United States Patent 10,662,479 (IMMUNOGLOBULIN EXPRESSION LEVELS AS BIOMARKER FOR PROTEASOME INHIBITOR RESPONSE) - sequence listing, part 2

SEQ ID NO: 369 - DNA, 915468 bp, Homo sapiens
gcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggtgctaggtcatctttgtggcatgcagaccctgacatttggctaggcaaactgaggcgagcggtcggtggcgtgattctctcccgcccccaaacacacccagtttatgttggagccgagctatgaatgaaaagtttgtactggcaacgtgttgcttgaggggagcaacgcttattggggggtacctttgatgtttcgtggaggacttcagttttaagtcaatacatcagaatcctgggttttaagaaaagttcaggaggctgggggatgggatgggagataaagcagttccttgactagtggaaggagagtgatgaatcgtaagcttattaaggtaaactggttaattagatgccatacgagggtgtcacagtggggactagagggaacggaggacgggggcgttccctgagcgcctagcaggctgcgtttgtttggctttgaagccgttatccccttgtccgcaatgagaggtgctggtgtcaggcctgtgtgtctgtgatgtgacagagcgggactgagctctctccagatccgaggcgcggttgtcaggagaggtggcctgcaacggagagctgaggatgcagttcctgtgatgtggacttggagaattctctagtgagtctcctgtgctccaatttcaggaagatctgtcaattgttttttcttccagggaggtgtgtgtaatctcctaaaaggaactttcagctttaagtaactgtagcattttgaaatcctataagaaatgagatatctacatatattcattatttcatgtatgtggggtgtgtatgtgtgtgtgtaaaatatgggaaaggggtaagaaaggcttaaaaagtttaacttctaccagaaaagaaagcgaagagttaatttttttctccccaaatggtataacaatgcatatacaactaaatactcttgctgtgctgagatttctcataaggagtaagatttaggaattacaagtattcagagcactgtcatgttttcaaatcttgcaggcactgtcgaaatctggaaaaagggagtacgtacatagaaaacccatattaaaggaaaaaaacattgaaaatctcccaaaagaaaaccttatgacatttgaaaaggcctggatgttttctgatgccccagaaatctttctaatcctgtaattaaaaacagcacagaataagttgcatttaagaaatcagcaatcatgtttaaaagatatcttttgaccttctttttcgtacttttgatttttattatggaaattattgtgactgaaaatttgttgtttaatatatttgccttttaccacagataattagtcttccttatccttttaaaccactgttccagtttggaccaatttaattccccaaacatcaaattactgatgttccttctggaaaccatttatgtttaaaatggctaataagaatattatatttccaaaacaacataatttagtcagttgtaaaacttgcttgtaatttattctcatccattttgtttgaatggggcacatttgaagaagagcagcattttcttagaatatgccattttctgtgtgggaaaaagctagtgttttcatatatgttttagctattaaacagatgcatgtaaggtggcaatcctgtctgacctttgataaactgccagccagagggagagagatgctttcttagctgtgctagtgaattgataatctttactacaaaatggacacggttagatgcacataaggttgtgcagaaggaagttaaggagttttaaattaaataccagtttatgggtaggagacagatttttttttttaaccttgatcttcctgtttctttctttctgcagttcagcctgttgggctggcctttattggagagtcagaccagcactctgactagagagtgtttagcacattaaagtgctgtcttttgtagaaataatgatggctcttttgcaattaaaaggtaattttatacatgcttatagatttttgtgattgtttggtgaccaaattaagcataaccgttattatggtagaaagagttgttttatgaagttattgccactatatataaataattatatatttaagatatagatgaattctatttgaggtttaggagttttgaatcttaaggccagctgaccagatataaacctatttaattaactaatttgaatgacaccagaattcagatttttattaatatctacatctaggtttatgtagctttcctttctttttattagaattacttcttttttgaatttgtttaaatattacaacatattacattataatttgtacacactcagtggggaaggtgcaggttattcttaaatagagatgtggagaaatagctaacaaggagagtcatttgagaaacatatggacatcataaaatccttctgtatgtagcatctgtaccttctcattagtgaaatattgtagttatggacattttttgttattacatccaaatgtggctttttatttttgcttcattggtttttttttgtttgttttaaaatacaatttgtattactgtttaagttggtgggggctcttactgcttgaagccttttgctttcaatagacatcatacttaatttttattgcatgcatctgcagatatatacaattgtttcccagtttgttattataattcttacactttttggtgattcctcaaaacatttgagagataagtagggtgacatattgttctcattttaggaaggaggcggcaggtacactgatatacccaacgttacaccatagtgaatcagtgtgaagctgagcttaacatctatatttcctgtattttaattatgagagcaagctgctcctgtgtcttatgataacttcataaatttatgtatttctagatttttaaagtggtcatctttatacatgtgcagatcagattttaaatcagtcaatatagtcataaggggatggatcatactgttggcctgttgatgggagagaaccatgactctaatagctactgctgaaataaacaaagaagcacacacacctctgcagaatatttgttcttgcaatcaatccatagtccacatatttctctgccctgctggcctcaccctatcaactacctactgcccttttactgatcaaagcagttcttaaagtttatcagcacagttgtcaagcttgaggatcatcagcctcactggcaagaaaagtcagaacctgatttttgggaagagagagtattgacgggggacagtaatggagtgttcactccagaggcagccagtagtggtcagagatcatattctgggtgtcgggatgtctatttctctcatcagctctgcttctttggccgaacttacaggtatcaaagtgaacagaaggtttatggaattatctagtcatttctttccatgtagatctcatatctgaataaatcagactttttttaaaaaaaagaaaaggacagaaacttgttctttttcttcatctcaccaaatctcctctccttcaaatcccactagaatttttttaggataattgcccacatgatttgtaacactaaagtgatagacttctgatattgcattattacacttaacagtggaatatattatccagcttgcagaaggaagcattgtaattctgtagataatggtaatatgtaatcttatgcaagtatttttgaataagcagacagtaccaagagctctccattaagctaatatgtatattcttactcttccattccctaaattacaaatggtttataggagctcatccaaatcattaagtatcaagtactgaaaaaaagttcagatgtggtttcctgtttactatggtgaattttgtttagagcttcaaagagaggaaaactactatctattgtttgctgcaccagagagagtataacgtgtttctggtgagcttgaggagcattgaggttgctggaaatggtactttcttcacatctctacagaagctgtgataagaaggagatgggtgtggactggtttagttctagtacagtagtgatgactggaatttgaagtgaccactgaaagggtaagatttggatagtctgtgtgtcactcaaggtattcagtagcaagtcatggaaactaacttagttaatataagcatcaaataaatttattagaggatattgactttgttttctcttgctgtgtaacacatttccacaaatttagcagcttaacacaacacccctttatcatatcagtttcattgctcagaagtccacacatagctcaactaggtcctctggccagagatcttctcccatgttggctagggctgcaatcccaacagaagatcaataggaaaagatccactttcaagctcttttctattattggcagaatttatctcatagtggctgtaggactgaggcctccattttcttgctggctgtcattcagaggctgcccttaactcttagaggctgctgttattctttgccatgtggccctctcataggtactgttacaacatggcatcttacttttttaaagctagcaaggaagtctctcttgctccagtctgataagaaagagtcttatatactataatataatagtgagagagtgacatcaggctatacaagggcatgactccttggaggtcagcttagggtatgtccaccacattgactagctcatagaatctctggtgtagggtgggcacagtggcttatgccggtaatcccagcactttggcaggccaaggcagatgaactgcttgagtccaggagttcaagatcagcctgggcaacatggcgcgaccctgttgctacaaaaaaatgcagaaaaaattacctgaacgtgatggtgtgtgcctgaagtcccagctagttggcaggctgaggtgggaggatcacctgagtctgggaatttgaggctacagtaagccatgatcgtgccaccatgctccagcctgggcaacacagtaagaccctatttttctttctttctttttttttttttaaaaaaaagaacctctggtaaagtcagcagacctgactttgaagccactcaagtagaaacaaggctccaaatccctctgcagaatttgtcctgtgaggtactgctgctgtcgctgctggcatatagcttctacagttgaatgtgggctctatatcataaaagagaggattctccacatataataatggggtcccattgtccattgccaaaaagaatgacaggtgtccactgctgagggaaagaagaaaaaatgattgcttaatgaaatgtttgagtttttggccaggataggcatgatagccttctagggatgggattgaattggaaagtgactgaagtcatgatgacttcttggaagagaaaactcttccaggatttaggagaataatggtaatgagggtccatttatgagtggtagtgataagaaaggagtagaaaacctttgaaagatgaatcactacacatacattagtctgggtattgacttaattagtccctaaatatattccacgcatgaaagacttttaagggactgattccactaatccttgcagggaaccagcgctgtgacttggaggcctgcagtgtggtctaccctcattttatagaaaggagtagagctaaggaccattgtactatatttgtggcccagtgactatagggtgctatgtagtgggttggggactattgaacacaccctgtgctctaagcactttgccagacacattttatctattttgtatctcaaactctggcagtttagtttatatttccctagttctgcctcccttctcccctggcaggtgtgtggagactttgaaaggctaaatactttgccaagggtcgttcagctaggggtggcattaggatttgaatccaggtctgattccagagcctgaagtcttgtagtacacatcccatactcacaagcagtaagtgaagtttccagggggaaagcctgttactcacattgaagtggatgtcagtgctacaattgctgttgggttccatcattcagcttgagagaactggatactgcaagatgagggttaaagagaggagtgagagagtgtgctgtatcatgccttcttttattttctcagcaggaagtacatattataggtctctcttagatctaaaagtaagaatggggagtagaggctgtgcatttttatttctacttatcattttggttaaaatcaaaagcactgtgtctcctttctttcctatatgtagatttctactattaaattaaatcaggtaacattatgaattctcattgcctctttggccatagggttctttctatagctttttcagtagatgccactgttttgatcttgaaaagtctattgagacattcttcctttgttcttctattactcagtccctctttctactctgtggtgcctctgaaatctattcatagatattctacttttttcttctgttttatgtacttaaatatcttctttaaatggatctagttccattgatcagaatcattggcccagatccccttgctgctccactgtacccaggaagtcttatctattttctgttaattttactgagttttactctacatcccagcacagtatgaggaagcctttaagatttccctgggtatctgagcctaaatgtaaacatttaaaactgaatacctcaaggaagagtatgattggattgtgttagatcaggtgcacacctatggactactccactgtggccaggcaaagggagttttattattgctccatctgggttcaggtgtccacccttctagaatactactgttctcaaagaaggaaattgtgagccagccccagcttgactggggtcaacagtactaatctattctagagcacactgtagctcaggaagtctctaaataaacttaatttcttcatataggttttagatttcctaaactagattaggccagatttgactttaaaagcccaaacttcttagcatgacacaagttctttcacagcctggacccagcctatctttgttacctttacttttttttttttttttttaggtgcagggtcttgctctactcccaaggctggtgtgatcacagctcagtataaccttgagctcctaggctcaagtgatccttctgtgtcagcctcccaagtagctaggactcacaggctcatgccagcgtacctggctaattaaaaaaaattatttattgtttatttttaaacattttttgtggaaggggtcttgctgtattgcccagagtggtcttgtactcctggcctcaagctatcctcctgcttaggcctcccaaagcactaggattacaaatgtgagccaccgtgccaggcccttacatttttaactgttgcaactccctgcctttcatccagtaaatcattaaggatttcaatcctaaacttggagctagcaagtggcttcgattttagataaacaggaatagccagcctgagagaatacatcgacgtgtaaagaaaagtcaagatgagagagagagaaataagtacatttcagtttttcacttcctgcatccagtcattcttaagtctcgttctatagctgattttttccacggatatgttatgtgagcaatgaattatccataaattgagtttctgcctcttgcaatggaaagagaaccgtgtagcataggtttctataagtgatcatctcgtagcgaaaatcagactttcattctgctggggttctgttgggggattaggaagctgtgcttctctgccctactttttcactgggcccagtgtatgtcccacctcttctgtgatgcttcccctgattactacaacacactgagatctcattcctctctgaattcctactgtagtttagggttatggctatgttttcgcaggcttacaaatggaattctagtattaattgagaaaatccataataaaaaggctactgtattaggaaagtctttaaaaggaatttgcatttttattaccccaaacagcatccttatatttttgaaatatagtagtatatttaatatacaggaggatttacatgtgtatttatggtcttcttgcaattaccctgtggctcgctagagattcatagtctcccaccacttagatggaaaagagggcagagaaggtttggcttcctaatgggtaccttctccaaataaaacaccacaggaagaatgggccggttttgactaagactacaggtctgtacagtatgagtgtgtttattttttattaaacattctacttaggtatataggaacataaatatgaatgcttttgcttatagatttcataaattataaaaccaaacccaacaaacaaatgttgaatataaacaacagaattgatgaaattaaaagaaacaacattgaactctgtgacaaatgatgctgtattgttgaaattacattgccagtatccagtttaaaagtataaagatgcagtctcagattctgtttttctttaatctatttctatgttttatatcaatatagatacaaaaattgtccttttacaaccaaacaaacaatgttaactttgaggctttgtgtatggctcaggataatcaggctttacacatgatcaaaattcctcaaataatccctcaaatgtcaggtttaatgaggtatcacctgagatctctataacatcttttcgttcccttgaaaatgtgattagtattgtggagtcatcgaattctaaatcaaatctgtaagctgtattccaagatttctggaatggagaacagattatgtagaagctacacagagataggatgcatgcattatcttcacactcatgatgattataacctctatagtacaggtacttttgcctgcctgtgctacccagtgttctgtaatgactcacttcatcctcaccttttctctaaacagactttatttgtttagcaacctttctattctttggtctccacttagtttatgcatgattcaaaacaccaagtgcaaacaacatgatgaaaatttggtggcagtatttagtttttaaacgtttattcagaaactgattagcatacaacatgtatatttagatgatcatcccaatgaaatcccaaaatggaaaaaaaaatatttcacatcaagctcatggacctcagtttgaaatacacagttgcaaatgttaattggccacttaaaacattttacatcttgccttatgttgtgtgtcattaatgaaattgtaagctccttgaggtgagactatatgcttactgttttgttttcttccatagcactgtgtgcatttgttatagttggtgaccaaaaagtgtttgctgattgaccgattattaatatattgttatttcctattgctctgtgactcaaaggcagggactattttgttttaatctgtggtctctgaatgcgtagcacagcaactctcacatgagaagtgcctaataaatgttctgaatgaaagaatggatgacttgttggctttgtgtgtgtgtgtgtgtgtgtgtgtgtgtgtgtgtgtgtattcgtactcttttagatctaatctcttatgtacagggcacttctaacagttgtatagattagtgctgtccagtaagattttctgtgatgatggaaatattctatgtctatgctctgcaacatcatagccactaggcacatgtggtctttgaaatttagcaaatgtggccaatggcctgaattgagttttatttagttttaatgagtgcatagtcacacatggctagtgggcagcacagacccaaatgataaaatgtactttctcaaacttatttgctctcatatctaacattattatattttttggttataattggatgttgttatttgattttgttgtattggatggatgaagtgagtttatcactttaaaaatagggcaatatagtccaccaagttgacttcattctttcctaaatgaccagcaacattggatgtcatctgttcacttgccccaccatctattttggtatttcatcatttccttattaggctagaggcctgacaccgctttaccaaataagttttatgtacacttttacctttttttttttttttaatgacccaggttatcttgcgtttgcttgtctttctgttttagtccttttttcccctaataaaccatttaaacttggattatctatatcattattatcatttttagagacaaggtcttgctctgtcacacaggctataatgcagcagtgtgatcatagctcactgcagccttgaactcctgggctcagctgatcctcctgcctcagcttcccaaggagctgggactacaggcatataccaccacacctggctaattttttattagattttttcttttttagagatggaatcttgctttgttgaccaggctggtcttgaacttctggcctcaagtgatcctctggagtaactgagattataggagtggaccactgcacccagcctatattatcattgttaataccaccatcatcattttcatttctggtgtttatgctttgccagcccatatttgatgttgtgtactaacgtctactgatagtctaaacacatttcaaatttattataatctgaaaaatgtctgaatattctttttctccaattgttttctttgcttatcttgcccttttaccctttctggtccagaagaatgaactagcaccatatgcatttaaacattacaactcagtccttacataagatgtaatcccatcatgacaagtttcactgctgttgccaaatccgtgaaatcgatactacaggactgtcatttagaaagacaggaattgcttcctgcaaatggctgagatctttatgcaatttgtagttctgctggagcaagacttctaagttattgtacatatattgaacctcagtattgggtatattcaattctcctttaattcttataacagtattgaatctagtagtatgtaatggttatagaggctatctatgcaaataagttgaaatcagctctgctgactagcagaaatactttagaattttccactcattttctgtttactgctagagatttaattgttgtcttatgtggcagaatttgaatgcacagacttcagcatggaagcttgccttttgttcatttttttagtctagcttagtagttcccaaacttgagtgtgcatcagcatttctgttcagggcgatacacacaaaagattgttaactatactttatggatgagttaacctcttttcaaggcagttttgtctatactagattttcatcttggaacctacctttccctcattaccccaaagatgcatctcctctttattccttctatttctactttcagtccagcacacagctgctcattgagtggacttgtagatgtgctcttgaatagatttcacacaatgggagacaaattcagtagcaatatatagaattttgaacttgtgaatccccggttgagcttttatcttcttattgctttcatatgcctctctatggtgagaagctagtactgctttgttatcttctttcccaatttttccccataaacattctcctaaaaagccctaatgatgtaaatgatacattatgttcattcttgacaggttggggaaatgaggaagggaactttcctttgtgacttgtgctgtagatatattttaaaatctcctatttatctatttgacccaatttttaaaagttacctacattaaaataaatattaaataaatttagtattataatgaaacagtagtttgcttttatttataaagttcatctgggtgtgttggctcacgcctgtaatcccagcactttgggaggccgaggcaggtgtgtcacctgaggttgagagttcgacaccaacctggccaacatggtgaaatcctgtttctactaaaaatacaaaaaagaaaaaattagctgggtgcggtggtgggcacctgtaatcccagctacttgggaggctgaggcaggagaatcgtttggaccctggaggtggaggttgcagtgaactgagattgcatcactgcactccagcctgggcgacagagtgagactctgtctcaaaaaaataaagaaaaaaaaaataaagttcatcaaaggcctttgcttaaacttatgagataacttgtttactaaccagaacacccttttggagttacttactgcttttctctgtgagaacaaacatcatatattcaccttaacttatattttcaaaagtataatgctaagactactcaagccaagtgggaaagtgtaggccaaatggaatagtatttcagaataacggctacagttttaatttctctagaatagcagatctgaaatattgttgtgtgttctaattttcaggtaactactggaaactcattaaaatatattttataccctattctatttttcttacatatgttataaagcccttactacattcgtattttattaaaacagtaattatttaaagatatttatgtaaaacagaaatcttttgtatttactcgagtagttaccatttcagtgctctttattcctttgtctatatccagattttcctctgatatcctcttccttctgcctgacttcctttaaacattccttgtggcacagatctgctggtgatgaatcctatcagcttgcttttgtatttctgaaaatgtcttatttcaccttatttttgttggatatagaattctaggtcagtttttttcttttaatagtttaaagatgttacttcactgttttatcatttgcatttttttttacaagaaacctgctgtcattcttacttttgttctcctttatagatatcaagtcctataacgtattctgtttattcctggttttgaacaatttgattttaatgtatcttggtatagctttcttcatgtttcttgtgctttgggttcattgagcttcttgggcctgagggttaatagtttccatcaaatttgaaaaaaaagttagtcattatttcttcagaatttttttaggagtccctcctcttttttctcttattcaggaactccagttgcatgtatattaggatcactgatgctctgtttgtttatttttattttttcttctccatatgttacattttgagtagtttctattgctgtgtcttcaagttcattaccaagtagtcatatttagtgtgttctccatctcacacattgtagttttcatctcttgaagttcaatggggtgtttcacaattttccatgtccctatttaactttctggacatatggaatagattcataataactgttttaatgaccttgtttgcaaattctaatgtcttttttagttcttggtcaattttgtttgatagactttttatccttgctattggttatattttcctatatctttgcatgcctagtaatttttgatggatgccagacatcgtgaattgtagggtgctggatatttttatattcctataaatcttcttgagtattttttttctgggatgcaattagttactgggaaacagcttgatcctttcaggtcttgtttttaagattagtttctgagtactctacccaacaccccatgaattatgaagttttccagtctggctggtaggaataggcacaattcccagacttgtgtgagtgctgggtactgttcccattaacactttcaggtggttcttttcctaactttgggttgttttctcacatctgtgtcctgatcattacactgctgaatattcaaggggggagctcatttgtagacctctgaatatctcttcatatttagctttcccccctccagtactctggcctgtgacatccagctgctctgatctccttagttcctccaattcatctcctcaattcagggattattctaggctctgcctgggttttcctttcctgggccacaatctggaagctggactagtcatagagcccaggtcatcagtttcccatttcttagggttcacctcgtgtgttttctgtttgtcaaggattattgcattgtgtccagtgtcttgaaaactattgcttcatattttgtacagaacttttattttcttaggcagggggataattccaatccctcttactcagtcttctttggaagtggttcccccattccttttctcttccatgtaaaaccttgttggtcaatatcattttggcgactacttaagtatttaatgctcaatttaatgtagtttattttgatattctacatctttcttttcagcagtttccaaattttctttaattaacattttatattacaagcatattttaaaaaatccattttgcacagttatattctatatcatgcttgatgcttttatcactgtcctagccattcaaaaccattcttaaggcaagctggtcataaaataaggagttaaatttgttgagcataataatttacatgcttttaagtggataaaagatgccactatgggaaagtaccatgttttttaaggatagaagccaagtggctttgaaataatgtactcttgaatctagtaaatgtgaatgatcataaaacagctcataaattactatattttaaattggatcacttatggattgctcctcttttatatttattcaggaggttctgtagttcatggataggccttgagattgttcatatgtcaagcaatagtgaactatgtgctggtgaattattttatttttaatcctctctcatatttgaatgataaaatatactactgtgaactaatatgagaataaagtgtcaaaattcaggagcacatcttgctatagtgaatacatcttgttacttcaagagttttctggcagtaagggcacaattgactgtgataatttaaaagaatccttgaggtggtatagttccatatgtcgtaggaatatgtcaatgattttttaattttgcaatttgagtttttaatgtagtcttttgaaagctagttgttaagcatggcaagaagactagagttactttagaattcttaggaaaataattttgtaagaacaaattaaaattaactttttcttcagcactgtcataaatatcagcaccatgaagccaaaattgtggcagtgttacatggctatgtttccaatatttaagaataaaggttaggccagatttatattctcttgcaaaattgaaccaaaatataaataatttatagaattttaagaatagaatcttgaaaaagcgaatactactctgtgagggagactgttagttgtctcctagtctctcttttccccactgtcctcagacataaagcacctaagttttagctggggacaaatccctacaggatagagatgacatttcttagccttccttgcagctaagaattttaaaccatgtgacaaagttctgaccacaggatataaacagaatggttatgtgcaacttccaagtaggccattaaaggacggggtgtgctgtctcctttcccttctcatttgctggaatgtgggaataatggttgcctatcttagactttgctaaggatgccagcactttaagaatggcagagcaacaagatttttaaagaaggcctaggacagtgtattaatctgttctcacactgctaataaagacatacccgagactgggtaatttataaaggaatgaggtttaagggactcacagttccacattgcgggggaggcctcacaatcatggtggaaggcaaaggagcaaaggcacatcttacatagtggcaggcaagagagcttgtgcaggggaactcctatttataaaaccatcagatctcatgagacttgttcactaccatgggaacagtatgggggaaaccaaccacatgattcaattatctccacctggctccatccttaacacatggggattattacaattcagggtgagatttggttggggacacagccaaaccatatcagactgtgatagtgacatttttactttattattttattttattttatattcgggggatacatatgcaagtttgttacaagggtatattgtgtgatgctgaggtttgggcatctgtcgatcccatcactcaaatagtgaacatagtacccaataggaggtttttcagccctttgcgccatctctctggctcctcccttttggagtccccggtgcctattgttcatagatgatgacttcttgaagcagagttgccataacagcttggagtcttgtctaactaagccactgttattttcagtctctgtcacgtacagccaaagctatatgcagtaagtcctcacttatcgttatggataggttcttggaatctgcgaccttaagtgaaatgacgtacaaggaaaccactgttaccacaggctaattgatataaacaagagttaagctcctatggcatatttctggtcacaaaaatatcaccaaacttctacataaagatcgaaatatttctaatataaaacatcggaataaatgtgagctatacatacataagaaagattcctaaaaacaagtctgaaaattgtttacccacttacaccaattcatggtcttgggtggccagagccgatcccagcagttcagggcaccagttgggaaccagccccggacaggatgccatcccatctcagggaacactcatacccacccacattcagaccgagactgtgtagacacgctgattcacctaacatgcacagctttgggatgtgggaggaaaccggagtacccagagaaaacccgtgcagacaaggggagcatgtgcaaactctatgcacacagtggcccgggctaggaagtcattttttcttttatcaactttataatgaaacaaatgaaatgacattatttgagaacctgctgtacattgttcccataattgtatttttttttttgtttataagacacattaagggtttctttttgtaaccataagcttgaaaggaccaagtgatcatacatcatagagatctaaactttttcaaaggccttcatttttttaaaaccagactatttcaatatctatcagctgaggtgaggaacacaatataattaaacttacctggctcttgtctgagaaatttaaaaaaagatttgaggcacttaaatccttatgctgacttttgaaaaaaacaagggttgggaaaagagagaatgctaagttgttcagctttctactttgcccgcagacaccaaatattttttcaattttcagttcccagtgtgaaaagactccctataccatttcacactgtttactactcccccttttggaaatgatcatcccagagcttctgggatatcatactctccagtttcctcctctgcctctgctctctccttgtctcctttttgggaccctatttaattcactccctcagtgtgggcatattctgattcttggctcacttttccctttactctgtaagggagatcacaaattggcagcttatagacatgttttgttgatgccacacagaattcaaagtaatttaaattttgaattaatcttttctaaaggctatttccttttcctccccctttgttttcaattccatttcctccttcagatcatttctactattatcttaatcagacaatcatgttgtcttacctggcttccttgcaatagaattctaaccaatattacttttggaatagcctttctaaaatgaaattttaatatttttctatctagcctcaaaactttgatcagctcatctgctttctagatgagatttcatctacatctagatgctttctagatggggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctagatgctttctagatgtagatttcaaactctggtgttggtatgaatgcaaaatgggcacagccacttcagaaaacaattttggtagttcctcaaaaagctaaccagagagttactatattagctaggtatacacccaaaagaattgaaaacatatttccagacaaaaatgtatatatgattattcatgtccatttataatagccagaaagtggaaacaacccaaatgtttaccacctggtgaatagataaacaaaatgtggtgtagttgcacaatggcatattactaggtaatcaaaaaggaatgaagcagtgatttatgctacacctgggtgaaccttgaaaacattatgctaagtgaaagaagccagacttacaaggccacatgctattttattcaatttataggaaatagccaaagactaaaggtagaatagtggttgcctgaggcaaagggaagggggaatgagatgtgactgctaaaggatatagggtttctttctgtggcaatgaaaattttctggaattagatggggctgatggctgtatacctctgtgaatataataaaaatcactgaattatatagattaaaagggtaaatttttaggtatgtgaatgatacctcagaaaaagtcagggaacgcagtgaaaaacaaaacaaaaaccgaaagctccttagaactcaagatccttcatgatctgacctttgctggttttcccagtctcatttctgggtactttgtctttccatatccattgcctgtctgttcctctctcccttgcactagtctgctaatctacaaactcttccaagagttccatgctgtctatgagtcttattatccatgcacacatttctttttttttttgagatggagtcccactctgtctcccaggctggagtgcagtggtgcgatcttagctcactgcaacctccgcctcccaggttcaagtgattctcctgcctcagcctcctgagtagctgagattacaggcacactctacgacacctggctaattttttatatttttggtaaagatggggtttcaccatgttagccaggctggtcttgaactcctaacctcaaatgatctgcctgctgcagcctcccagtgtgctgggattacaggcgtgagccaccgtggctggccctgtgtacacatttctaccagaaaagtccttcccactctcttctcctcacattcatctcttaaattcctgattttcttttgagttcatatttcacctctcctggaatccctttttatacaccagtgctggaatacttaatagggggattatgtagactcttcagggcaggcaggagtaccctacaaatgaaaataaattaactttgatgagcttataccacctttgcaatcagaaaatcttgaaagaagcttttttgagtgtgcatgtaagtgttatgtttcatagtttttaaactttaaataaaatgtagtggactgggtatgcaactatgatattttagaacaagcatcatgtcacaatattaatctggctttgctgccccctctcccctgccctgtgtagattaggagcaaacctagggtgtttgcgcttcccaaatactctgggcatcccttgctaccctaaatggtaaatatccgtttctttttctgtctctccatctagactgggagctgcttagtgataactgctttgtctttcattaaaaaaatctttacaactaaattccagtaattctccatagaaagtgtttggtaagttttgaacaaatgattagacatcctttgtggtcaaatgtaggcatgtgagagagactactagcatttgccctactgaagatcagagatctgaggacattttaagaaatgcctaattagatggcttcattgaaatacaacttgatctctttcttgctctctctctctctctctcacacgcacacacacacacagacagacacctcctttaaaaagctaattcaaaaagagtagaagcaaaaaagtgagatttaaaactttttctcaacctatacacctgaggaaggtgttagatttaaggcctaaagtggattttaaactgacacctcccctaacatatttttaaagtgttttctgtactttttaaaacagcttttctttttcatgtcagcaaattcatgagttaacattcatgtactaacattaactcccattttggacttgctcattatgcagtggtagatagtggctggttaatgttttctctttcaaaaatgtgattatacttagttatttataagtaattcccccttttttacctttcatttttaaaactagaaattcttgtttcgaccctatatgtcttatttgggttctctgaatcagattcttagacaaagatttgagtgcaggtagtttactaaggaggcattcagtaaactgtttgtattaagcaagttactgacttgagcaactgaaattttaattctttcgggggacctgtgaaaaatatgcctacaattagctacatgagaagcaagggagttgggatatgatatcctagaacctgttagtccttagttgagggctcttctagggggtgttaatacccagagtttccaactgcagtgcaggtccagagaaaaccctcaggtaaagaaataaaagggttgacggttggaagtctgtgggcacagattcaagtagcaatgaccagggagtgtggggcagtaccaacagcgttcactgtatatggagatgggcgccatcatgggaggagtgctcaagtgtgaaaaagcccagaatttaagttagtttttctcaagcatttactcagtcctcaggtaagtacctactgtgtgtaaaggctgtactaggtaatgggatgtatgaattcgcttgtagaggcaattagctgtttaaagctcagtttctttatttcaaatgagaacttattttctttctttcaaaatggagaatcaaatgagatcgtattcctgaacatactttaaaatgttgagagcattttacactcatctcctttttttttttttttttttttggatatggagtctcactcttgcccaggctggagtggcagtgttgtgattttggcacactgtaacctctgcctcctgcctcccagattcaagcgattctcctgcctcagcttcctgagtagctaggattacaggcgcgtgccaccacacccagctaatttttgtatttttagtagagacagagtttcaccatgttggtcaggttggtctcgaactcctgacctcatgatcctccctcctcggcctcccaaagtgttggattacaggtgtgagccactgcgcctggccacactcgtctcttatcaggaatatgttagccagtcaaaagcttgttttcttcttaggccatgtgaatttggcctctctgcgaaacatgtataagacagtaaatttaaaagtttcatgaaaggaataaggtaccatggggatggttatttttagccagttggcagtgaagacttcctggggaaagtggataaaatggaccttaaagtaatggataggaattatccatgtggaaacagggaatttctgaaggaacagtgaattccaggagagcttgagcaaagccctagaggcagtgcaactgagaaccactcagtacccaggttaagcattttttcccccttaactacaaattgaggatattagtactacctacactataagattgttgtaaggatatcttgtaaggataaatgagctatgtcatgtaaggtaggtaggttagggtaaattctaacttcatctgtagcttttggtgtcagtgtagtttctgatgataagttatccagtcccaaagaaagcagtgtttcctaaagtagatgggatgtaaaccccacaacatctgcaagaaaaaaggattatgacattaaaagaatttgagaaatcctgtgtaccatacatagatggatttcatagagaggcacattaagatattaacagtgctgagaagtgcagcaataaataaacctttttttttttactttgtttaatgctgtgtattaaatttctttaattgctggtttcttttctccccttaatgtaatacttattcatgttggacattctttgtaaaatgtgaatttgaagagcttcatgtggtgcgccaaccaagttaccagtacttacatatccactttaatgttgttaatctatcttaaggagttgtaaatggcttgaaataataagaaactttgcttaaaatactttttgtgattctccctctaggcatgcttctgagcagtttcttagtcattgcccccacatcaatcattgtatggtgctttacatatttcattcctcattttctgcacagaattgtattgctcaccccatgatttctcccaggcctcagatctgctcagaatgatgtttttttggcctcacttgagataatttaaagaacattccccagacaattctgaaagttgacttccaaaaatacttggagtaatgccatcatcattaaactaagtggatgactttcaaggtgagtggttttaaaagggacagcagcttcttggacgtgcactttctctgcagaacaaatggtttgtctttttatagtcatagaaggagctctgaattcctactatgtgtttgtccttttggtagatatagtctattttgggcagaagttcatagtctactggggtaaaaaataaatgttcaaaagtaaccactgtagaagaggatagatatagtcataaaagctacagagtgttatcaaagtacagaggaggggtcttccataggggtcaagaaaagtggcaaggatacttacgatgaaccttgaataccacatgaacaatagagatattccaggcagagagaagtaatgtgcagaggcccagagatgtgacaaaggacaaggaactccatgtaagtgcaaatggagtgtagactccacatgggaatatggatggtgagtgaggctgggaagccagatggagtcctgactataaagggctgtgtaagtgctggggtaaagagtttggagtttagcctctagatggtagagcacacctgatagattattagacagagatggccatagtcacaattttaagcaatttggtaagtggcaactatgcagttgagttggagtgaggaaagacgggggccaggagcttgggaggctattacagcggtccagccaacggggagtctaaactgaggtagtaattgtgatgatggggaagacaaaatggatatgatagatatttaaaagatgaggaacggagatgataaggggagtctgggattctttcacatggggaagagtttggatgttggtataggtcagtgtaattagaattcaggagagaaacacattttaagggacatttgctgagttgtattctgtatttgttgtgtttgaagtgcttatgggttattcatttgtattttcatcagttcctagagtaagtactctgtgccaaacaatgtgtttgactctgaggatgtggcaagaaaagagtcagaatgttccatgtgcctgtgaagcttacagcttagtgggagagacagacgtaaataattacccaactaattacttcattagtaagtatagaagaaggggacctaactcataaggaagtcttctgtccattctggaacttagcaaaatagtttggtctgcaaagtgacagagatttgaggatgattggtgagtagttgctaactgaagtcattagtgagattgcccagactaggtttgcaaaacaggcagaaaaggaggcctaggttagaatgtgaatatttaaggagaaagttagataaagtcctaaaatgaagctggaaaagagtggcagagtatcactgcccctcggtatctgtggtggattggttccagcgactcccttggataccaatatcagtggatgcccaagtctcttgggtaaaagggtatagtgtttgcatataatccatactgtatactttaaatcgtctctatattactaataatacctaattcagtataaatgctatgtaagtagttggtatactgtattgtttttcaacttgtatttttatattgttattgcttatttatttatttttaaaaaatattttgcatttgcaattgaatttggggatgtggaatccatagatacggagggccaattgtaatttaaaggtgtatggaaagggttgggaatgttgccaagaggtcacataaagtaaatgtaagaggtgccatgggctttgaaactgcagttccatgctggctctagcaagagcaggtgcagtagagtggtgtatgtacaagctgtatttcctgccagtggtgtgctagatctagcttatgctgccttgagagagctggattgttaaattttcaggaattatgcaagctggttgttaaaatagccattagtaaaaattaaagtatgtacacttacaattaaattgtattagaatagatgtagtaaaaatattaaagctcatcctccctaattattttacaacatttttctattatctatgctcttaaggttatttatgtctattattttcctgaatgggtggatgtactatacaatggtgtactaccgcacatttcttttcaagtctatgtttattgactcttgttggcatattgaaattagccaaagtgagagtatttacaccgtggaaattggcaaataaatgccacaaatcggagattttgttttgttgattttctagacctgagaaagtgatagagaaattgttaagaatgcggactacagttaaacttgtgttggtatacaacaattacattgtgaatggcacaaaaaaatcgaggaaatggtctttcggtacttgtgaactgtcatccaattcaataaagaagttgctctcaatattgatgagtaagagaagttccgatatacacagtcattgtttcactttcttcttacttattaatgcaaaagaaaatattattagtgtcagaacctaccaggtttggtaagtattaatgaaagcattttgtaagaaacagttggctatatggaattttcagtaaaggatattatatgttttattattatttgtcaattgtgtgctgtatctcctttattttagtacaatttataatgaacatatatatgtgtgtatatacacttttattttgatgagagccagttgttaacatttatcagcacacagtggctatatatatgggatgtgaagaagcaggtcacacgtacttttttgaaaagtatggcagagaagggatgttgcataggtactaggttggtaggtagtcagaagatgtttacaggtttgggagagcgtttgtttgtttgtgtttttccttgagtggaaagtgagcagccagtagagagggagagattgatggtacaggcgaaggtggaagtaaatgttagaagaaggcgataaagaaataggaagaaataagatatagactattgtgggaaaattaaccttgaacacaggaaggacccctattcctgtaaggatgaggaaatgataaacataagatgtgataaattaagtacacgtacattaaaatcacgtacatcagtgaattgtaatttaagaaataagaaggatgaggtcaggaaaagaagctcagaaagatatcagttaatttatgaataaagtatagattaagaggtgaatactatgattgaccatggcaagatttcatgctgatttaatctctgaactattatgctgtatttttagtctgtttttctaggctgaaatatttaaataaaaaatgagagacaatttgaaggcgcctcattgcatttaaatgccaactattatttcttttacttagctttgcaatgtaatgctacatttccatggacacggattaagtttctacgagatgatcagaaatgggatataatttgaggttgactaaactacattcattgcatgcatggatagtttgaacacaaggtaaaatgttatccagactgctgaagaaaacaagtcttattttggaacatgactttcttcagcattataatttatgactttttcacttggattcttgcttttaacacactcttatttgtatatgtatgcttcaattaaagaaatgcataacattttgcttacactgtcttagttctattagttttcctgtattaaaatttgcagtccttatatttctctcagttgaaacatagtaagatacagagcttttttttatatttgcatggtagtttgacatttcaaatcttttcagatctattttctgaaatattaattatcctaaatattcatagagattggtattgatgatgctaaatatggctgttgatattgaatatacatatgtaatctgcccttagtgtgccattgtagctatcactttgagcctaacactgtagttacattccccctcaccttgcagtctaacagcacctcagacatctggctgaggacctcaagactttggaaaaataactctgcatgtatgttttcagagttataacactgttgtagcccactcagacagctggtccttgtgtttgttgattaatttatggttgcaagatgatactgtggtctaaatatcatgttcaaggtagaaaaagagggaagaatcagcacagcactagccatgtgtgtgtctggtttaatcaaggaagcaaacgcattagagagacatccttagcggaattcttcttagacctcattggccacccttggctacaatagagtttgggaatgtgaatatttagctttcccacatctatattgggagacagcaaaggagaaattggtagagaatgactgttgttagccaattagtagtgtttgccaaaggggatgatctcaagtcctgtctagctccaacctttgcatttttactatcagttgaatgctatttcacctggaaggctacctttttagtccttacctgcaggcctgggacaaactttgttgacctccatctagactatttttaattaataagtgaagacctgacacaattccttctggcggagaggatccattcttcaatgtcaatctagatggagcagtccaggaagtaaccccagacttgaaagggaaccaatattaatgacatctcattctcaagcatggctgctgggaaggcttctgtaaaaaagataagcaaagaggaaagtgatctgagaatctgcctgataatactttttatatctgaacgatttaaacaaatatagctgcatacattgctgggtggttttccgttttgtgtgggactatatattcagacttcttgtttgaaatatgttagcctcttcgcagctaaaaaatattagaaacgagtgaaatttaaggcaaccatttgttcatacactcccagggagcatagagtatagattagaagtgtataagtatatttctaaaaaattcatatgtccgggcacagtggctcatgcctgtaatcccagcactttgagaggccaacgtgggaggatcacaaggtcaggagatcgagaccatcgtggctaacacggtgaaaccccatctctactaaaaatgcaaaaaaaattagctgggcttggtggcgggcgcctgtagtcccagctacttgggaggctgaggcaggagaatggcatgaacccgggaggcagagcttgcagtgagcagagattgtgccactgcactccagcctaggtgacagagcgagactctgtctcaaaaaaaaaaaaaaaatccatatatggatcaatcttgcagtattcacatttgcaaaaatataatacttctgatcttctaggcaagtgataattcttttagatttgtgagaatatttttagatgacaaaaaaattggttgcacaagtgcatgaaaagccaatgattatgttatttgcaaaattacattccaccatgaaaatacaatgagatataagtttttctgaaaatgtagtagattccagtattgggttaagtcatttacattttatattattttatatccttgagggagttactattattttctccttttgaggaatttgatgttcaaatcggttatttgaccagtgtttcagtgccagtaactcatagcagctatactgtgaaaccaggcagtttgccatacctgccagctgtggacctgtgctcctagtaataataacaattaggcattatgccaaagattttatagtcacttaatctattattcattaaaatcctagaagctgatactactatcatcatccctgttttaaagctgagaataaatagtattagagagattcagtagctgtctcaattttttgcagcttccagggctaacctgtggcttcaaactcaggtatctgacaccatgtggaccctaaccacttcactacattgatacttagttacacgttgaattgtatctctatagttttctataaaatgtagtgtttatttctatagagaaaaattcatccacgttttgaaattcaagaaaagccttctcatgtttctcaatggtttcatgctgagataattttcctgtgttagatcaaatttgctagcaattttcgtggtgtatgttaatgaaaatttgatatgcattgctttgtttcttgcatatataaccataatttagattagttcattttttaggtaattgaatttttgagaataagaaataaatttatattagaaaaattccagaatgagaaattggacacaaattctagcaattgtgaaaattatgcctgcttggaaaagttacattttatgttacttgctaaaattttttgaaaaggataaagtgatcaatttatctgtcaactatcactttgattaaatgatattaatcaaaagtactgtgtattcccttatactgtgaattatgattgggaaaaatgtgattgatattcagtgtttaaaaataacctacctctttatagaaacagctatatgaaattatagttcattctagatcaatagtgctttggttttggttaacatatgtatcacataaaatatatatgttttggttaacatacgtatcaaataacatatgtatcaaataaaataataaaaatttatttttttattaacaaataatagagttgatttaataaatcaactctattattctaggcagatttcatagcctaactccccttcaccaaattcagtgctgtatttcatagtgattgactcagaggagaaagatctgtgacttctatcttgctgcatgaccttggggaaaattggcttaaatgtatgaaaggatatttcaggcattgactcagactaaataaatgtgctaaatttgatacagtgagtgggaaatttttctcaccacatggaaccactaatgagcttgggaagtaaacatagttaagtaggcatagttgcctttttgttacaatcattctgaattggtccattagcctgaataacatttcaatgaacttcacatttgtagctttaggattgaccaaaccaaaccgcaacattataaactatttccaggtgagagggttgtagtgggttgaattgtttttccccaagaggtctgtttaaatctgaacccctggtaccagtgaatgcgaccttatttggaaaaaaggtctttgccgatgtaatgaagttaagatgagatcatactggagtagggtggcctatcaatccaatatgactggtatccttataaaaaagaagagaaggtcaggagatcgagaccttcctggctaacacggtgaaaccccatctctacaaaaaatacaaaaaattagccaggcgtggtggtgggcgcctgtagtcccagctactcgggaggctgaggcaggagaatcgcgtgaacctgggaggcggagcttgcagtgagccgagatcgcgccactgcactccagcctgggcaacagagcgagactctgtctcaaaaaataaaataaaaaattaaaaaaaaaaaaaagagaagagatagagagactgagatccccgcagggaaaacaccatgtgacatcagaggtggagactgggatgatgcagcattgaattgatgcattgggatgatgcacccactgaagaatgctaaggattgcctgccaccagcagaagctaggaagaggcaaggaaggactccatccagagtctgagagggagcgtggacctgctgacaccttgatttcagacttctggccttgagaactgtgagaaaataaacatctgtggttttaagctgcccagtctgtggtactttgttacggcagccctaggaaaggaattcagaagttgagaatggagagacaatggagagaatgaagagtcagcagcagtggtagtgctccctggattgactctttctcctgtagttccacatctttcctcctctcttatgttattatcatacacattagacaactgggctctgtttcctcccccttcatcacttacagatctctctgagtctcatttgccttgtcagtgtgatgaggatcttaaactcctctgagtaataataacaaccaacatttatgggagtttaaccccatagtaaagccagggctcagggttaacatgcattctttcatttactcctcaccagaatccatgaggattatattgttattatccctacttcacaaatgagccaagtaatcacatttctctatgacatcttgctttctcttgccttgttccttcagagacttgaacatgagagtcagaactggaatattgtcagtccttatggttccttgatgggaaatatagcagatccctaactttacttaatctgggtagaatgggggtgaaggccattggaaaggaatgttacatcaacatgttgtgtttgtcttggccatgtcacagtttcttcatgtatagaacatagaaattttttataaaaattctttcttcattatatttcccctattttattggggaaaataattttaatataactcccttattttctagcttgcttgacaatttcactgtctgagctacttaggatataacagaggaatttaatgatatagttgctattattgacattcaccatgtgctaggaacagcattatgtacagcagactatcagatgggtgatattattactccacaccctacagtccagggcttaagaaagtaacatggtccaaattactagccttcaaatccttgtctattttgtatccagagcctatttttgtatattctttttagggaaagccattactacagtgacatggattaatttatcagattaatgctgaacttggaagctggacatctgggctttaagagaatattggccaagaaagggtagtatgggaaatcggaaaacacctgaaaagtggcatgctgaatgcaggtagcttagatttaagacggcatgagtaccccatttttgtcagcatggggatatcagagttgaacctggcttctttcagaatattttatctgaagctcttctagagttagactaatttccttaattaccataattagggccaagcaaaaattggatgtttcctgtttcactttttggttgcttattttctctgagtcaagaacatgataacaaactttacactctatttctaacatggaccttttagtaaatggtaggttactataacagaaaagatgctatatctgaaatcaaagtgcaccagtccattgcatgctccatgctatttccttgcaagtctagatactgtcacatgcctgtaatactaaatagtcttagaaaatacagcaagcagcagtgttggaataggtcttagaggcaaaactgatctgaccaagcaatgtatgttggttaagtgaaatatgaaaggcagtctgttctatctcagctgaggacatttgccatagaaaatgtttgttatggcacagtagagagaccgaagctaccagtttcttaccaccaaacttgtcttggttgaatttgtctcctgtcttctaaactctagagaactgtcggtcttctgaagaactgttcagcgtagtgaaggaaacaggaagagagattgaggagcttagccagttgatcagagggatttaatgggaaaacacacttggatagtgaatagacactggaaaatctgactgtctaatttggattttcccaatatacctgtcatggtaaagtgaaatatctgttggactgaaagtaagtgtgtcagttattttggtcacagctctgctacaaattgacattatgactgggaagtggtggtttgtgcccataactttctccgtgagtcaaagctgtgggattttacatcctttcaacttctctcaaaattcttttctacttaaaagaccataggtgtcatattgagaattcatttcatcaagtattgatcaatccttggggtgtttgccatgatcttgtcatgctttccatctttgccaccaaagaatgtttttgggggtaatgtatgggaagtttgaaatgtgaattatatcacagtttgtatctggaaatcagtgtctaatagataatgatgatagtgactactgtctagtaaacatttactactgggtagaaaagtcaccagattctccacaggagaagattttgctcccttgggacatttggcaatgtctggagacatcacaacagaagggaggagtgctactggcatctagtgggcagaggccaggggtgctgctcaatatcttacattgcacaggacagccccccacaacaaagaattatgtggtccacaaggccagtagtagtaaggttgagaaatcctgctttacagcttgtttaataaatatgcatgctgatcatagaggatgttatgctcatcttgtagctgaggttcaaaagggttaagtaaattcttcaatgtcaagccattcattagagacggagccagcattccattccagtctgtaaagccaattgagggatggtccccaaacacaaaccttttctattttgctgctttgggaagttttcttcatcctcgtttcttcatttttaagataagaagatctgtcctttaccagaagtttgtagtagtatatttgggtgggggtaggcagcggggagaaaagacagggggtttggagattttcaaaaagttgaggtattatgcttaaatgtaatatttttggcaaaaatctgtagtcataagcagtgtgggtgaaatacaaagtgtatatttagactttagtgttgctcatacatatgcattgtttttagattaagaatgagagcttttagtttttgcttctctttgtatctttcaaaagcaatttgatttgctcttctcttgggcatgatggtgatttgtagagcttgctggttgttgagaaatcgaagactctttgtgggttcttaaggatgagagtttacttccacactggcagtaaggtagatgttgggttttggacttagagcataacagaagacatagagatgagagaatggccaaattgcattttagagaaagaagtgcggagaaccccatgagaaaactgtgttttacttacatctctggtcactgataaatctcaattttgggacaaatcctgacagataaggaaggttattggaatgtaagaggtaagaaaaagttaatttaaattattttatttgaaaacttacattttatgagtgggaagtgtggtttaaggtaattggcaagactccctcctctagaatattaaatttttgtcaaaactgccttttgaatagagtattttgggacttgcacattgaaaaatataggcagttgccttgtgtagggctatacttgcccgtagagttttacacttccacagggtgtcgggttttgttctggagacttgtggcagcagctttagctgctttgtgtgataatcagcacacagagcaaaggcacctcagtaatttactgggtgttcattctgtcaattggtaggtttaataaagagagaaaggacaggacatgtagctaatacagccaaggtaaggtgagcaccataagaatatgcaaaaaaaaaaaaaaaccattgaaattatctataaaggagttgaaaaaacagcttttaatcaacattcaataattgaaccttttaagggagcagtacacagagatgtgctcagtgtggcagtcaagttaaccgaaagaatgaattccagcttttcaacgtgaatttcaaagcatcaggaacactgaggcctaaaccttactgtcttatactaacaagagtcttactgttttataataactacattctttttacaggcattactaatgattgcaatttatttttagataaaaaaggttattattgagagtaggattagacactctgaaactcttaacagtttacaaagaagagatgaagagatcttgaggaaaagatgaacttttctatgtcatatccaaccttgatttgaatcggaattattattttgtgtttctttttcaaccttttatgaaatgaaggcattcttgtatttcttcaacatgccagttccccagaaaccaacttcaagatccatggtatcagcagaatttaagtacaagtaacagtaattatagtattgaaaagcccccatagcattcaatcataatattttatttaaggttgggagagcttaagttaattcattttcacaagcagttgaaagattgtggtggaattgactttctttagagaccatatgcatatttaccagttgaataaactctggttgtcagttatgtgtgtaggttggtgagaatatggatatgttatatgagggcagtattcttgtagcgggagaagaagatgtaaagtaatggaactgacagtgagtgcctactgggtttcagacacagcgctgggaaatgctttggtatgtagttgtcacaatgtctctgggacctagatgatattattttcattttatagctgaagaaaaaagccaaaataactaggaagtatttttcctactatatccttatctgagtcaagaaatggatattttttttgatgtatatgtttagtgggggcaacttttagttgttggttgactcgaacacagaattctaaggatttgggtctatcattatttttaatttttgtggtgttgtttttgagacagagtcttgctgtgtcccccaggctggaatgcaacagcatgatctcagctcactgcaacctccacctcccaagttcaagcgattctcctgcctcagcctcctgagtagctgggattacaggtgtgtgccaccataccgagctaatttttatatctttagttgagatggggtttcaccatgttggccagtctggccttgaactcctggcctcaagtgatcttcctgcctcagcctcccaaagtgctcaggcatgagccacagtgcccagcctggatctatcattacatacaaagatttctgctagggtttttttctttatttgagggcaaataattcatatacttattcaaattactgctttaaatatttcccaatggccctaaagagacattggttgcagtgacaggttttggcacaatgggtggttatttcctaataaatagcccaatacctatttaatttgtaaagtaattccttcctccaacagaaaattactttaaaatggaagctggtaggctatcttagttctaattttgcattgcaagttggtactgcaagaggtcacaacccccttttattcagagctattttatctaaaatggtaaaggaacatttatcagtttaaaagccagaactccaaatgtgatttttgcagctgataactcagtttcatgcctaagtattttaattataaacaaatatgtaaccccccgatttaaaacaggtggcattcaaaagttcatttggaacagagtcgtatgaaatttgaaacatttttccatagaaacaatgttaggtttccaggccaacccacaaaagcctatttaaaccatatcgtacaatttctgctctaaaatcatcacggggcccacacaacatatataataatatttctattgggaaaatgcatttggagtttagcttggaatagactagaatttcactggagtagaactgggcattttaaagtcctcctgccattttggcaatgaggatcagcattttttccctaagatgtatctttggttcccatgacctggggtgaagcagtatgaaggctagggcaggcaacagggtgtcttccaagggtgaattcatgattcaacatgcttttggctacaagcaagagactattgaacttgaatactagagttaattctctcacataataagtctaaaacaggcagtttaagcagtggttaatttaacatctcatttaagtcagggttctataaacctttataaccttatagttggaagatgtccaccaaatatgtaagaatcttgtctgtacataacaacctcctaaaggagaaagaatgaggggtgctatcttaatcttactaaataggaaactatttcccagaagccccacctccagcaggtttccctttgcataccattggccagaaccctgactcacagcctgccccaaactaaacactggccaccaagaatcagattgttagaagtggcttagagtctaagttctagttgaagtatagttcaccttcgggggataagcaggtggccaccttctgtcatcactttgccgagctcatttggagatctgtagacaaataagaaggtggaatatctgttgggtgaatgttatctatgtcttttacggtctgcttccatacagcaatagcctagggcaagggcaaggtcagaaaaattttagctttccaagtggctgtgtgatcttgaaaaagtcatgtgcttttcttctgcagactccagtttctataaaacaaggaggtgggatagatttgtttattcctcagtttattcattcaacaaatgttaatgaagcacttactttattacaagcagtattttatgcatggaggttacaatagtgaaccttccaaagttcttcccagatatcttatgtttttacatgattccatgtgagaagctgtggtcctggtaaagctatgggcgttggtgtagggatggtgtgcacccgtgaggccttctaataccgtcaactctagggggagtttttggacgtcatgggttcatttcactttatttatttatgtatttgtttatttatttaagaatccaagagattgatctggttccttccatttgccttgcccccagctgctgttactgacagggtttctgctttccatattgcccattctagagcaacacacaacctcactgcatttttcttacacttctgcctctgatcccaaaaggaacagatgactgatattttctcagtttttctttctttctttttctttttttttttttaacattgttagcaacagaggaaatagatgacagtggttgttgggggaagcttctctgcccttcacactttttcatcctagcactgtagagaaagataaaagaacattaaagcagaaagagtgtgttcttgagtctgtaatactgaggtattatcttcttatatttttgataaatagccagatttgatgatgaggagggagaaaggtgtgttggaggaagttgactcgtggctgagaacagctgcagcagtcctggggaatgagggtacccccccatcttttaccctttgtctcagccatatcaattcctgccacccgggacactgcctaggacaggctgcagtgcaagtgaagatcaaggactggagaggggaaggggctgtgaaggcaacatcaaaggttttggggctgtgaggggagatggcacagagatcctctgttgagacgctgagtttctaggactttcctgaatctcttttttccaagggaatgtatatatacactaacacatatatatatgcgtgtgtgtgtgtgtgtgtgtgtgttaaatggagcaacaagatgaggactggctcatgatatatatgatttgtttcttaagtgatgataaaataaattctgaagtactgtggtgattttaatgacaacactttggaaaccttttgggacatgtagacagggattacagtctgtgttatctacttatctatctcaggggtcggcataccattcatatttactatcagcaagatagtaaatattttaggctttgtgggccatatggtctgtgttacaactactctgcccttgtagcagaaaagcagccatgcacaatagctaagcaagttggccgtgttccattaacactttagctatggacaacttccttgtgtttccttcagtttcatataattttcatgtgtcataaaatatttttctgttgagtttttaaaaaactatttaaaaatgtgaaaacactcttactttgtaagtggtgccgaaacaggcctacaggctgtagtttgtcaaccctgagtctatctggctatcatttgtttatttgttggtctatctacctgtatgttttccttcttccttctttcatctaggagaagaaatctggttccattaaattttgtatgagaaattctttcctatttatatagtcaactactctaaacacttacaaaggggatagagaataactgatttattggatttctggtattgattcgcttgtgtcctgtggttgaacttgtacaagctttatgtattattattattttaaaatactacatttagcattcttatagccaatttagaataattactttgtaaaagatccttgaggaagtacattacatctaataaaaaattatcttggatcttgttaagacttgaaaaccccaggtgaatgatagcgttgggtcagtttttacattctgaatagagcacgtgttttttctgagtcagacaggcaagacttggatagctgtatattactgtttatgagccttatcctttcctgcaaatcaagtgtttattccactcctgaacttaattagcagctaagagctttgtgctttgtattttaaggaagcatgtgatttgttcattagttcaaaagcagattaattattatatctttagtcaccatctgtaaacacatctatattggtgagctctctcctgctgagttaccttgaaatgccctgtggtgttttattagcttcaattctgtgtttattacagttggctggagatttttcaatttagtttattggccacagaaagtccaatcattctgtggaaactaccaatttctgagagtgaggggtttactagtgctggctgtcaatttgctctaaacattttccccaaatcaaactgtatttctgtttggattaaagatagtagtagtttgattataagctaagattttaagcaccctatatattgtccgcattcaaggaagagcaattgggattaaaattagtaatctgcatgaaaaagtatctttctaatccaagttagctccagacaaaactgtgaagtacgtgaacgaaagaggataaatgaatagttattgatgcctgggcattttaatattatctaattttggttttgcagcaatgctgttaggttccaagtgattctcagagaatttaaagaacttgcataagatcattgatagagctgggatatgaatcaatattagtgtgacttgtgagtttgtgcttctcttcaccagtgtctagattgtcagaaaaaaatataggacacctagtaatatttgaattttatattatcaacaaatacttttttagcataagtatgtcccaaatattgttgtcctaaatattgtgtgggccatacatatattaccaaattatttgttgcttatctgaaatttatatttaagtgggtgtcatgttttattattacttgtgaaatttggaaaccttagtagtgtcccttccttctctctccttctctaggcattaagtctgtccaggaacccctttatctgcttccctgctccctctgtacttctggctttggcttattaaccccattctttgcttctttagtttgcagtttacctgctcaggtaaacttaaacattaactggggaccttattctctctggttttcaaagtgtctagtgactattttaaaaaaggaataggattagcctgtttgtcagagctaatgtcttcagtgattatatttttcaagttatgtatttacttaacacagccatgctttaatgcagggtaactctagaggccaaaatttttagaccctgtgcaaagaaaaagaagagcttaagaccattcttttagttattctgatagggtatttttcccacagaacctgttggtgactttatgtttttaattttatctaaaatttgattattattattattcagatttcttttgcttttgattcttgtatactaaacaaattttgaagacaattttcgtgcatttaaaaaaaactttataaaatacttttcaaagaattagtagatgattgaggtctctaacaattcttaaactatattttcacttagtaaaaggtaacacttttacaatacaatttttatttcttgagtaacaagaatacagagggaaaagttacggttctcagtatccaaccatttagctatataccaacatagtagcagaccagacgcttctcagtgaagctaatccaagccagcaccttatgttctctgcccaaactctaggaaacttgtacctttaccaaaaaatctcagagactggcttggaaaccactgggtaaatcagtaggattgttttattatctagttaccttaaggactttaactggggcctcaaagtcttttcagaccactaagcaggaagcgtgtgctgttagccataatgtggctgcaataagaatgatagttttgggtcagctaacagtatgttatggatgaatgtggctcctttcatctctctgaatcttggctttgttgtctgtaaaatcaagcaggggtgggattgaatgatagccgaggtctttattagtttgttactggcttcaacagagttgggaagcctcaagccacatgaacctttctcagaactgcttctcaggacaccttagggtagctgagtgattacaaaaagcatctgaactatgtgcagatgccttggaatagaagcaggggatctggaaaggctgttccccaaggtctctgcagtcagccatgcacttagatttgactacagacaaaacagatgtattcaaaaaattgaatggcatgttttacctaaatggtaggggttagggaagatagcttcttaatgggtctttgtgccatgtctctttattccttatgattagtacagctgaatcctgattctctttccttttccttgtcttccttccctctcttcctgtctctctttttttctccctccctctctcattgctcatttttttccttttcttcctttcttgccactctaacaggctgagaacaggacttttaggagctagctttccagaagtgatatagttacattgccttatctggatttccagagcgcatttctcctcatgtgctttttcgcaagagagagaacataacataagcccctaatcctttcaaatatgttaaagagaacaatgctgtgattgaagcaaggagactgggatttgactctcgtgtcttcctcttacctactatttgtatggctattgaagaagtcactgaatagatttcattatatctaaaatgtgagtataatcctcattgaactcttaggatttcattaacactgaaattctattgaaaaacagtttttaaactgatataccatggaaattattttttcatgtgcctaggtaggtttgttttctttcttctctctgtaattccagagttgttataatgtgtctttctctcatgctagactctaaattcattgagagaggaccttgttttattcaccttttaagttttaattaataagcctatagaacctataaaatgagtcagcatttagtagggtcttatgtgtactaatgtgtctgaaggcatgtacacataaatttaactaatttttattttacttatgattctgtccagtttttaatacaatattaaaacctgaggaaagcagaatatttaactttgttattatagttgattaaatactttactgtctttttgcatattcaattatctgtagcttgtgcagtcttgtaagacactggttgtggtactcactcattcattcttaatccattcatctatccaaccaatagttattttccccattaactgtcctctgaattgtgctaggcacaaaacagatgtaaactctgacatcatgaagcttatagtcaatggaggagaaggcaataaaataagtaaacacaaatgaatatgtaatggcaaagtgatataagtgttagggagagcatccggtttcaagtgaatgagaataacagtgtcacccactctagaatggatatatttaaattctttgaggaagtggcactgaagctaagagagatctactcttgacgatgattagttcttggctagacaaaaccaaaccaaaccaaaacaacacaacggatgaagagtggatcagacatgttacatggtacatacagatggagtatcccttatccaaaattcttggaaccaaaatcctttgaatattttcagaatatataccagttgagcagccctaatttgaaatccagaatccacaacccagaatgctccaacgagcatctcctttgagcatcatgtcggtgctcaaaacgtttcagattttggagcattttggatttcagattttcagatcaatgctcaacctatataatgctcaacctgtataaaggccctgaggtaggaaagagccatgaggactcaaagaattgaaaggtaagcatgaggaatagtggcatgagggacggtgatgctgttcatagtgcccaattccccaaatgttttattcccttactaaattactccgttgtagttgctttttttggtgtttcatttttcaacatcctcatatgcctcctttcttggtaacagctttattgagatataatttacatatcatacagttcaaccatttaaagcatacaatttagtggtcgttagtatattcacagagttgtgcacccatcactacaatcaattttagaacaacttcatcgctattctctttagctgtcacccctaaatccctccattcccgatgccctaggaaaccactaatgtactttttccccatttatctattttggatatttcatatacatggaattatataatttgtgatcttttgtgtcatgcctcttttaacaattttctattgcatgttcatctgcttttcatctttgctcccaagttaccgcagttatggacttttttttgccttcagtgtgctaccttgttccagtgaagttatttctctttttgtttccctacaccattagcaatgtccaaacttcgaagagtttccatattgctaaatgaagtcataaaatttatattaatgaaaagttgtctttctagtttcttataatcgagtgtttagaaatctttacaaatcaccagttggttatttttctgttgctcaaatttgtgctctttcacctaaaagaattaggaatccaaatgagattttgtactataatagacaaattgcacaaagcttccatccacctctaaataaaaggagaacttcgtcagcatacattttgacattttagatggtatgtgtaaagaacacatacgtacccaaatctcttccagtgatttctcaaaaggtgagctctctgctttaaaaatagaacattgatgattcagtgcccaatatttgttagtatgaacttaaaaaatattgattgattgataactaatagcaaaatttggttgttgggtagatatctgcagtctgctgaaaatcaaaatgttatggttaaagaacgagtttagtagcactaatcagaattccttggtttcttgggaaattagggggttgctgctttactaccaaagaaaaggaattaagaagtattaataatcttcatttgtttttggctagacaacttgtgggatgcagtagggggtagagtgtatacatactattaaactatcttctgaaataaattgtagagggcattttttgaaggcagaaaaggaagagtcagtgtgtttcctaagccaaagctttggtcattgtcactactccctttctgttaagcaaaggacagaaactctgatgttacgaacaagagaggagggtgaaggtgaggcggtgagagcctcagtgctagcaaagggttttagacgcacactccctcatggagagcagatctagtcaggcagtcatgttcacacatctttggtctttgcactctgagcaatacaaaatttaagaattatggttggaattatagataattgggagtcaaaatttaagacaccttcttccccaatatgttttaggcaaagaagaggctggcgtcaagtatttaagagctattttagctaatggcaacagatagattatggagaatcactgcttgttctgtgggccaggtggtaattacagacttagagatataagagttgaatgtgttccattctctaacaccttcacacgcctctttttgaaattctctattgcgtgttcatttacttccctccctttgctcccaagtcacagcaattaagggctttttcttcccttcattgtgccagtgtgtcccagtgatgttatttctcttttcttcagacaatgagtagcttccaaaatccatgatgatctccaaattactaactacagaagtcaaatggaactacattcaaggtgtttagaaactctcataagattgtaataatatgaagaataataggtaaaatattttgtcatatctgaatatattcaaaagttgtgattgaagtctttttttctttttgtttttgtttgtttgtttttaagagacagggcctttgtctcactctggtgcccaggttaaagtgcagcgggtgatcacagcttattgcagcctccaacttctgggctcaaatgatcttcctgcctcagcctcctgagtagctgaaaccgcaggcacatactaccacacctggctttgattgaagtttttagcctcctttttgtgggatccaaaaacattcctttctgcattatgtggaagaaattaataattttcaaaaaagacagcatgttccttcaactaagtttattcagaaaatggcctgtattcattaaaagaccttggctgagttctttggacctgtgaggccttagttttattgtcagtaaaataaagagttgggcctagattggtttttagtaaggtgattggtgcaagaccttttcaaatgatattgtttctttatatcagaatcccaatgtgccctgctcccccttccctaaataaagtgacttattttttatttgattttacttttgtatagcaccctaaggttaacagtctttcaaaataactctcagaattaaatcaactggctgtgaactttgggccctgtcctaactgagtcctctggtctttaatgtagctgaaactgctcaccatggaaacagctgatagcagtggtctgtttgtcaaggaaagcaaatcttgattcagacttcttcccaccctcagctcaccatccttagcttctgtcacaaattgcattggaaaatacattggaaaaacacaaaaacacagaaatatgaactctggctcaaaatagaacaaattccacaaaaattgcccatggcatatcagtaaaatacaggattaatcacaaaaaataattatagtctttggacatatcagaatctcataatatatttagaactgttcattcctcttatcaccctcttaagaaaaaaaaatccactgagcatttagttaagcagtggtgatattctagatgacatgtgagaagacttgtcaaatatccatgacttgaaactaaaaacagcatgacttcttgtcattttagggagacttaggagctaagtctggtagctttggcatcagcttatttttagcagtgtgtgatgtctgtttttcctggttattatccctgggctcaattttgcaattataggatgcacatgttattcagcagatatgaacgttttcacttagcaaactgtgtacgtgaacacctttttaaatgacttaatgggctcgagttttgttggttgttttgcatttaaaatggcacttgagacagataaccaaaagcataaaatggaaaaagtgattattgtagaaaaatgggaaagcaacatgtttctgtaaatgctttcgtgtcgcttactcagagaaacaccatttgactattggaagttgctatgggaagcatgcaacatttccatggcgttacattttactttcttatttgcttgcttgcagttattctttaaaaatatctatatctatatatctgtgtgtgaatatacacgcgtgcacacacacacacacacacacacacatctctagcctttcatccatctattttttttttttttaatgtgtctgagcaccacttcttaggcaaggtcaacacagtaaaactcagctttgattataatgttcaccctcctggaattggtccattacaaccattgtgtgaataaccttgtagaagtttcctgtaaatgtgttggctccttggcaccatagtgttctcagcgttcatactgtgggactgctttaaagttcaactccccttagcaagagccttggtatttcagagactaaattatcttgtggctgagtaatgccaagtatatacctgctttattcctaattctgctggatagcatattattttttattaatgtcatggcatatattagttattattcaaggactgctagggaaagaaatgagccattggatgaccatataaattcctctataactctgatagatcaagaccaatggagctagtgcttaatttccaccattaactgtactgtcattatcaaaattcatggattgaatatacatagtttagaaattctcacgcatgactctgtttgaagcagtagtaacttcatatgaatttttaaaggcagaaattagttacaaggactgcataaaaggaaaaaagcagatcagttgtaagttatcaacatagtgaacaacattattactcattcttaagcactaggtgtgattctaaatcagctttctgtttctagttctcaccctcatctccatgcccgttcttaccctcacccaaataatatttgactgataccagaaatattcttctctctttatttgctacattagggatttcagagggaattcttttcatccaggaaaaagaaaatcaggccagttttgaggaactaaaaataaagctatgcaaaattgttttcaaagtggaattcattgccatttgtttttatgcatgacaatcctttagaatatagcattgaatcaaactatgattctgacttcaatgatttttatagtcagtttacgaatattcactatagattttcttatatatggtttgtatctaaacagatctaatttaaatcctggaagcatgatagtaatagtagtaatggtagtgatataatgagttcatcatatgtgacagactgtgataaattattttacatctattttctccttaagttctcactacctttttcaagtggatactgttcaccccatttaaaatgtaatgaagtaggaaatgtcttactattttgacaaaaatacaaaatcctcttaggaagataattgtgtttgtttgcaaaaatttctttcttttttttttttttttaaaaaggtagtatttaccatattcttttttttttcttttttttattatactttaagttttaggatacatgtgcacattgtgcaggttagttacatatgtatacatgtgccatgctggtgcgctgcacccactaactcgtcatctagcattaggtatatctcccaatgctatccctcccccctccccccaccccacaactgtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgccacaataaacatacgtgtgcatgtgtctttatagcagcatgacttatagtcctttgggtatatacccagtaatgggatggctgggtcaaatggtatttccagttctagatccctgaggaatcaccacactgacttcgacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgtataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttctgctgtgcagaagctcttgagtttaattagatcccatttgtcaattttgtcctttgttgccattgcttttggtgttttagacatgaagtccttgcccatgcctgtgtcctgaatggtaatgcctaggttttcttctagggtttttatggttttaggtctaacgtttaagtctttaatccatcttgaattgatttttgtataaggtggaaggaagggatccagtttcagctttctacatatggctagccaattttcccaacaccatttattaaatagggaatcctttccccattgcttgtttttctcaggtttgtcaaagatcagatagctgtagatatgcggtgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaaggcattggtagctggatggggatggcattgaatctgtaaattaccttgggcagtatggccattttcacgatattgattcttcctatccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacagtatgttgaataggagtggtgagagagggcatccctgtcttatgccagttttcaaagggaatgcttccagtttttgcccattcagtatgttattggctgtgggtttgtcatagatagctcttattattttgaaatacatcccatcattacctaatttattgagagattttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgagaatttttgcatcaatgttcatcaaggatattggtctaaaattctcttttttggttgtgtctctgcccggctttggaatcagaatgatgctggcctcataaaatgagttaggaaggattccctctttttctattgatcggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagagtgtatgtgttgaggaagttatgcattagtactagattttctagtttatttgcatagaggtgtttgtagtattctgtgatggtagtttgtatttctgtgggatcggtgatgatatcccctttatcattttttattgcatctatttgattcttctctctttttttctttattagtcttgctagtggtctatcaattttgttgatcctttcaaaaaaccagctcctggattcattctttgtaagggttctaaggagaccatgagccctgatctattaatacctgtgtgcctccctctccctctctccttgcaaggacatcttctgctggtgccaagacatcagaatgagatctagattgcaaatggtgtaagaagggtttagaactcctggttttaggagatggagggagtgtggaatagagatgagagggagagaaagaaatggagccaaatagcaagatggtgggaagctgtagtgagagagagagagaggtgtgtgtgtgtgtgtgtgtgtgtgtgtgtgtgtgtgcacatgctcatttagttatttgggttttggctcaagtggatacagtgctggagagagcccaagaagcagagtggggcaggctgcaacctttctaggaactcctttggacatgcaccagccaaaaaattaggggctcaagtctatttcattaagaatctaggttggcagggaaatgcccagggacatcgctcacatcacagtgtaagaaattgagaaaaaatgctctcctgaagtcattcaattaatcaggggcaaggatggaatgcaaagccaagtctctcaattcagagtactggattctctttattataccttcctggcactctagaataatgattctagcatgagacatggtaatctcaacaaataaatgctatgattatgtttatgcttactagcagttctagtaatcttccatttctaaacttggtagtcaggtaatcagatgtgttaaaattttcttttaaatgattcattctagacagtggaaagtatgcttaagaatattaaatatttaattttattgggtatcaccatcatataattataatctggacttttttttttttttttttttttgagacaggctcttgctctgttgcccaggctgcagtgcagtggcacaatcttggctcactgcagccttgacctcctgggctcaagctatcctcctgcctcagcctttcaagtagctggtactgcaggcatgtgtcaccacgactggctaatttttgttattttttgtagagatggggttttgtcatgttgcccaggctggtctggaactcctgagctcaagcagtcctcctgtcttggcctcccaaagtgttgggactacaggtgtgagccactgtgcctggccctggacttcttatgacactttattttatcctgtggcaccaagtaattatgatgctttacttataatctatacacactacgtttgctattccttttttccgtgtcagggaaaagtaaagtggcaagttttacaaactgttttgtaatatgttggactgtatgagacacctctagtaggctgaataatggcaccccataaaatatccaccttctaatccttggcatctgtgaatgttacctcatatggccaaaaaggattttgcaaatatggttaaggcagggagattactctgattattctgtattgtccaggtgggccctaaatgcagtcacatgtatcttataaagagggagacagaggggtatttaatacgtacagaagggaagaaggcaatgcgatcatgaaagcaaagactgggcagcctccggaagttagagtcttcaaggaatgaattatctcctagagcctctgggggagaacagccccgccaacaccttgattttggcccaggaaaactgatgtgggacttctgtcctccagaactgtgagagcatacattctgttgttctgtggcacaacggttgtggtcatttgttatggcagccacaagaaatgaatacaacactgtggagaagtgtaagcccataagcaacctcagtccatgatgaaagccatggctagatgtaggtgttttcccccaaagccagggtactcattactcaaataaaattcatatcttcccaaaatgaaatctgcaaacatcccgggacccttctacctgggaaaggaccttctgataggaaaacagtgacagcatattaatctactgcttggggaattcttggcaacagggatatggcctccatcccatgggagacagaactggcaaaagaagaaattgtggatattgttgtattttttaaagatggaaacatctgcataaaagttattgtacagggttttctctttgagcccacaaaaacaagaaaaaaaatactgtcttccaccgaactttaaaaaagtcactcttagactagatccagattttatcccatctcttattattttacttcaaataagcaaaattaggaaactgtcaatactttgtattatgtaggaaaaattgttatacattatgcttaggctattgattagtgaatattttctttttagctgtgcagttactatatccatctaattatgataacagatttttaaaataagttattggttggtatgcagtatttgaaagaatgaaattaaccttttcctttcattatcaaggattttaacttacatgcctatgtcactgaacatacacatatatagaatacatatatacactgaatatatatatatattctgttttttatttgaagttctttagtaataaaatatcaccttaaaaacaaagcaatttctttgacacagcatttaatttggaggtcactcatattttaaatggggagccaaactttaaagttttttttttttttttaaagagagtgtctacaatagaatttgacttcccatgccttcataaagctaaaattctcaatgagcagcatttttatttaggataaactggcctctatgaaaacaagcatcttcagcttttgagaagttgtgtgccctgattagcaagcaagccacactagactttaaaattgaactgagggccctgctgaagcacagcttctattgttctgtaatgagtgttttgcagagtcctttcaaaagtaaactgtattgttcccttgctagtttcagtacatctgaatgaggtgattatgttccttaaaaagcactttcaggactgcagaaaaattatctactttaaaaaacattttttccctttatctggtgataaattttaaaaccttgaacatttcatgagcatcctggcaagaggtttaaaattatctggaaatcctgcctttgatccaaggtgcagagagtctaaaaacccatcagagcctataggcaggtctctgctgcctgagctgctgcttgagcaggaaattttgcatagtaaatactttaaaactttggtattcagagagcaatattaaatctaggtgaggactaacatctctgaatagagcaaaatttcatgatgccagggtacttgtatagctattgacagcctagtttttcaaataaaattttaaactgctggggcacttggagtccatttgtatttttctgatgcaatgtccgtggggctttcagaatagcggggacacgggtgggattggagctcttttttttaacctcttttcatttccacatgtctgttattcttagtgacttgtatcatttccgtattaccaagttgaaacagccacaatcttggccctgctgtcaataaatttgttgaattatttattcatttcatttatttatttatttcaataaataatgtcttagagcaggaccaagactgtggctttatagatttgaaatattttagggaaagcagagtttacaataaaggaggcaaatattggattggatctagaataccctatcagttcattgaatcataatttccccacataaaaccttgggttcttaatttatcgaattgaccctagtcctttattgtgtcaggacttttttcctaaatcctaattgagtgacaagttctatttgaagaattccagcacttcaccactctgtgtgtagatgagttatttttctgtctcctagagagtatagagcaaggctacaaagagcctgtaccccaagggtctcctgcattttccgatgcccctaagcatattttaggtgatatagaaaggattagacatgtcttaatttggcccaaataagtaacttaatttggcccaatgaaacaacccttgaaatacgttgtgtttccaaaacaatcagtaagaggagagtgatcccccagggagcccctcacttctcctgctcatccttctgtccccccagtggcaattttcattcttatccctgaggttcttctccctattaaaaaaatacacgtttgaagatgaaatatactggattcttgtgcagtgccatgacgtcttatggagacatctgttctgttgttactgggatgaagtgaacgtcaccacatggaactttgttgtgcctccctcaccatgcaagggaattagagttttgttaattccctagttgtttctctgctttaatcagagggacaactggtcagagagttttgtccttcctgggaccagctcattttaggccattctaatgactttgcagcttgcccttgggcccaggcctttgatttcaggtggcccatagggctgcagacttttacttcccttgaaatgaacagctccatcatccatcctcctagaggacgtggcgggtcaagactattcagcttcacgttcacaacttctgcctcctcctctccctgctcccaagtgtgtggcgtaaaccgatagcagccaccattatatgatgctgagggagcctccttccttataaccttccgttgtaacagctgcatccacagaaaccctggacttagttgtgagatatattcagtccctccagggcaggggatgtccttcagttccatccttggatccctagttttgaatcacttttgatttatagtaacctgggtgagatgcttccaaaactccatcccctgctgcttcatcacctaaatgtgacactagggcaaagatctccccctgcttttgtaaactggtctatcctgtgcacctacgcctattgtcaaattaataaatctctataatggcatatttgtattttgtaggaattgctgatagtaattcttttcagaacctggaagaacattcttcaaagaaatcaggaaattaagttatattacttgttaattcttaccacacaactgactacattaagacatttttaaaaaagctctatgcgtatgatgcttttggtcagtctgattatgaaaatggtatgttttagaagaagttctatttattgacagggtggaggcagaagctgtttttatattaccatgtcatgtttttaagtatgtaaataagatgaattgctgctatgatcaagtaaaaattaaaagcaatgtaataaattcatagagagtgagtgtttcttgggaggccgaggcaggcagatcacaaggtcagaagtttgagaacagcctgactaacatggtgaaacctcgtatctactaaaaatacaaaaattagctaggcgtggtggcgggcacctgtaatcccagctactcaggaggttgaggcaggagaattgcttgaactcaggaggcaggaggcggaggttgcagtgagccacgatcgcaccattacactctagcctgggtgacagagcgagactccatctcaaaaaaaaaaaaaagagtgtctctttttattttacctattaatttggtgcacagtatggctgtgcatgatgtattcttagtgtaggcattatacaaaaatcctgtgccatgtggcagataatctcattagaagaagaaaaaaagcctaaatcgacatggatcacctggtagtgtcacagtcttctctattgctggatctatttatgcaaaaaacataaaatcttcataccctcacgtctatctacatgtcacacctggttttgattttaatgactttcagactcttcagtgggaaggaaataaataataaaagcagtgttattgaaaaattctggaaataaaaacattttctgattatgaataatacatgtttattttagaaaatttggaaataaaaaaaaggataaacaagataaagtcaccttaaataccagctctaagagggatccattaacactttgaggtattttcttcccacagttcatggaaagtgaaggcttctgaactgcttgttgttcctcattctttgttcctgattactgtaactggaaccttcttctggtccaccaaatcagaaaccttcggggttatcttggacttcccctttcactcaccctgtcatcttttggccctgtgggtcctacctctgtggatttccctgcccattccctctggttcaaccccactcctattattctaattcagtctccctttctctcttatttggaattctgctgcagctttctgcccagtcttcctgtacctagtcataccctcctctgctatatgcaccattctgagaccaccatatttttttttccctaaaagttaaccctatgatgttgtactcttgtttaagcctctgaaagcctctctgctctccttttcgtgatctgccctgataagtttcttctttccatctcttccttagcctcactctctgccttttctctttccatctcctctccagccatcatctcagtcactgtgctagcagtttctggatcatcctctttttttgcttgcacagtcacacattctgttccctgtaccttttcttctaaccaccttgaagtttcaaactccctgaggtctgaggaatgaagtagaaagaccttgtgatactgtatgtttattgtaaaaatgtattttgaatgacatctttctgttcctcctgtagaagtcagcttgtcatcaccgactctgggaacactccctagccacaaagacttaagtttcacttgctttgtgtttccacaatttatggacaacacttagactttaggtcagtaagtgatcctgaagatttattcaggtgacatccctgagaagcaatattttaggctgattttatttggacagtcaacaattgatatggactatatgtcatatgtcaagcactgatctctgattcctgtgaattagacagacataatctttgctttcatggagcttgtagtctggtatagtctgatgtaggcaagcactcaataagaagcaatgaataagcaagataatctcatggagataatttgaagtgataaatacagggtgatgtaatggcattgggtgcagttatatggtttcaagttgactgagctggtaagggctgtgctgtagtacctaccagtatattatccagacatatgtcaatcatattactaagttaacagcatttggtagtggaagctgtgcatatttgttgggctaatggttttagggttaaaaccttatttgaatgaatagaggatatttaagattggaaagaaacatgatagcattcaaataattgaatgactatatattagtactataacaaagagattctggaacactccagaagactgactggagcaaaccaaaaaatagaagttacagaggggtatattttaacttaatataaggaacatcttttaaatgtttatgattttctcatcaatagaatggatgtgctgaatctttgataggggttgtattcagataccggtgatctgtcagaggtgagtgaggaagttcctctaaaggagagcaaagtagcctagatagtttcagagatctctattgtgttactttgaggaagctcaacctaggagaaatagaggtatcccgagaggagcaaatttagggcagaacagaaagaccccacaaaagaggtcaatggaacaagagatgatatttctctggaaaaagggcacatagcaaatatataagactgttgattcaccagcaaaagagtcttcatgctgattggttgggaaaaaaaggaaacagaagaaaaagagatcaagaaaaggaaatgtcttattgaagaagagggaccctatcaagtaattccagaatgctgaatgctgtcatgctctgaataaatacggcatcaattaaagggataagagctttgattataacttaatgtctggctgagctatttcttacatcactgtttcttaggtaatagtttttagtctattatctaatagtccattagtacgttgaatagtattctataaatgaatctagaataatatgtttaccttccattttaggtatgatatggcaactcttcattttcaatactcacagtggttgattgagacataaatttatttgggctcaggcttggcttggtcaggaaaacaacaaaggaaaaagtttttcttcagagctgctatgtttatgcttttatgttgtggttggcattttggcagcataggtattaagttatgtaccacccaaaactacttaaaattagttttctcaggcttaaaagaaagagaccttggttttttaagacattgaataagctttagttcagcaacaacgggctgcagaaacaatgcttttaacttttatttgtgtcatatatttaagttacacattattttcgattcttcttgtatttattttttccttctagcgaaaacaatttggttccagtattttaagttattaatgcttcctagagaacaagtttaagttttccagtttaggaggaaaagcattcaaatcagaaaaccccctcatttttaacatttttcccaagaagcagaacagtcattttttaatcctctcataatgccctgggggcgttagacagacattgtcccttaaaaaagagaaaaataggaattgcatcatgtttgatagaagtataagtaacaagggaaaaatatgaaaccacaaaaagtggatttatttttttcctcaatatttgcatattttagcaaataggtttattgagcctcattggtggagggttgacaaggatatgtaatgttattttgtctatttaacaacttacagcttatttaaactctttttcctaaatgaatcatctccctttttttttgtctgaaaggtgacagtatatttattatggtccattttgtaaatacccgcttgcaaatagacctcttcatacctgggtgtgcctctttggagacatgcagaagaaaccctcccaatgtgaattacttcttgactttgcagacttaagatgaaattgcttaaaataaaaggaaaaataaaaatacactgcttgttttagtgtacatttggaaggttacaaaaattggattaaatattgatgtttgcttttaggtatttttgtcttttaattggcaagttaatagggatactttcttgggtgagatcattttctgtgaacttgggaagaatcagtttgcttgttcgctggtggacacatggaaaatacatcattggagcatatgttgtttatttttttattatgaaatattttagcaattcagaaaaatatgaataataaatttaataaatactcatctactcattatatgtttatgttttgtcttacctcaggactcattttttttttaagcaataaggcatttaaaatatagttgaagtgctctttgtaaaatttcactcactgtccagagttagccattatcctgagttgaatgtggtgtttaccattcccatttatctattcttttaaatataaaatatttattcataaatattacgatattatttcatatgttcttgaactttatatatgtggtatattatataaatcatttttgattttattatgtcattaatttactgtaagtattgaggtgtatccattttgacatatatagctctaggtccgttgtattaattgctgtgtattattctaatatataaactgctacagttttcacatattcattctcctgttgatggacatctagactgtttccagaatttctgttctacattgtcttgctgttaatatttttgtgatttttctcaagaagatgttggggaatttctctaggagtggaattgttgggtcacttactagtttcctattgctactgaaacaaattatcctaagtgtgctggcttgaaacaacagaaatgtattatcttcgagttctatagatgagaaatctgacatggttcacactgggctacactcacggtatccgcagggctgtgtttcttctggaacctgtagggaagaatccatttgctttccttttttggcttctagagagtgctcacattccttggatcatggtctctctcctgcatcttcagcaggactgaagaaccagcactgctgcatcgactattattccataggcacatctccacttctgcctgactgtattctgcctctcccttctactttatttatttatttatttttgagatggagtcttgcttttgtcactcaggctggagtgcaatggtgtgatcttggctaactgcaacctccgcctcccgggctcatgcgattcccccacctcagcctcctgagtagctgggattacaggcgctcgccaccacgcccagctaattttttttgtatttttagtagagatgggatttcaccatgttggccaggctggtctcgaactcctgacctcaggtgatcctccctcattggcctcccaaagtgctgggattacaggtgtgagccaccacatctggcctctcccttccactttttagaatccttgtgaatgcgttgggccattctgaataatccaggataatcttatgattttaggtcattttattagcaacctaaattctacctgcaaccttaattccccttggcatatgaggtaatataatcaaaggttctggggatatggtcatgaatatctttgcagggggagggtattgtacctacacagatcatagggtgtcatacattgtccacttgacaggatagttttaaattgctattttaaatggtgtgtgcatttatactgtctctgaaagtgtatgaaaattttaactgttccatatccttgccaacgtgaggattataagactttaagatgttacccaattggatggatgtgttttggtatctcattgagcatctttccatataattattagctgctgaaattgtcttttttatttattgcctgcttctgtccttttcttatttctaaattgttctttgttttgttttcttactcgtttatacataagaaaaaagaaaagaaaaaataattagtagttaattataatatttaacaacatattaattcttataataattaataattttttctttttttttttttgtttagagtcagggtctcaccgtgtcactcaggttggagtgcagtggtgtgatcataactcactgtagccttggcctcctgggcttaaatgttcctcccacctctgcctcctgagtaactgggactacaggcacgtaccaccatgcatggctaaggttttttatttatttattatttattatttattattatttttttttgagacagagtctcagtctgtcgcccaggctggagtgcagtggcttgatctcggctcactgcaggcttcgcctcccgggttcacgccattctcccgcctcagcctcccaagtagctgggactataggtgcccaccaccacgcccaactaatttagtttttgtatttttagtagagacagggtttcactgtgttagccaggatggtctcgatctcctgaccttgtgatctgcccgccttggcctcccaaagtgctgggattacaggcataagccactgcgcccagcccagtttttcatttttttaaatttgtggaaatggcgtcttgctatttttgcccaggctgatcttgaactcctggtctcaagtgatactcccgcctcagcctccccaaattctgggattacaggtgtaatctaaagtgctcagccataatcccattactaattcttgttggttatttgcattcccatatttttcctagtgtgatttgtctttgcactttattagggtttttttttttttttaagtgcacaaatattttaattcaaagtcggcacgttctgccatttcctacttgaagtaagatatccctcttcatttttaaataaagagcaccattatacattgaaataattttatttgtatctagatatatatgtttctattttttttttgagatgtagcaacaaaacagtctgatttattaggttggtccagttttatataggccgcaattgagaactgtgtaatttaaagagtgatgggtttataaaatgttattgctagcaaaaactttagagatgatctggtctgaaactgatgtccagagagacagggaatggcgattctagaagcgcttgtattgacaaagtgaattgcatacacactgcaatattatcttcgttggctaagggactctgccttaccttgaaaagcatgattataaaaataataactggacatcaattttgctgagaatcttctcttatctctggagtgcatattttctattgtaaggcttttgtcacaaacatacctctactgtgagccaggtcccaaaagggacccttactttagcaaagtcccacaacttttctgtctgggtattcatccacatcactctctgttccaacactgctactcctccaactcactaaacaggttttattttcccaatatcactcgattctcagactcttgaagatcagagataaaattaagtgcatcttttatgcccaaaataagtgtgtcaagattttttcactatttttttcttaaggaagtattgcagaggaacttaagagtgagtgacagttgacaaaaagaaatggttgcctggaaactggcaatttaaataactaggagctgatatgatttaccagcctgataaacagctaggactttaatacaatctaaagggctgctacagatgttggattgagctatttatatgtgttaatctgtctcagtctattttaatacatgcatatatatatgcattttttttttgcagaactggaatataaaagcaaaggctgtatctcttcccctatatgacattaatagaaataatagaaattgccttcaattaaatgaattgttttggtccccttgtttttatatagattttcagtttcaaaggtggctttctcactcagggggaatagatgtcttgtggattgagtgcggagtttgttttgagttctgacactgtaattatatacttagtaattgttaccttgttttttcaggttttatcatttgaaactttactccatttgttgagatggagttgcagatacttttgattcttcacaggaataatgaggtttaataggattggttctgagtgagttagcttaatcaagtagcctgttttactgatgggatcattaagaggctttatcctctcatgggccagttagtttcctggagcaggtgaatgtctttgcagcctccttgatcctcactagacatctttcacatggttcttcgaagagatgatagaaaagctgcagcctatattgtactgtaatcatagtatagtaacccagagttccctcttctggcaggaggtcagtactatcattttgtgtataaataactgatggcatatttgtgaagctgtctgtataaaattccactatctccttgggaatggaatgtgctacatacaacaaactatcatcatgttactagcataaaacttgagataattttgaggataattttgacagtggaaatgttttatgatatgaggaatataaaaatagatcatttaattcacagaatagttgaaggacacagcaaggtaatttttaaattgtttcttgcaattgtttacaattcactgagcgtagtagctatgacttggagaacttctgggaaaggaggacatttttaccacccatgcatgtttgaataaatttcagtctcctaaagctgtgcaccagctctttcatgtatcttcccttctacctctaatcacagtgagaactccctactcctaattcctgtagcacttgtgctgtcccatttttttttttttaaagaaaatagctatcagggctgcagtgtttcacaatttgaggggcagtttgtaacacagaggccctgaatgtcataatgtctcacatatattgagcagtatgctaagtattttaaatatattatcactcatccctagtgaccctgcaagtaactattagagccagcaacttaccagtgaggaaactgaaggtcagaatggtaaataatttgcctgtgaaaatacggcaattggaatttgcattaaggtcagccagactccaaagtcagggttcttttccttgttctgctctctatatatgtttgttattttgtttcttaattgttcatatgcatatgttgtttctcttgtgcttctcatactttagcttagttaagaatcaccatggaaacttgtttaaaatgctgtttctgggcccttgtcctaaagattctgattcagaaggtctcagataagtcctgagtgtctgcatctgcattttctgaggggttcttggactgtactctgagaaatcactggtatgaaatctgggagacaggagctatctgaacaactcccccagctctgaacattcatagcaagcactcaataagtacatgttacattcaagcagagctaacttgctcctgtgcaaaatatagcccacaaggttccatagcatgaacttggattgttcttaacttgaatataaagtttgtgtaagttagaaaagtcaatactaattatagggtgaagttcaaagaacaatatctgatatgattcattttttacaaattggtgtattctggaaatttaggtgtatcctaaattaggtgtattggtgtgttttcacaaggaagtttctgtagacaaaggaacagcattggctagaaaagaaccagagagggacggaattgaagttagttgtaggtataaagtagggttctttggaaggggaggaggagatggagataaagatgggagatgaggttggttcaactcattagtgaaggtaagttctttggaaaggggccaaataaccagtggcctaatcaattgcaagggattctggagaaacctagtagaaaagagggtcacagatgtgttagcggtgaaaagaattggaccaaacgcacagacaaagcaaggaaagaataaagtgacaacagcagagatttgctgaaaatgaaagtacactccacggggtgggagtggcctgagcataggggctcaagagccctgttatggaattttctggggtcaaataccctctagaggtttcccattggttacttgatatacaccctatgtaaatgaagtagcagcccacgaccagtctgattggttgcagaaagtgaccaatcagaggctgaagtgaagttataaagttctgtacaaatgaagacttggccctctaccagcctgattggttgtgggaggggtccaattagaggtactttcaattcctcatctgccctgcagaaaaaggtggggagggttgcaaagggagtagcctttggtcctttcgttacttgagcatggaaacttggggttttccttttgatttagttctaggaagtcagtgcaaatcggctttagggtccctgcctctagaacctattctcctgcctcagatggagggataaggagtaaacagaatcagtgccaatgtgggtcttggctggggagggtgccatgtacctcacatctttgggcaatggccctggtgacttaagactcatactggtttccttctacattgtgtgggtattttctgttatcacttcttcacctgaggggcacatctgcttgtgcctagagatgtgtcttggctggcttaaaattgtatggactgctagcaacaggtagaacagtgagtaaaacgatcagtgatatccttcccaaaatagagggaccttaaggtctattgaaattcccaagccaatctgttaaaacatattcaagttctgtatagaaagatctatacaatatccggggaatagacttcatgcttcccttcacatttctataaaatgatacttgtttctaacttacagtttttttttctattcgaatgtttttctttctattaacatccaagtgatttttttatatagctaacacgagtgaaagattaaagtaaacatggtatattcacaagcaaaggatagcacagtatatttccttagagtacacatttgccttctaaaagaaagaaaaagaatgaaaaaaagctttagtaattagatacctgctgtaaccctagtggagtgagaaagatgaatagttgtgctgcaggactctgtgccacagtgagaggcactatgtgtcactgttttctcttgggatgaaatttggcctgaagtaaaataaaatttctgtaatgataataacagccaatgtttttgagcaccttcaccttaccaatgattactttacatttatttccttcaagcctcacaatgacctcataagttaaataattcatgtttaagcaactgaggctcagagaggttaattgacttccagaccgcctagctagtgaaacattttacaagagcactttgctcaacgtggggattatcagatcttcaagagttgagttgcagcattaaagaaatgtgattaaagaaatcacagaattttaaaaaatgtacacaatattgaagcttgaaaaagagaatcatatcactcttaattacaatgatggctaaaggtcttttgtgtttggctagctgatcataacccatgcctccacgcaggtgaggtagtagaccaggggagacgggttcttttcaacatgcttggtcggcagttttctgcagggaaggttatagcgtgtgagttacaaagccctcctgctgcacaggtatcagaggttgtctgttacaagttccttcacttcgactattacttccttttcacaattctattttggacttctgtccagtgtgtatttacaggtagacaaagctttttttctttctttctttctttctttttttttttttaacaacctctttgccatgactgaaaagaagcctgtatatcctgcagtttctgggcattgtgagtctccttttaaactcaaattggtgataatggtgactgtgactccctattgtccaaggaggggagttgcagatagggccttcaaagatgatccaataaaaatcagtgcagtaagactttttgataaaatgatctttatgatgtagaggcatttggaatatgggttgggtactggataccctggggctaagcccagtgtttaaaaatcaaggcttactacgaaaaggtctgtttttattagtgcaggtactgtagttggcaagatttcttcttatgaaatgcaatatccagcagaccattcctgattatgttatgtatttttagatgttaccattgagttatatttatagtatagactactgaatcttatcttaaatatgcaaaatatatgcataactaacctcccaagctgcgttccctgctctatattacacccaacaatgtagcctgttcttaaatggttctcctaaaagtcttagaatggagcttattatttgcttttaaaatgtaagcacagagactgtgtgttagatgtgtggccttctgggtgacatgttctgctcctagatactctaagggtgaagtcagcaaacctttggcagtgcaggtggggagtgaaaccaatagtcttgcatagataactccccagagtccagaatgagccaaaagtaattgatatgccagtctttgccagcatgtttggtgaatcagagcagcaggtgtctgttacggtattggggaaggttaaatcaccgactgcattgctgatgtggctcttgcttgtgcccatcagcttcccagtccccagaacccccagagtcctagactctcatcattctattcctcaggacaacataaatattatcaggagcactgtgagcacagtcctgcttctgctacttaaagttgaagggaaacgagtatccttacatctctgtatcccatgttcccctgtcttcatgaataagtggtttgattgttttgaggccaacttgagtttatagagcttgtctaataaaaagatggatgtccttggggaaaaaaagctgaggctaataaggtgagagagaaacggaatcctttcaatgagctaagaaattacttcaattgaaaagcctgggaagtgaccctatcttggtcaacatatttcatgggcaaggtctggggatgtctggtgtcttcccaacccatgaaggcacccatcccacctgggtttgccctttctagatggtggcccatctcaaggatatttttctttctttctctgatccaaatccaaggactatgttctagtccttcagaaatctatactaacaaactggataagtgattctgcctcaaagttgcataactacagaatcattggtcaagttcttactgcctgctcacttattcatcaggaacttattgtgtacctgccatgtatcaggtactctactaggtgtgggggttacaaagatgaatgtagtgcagtccctgaactgaagaacatagtctcatcatggatgaaagtactccactaacataagatacattattattgtctaacatatgtgatgttattatgggtatggtacaagatacagtggaaacagagatgagaaagctgatcttttacttggagtggttggctaagaattctcatttcagtatggctttaaagaattcaagatacggctgggtgtggtggctcacacctgtaatcccagcactttgtgaggctgaggcaggacgatagggataaattgtttctataaaaaaagtaaaaatgttaggtgggcgtggtggcacacgcctgtagtcccagctactcaggaggctaaggtgggaggatcacttgagcctcggaggttgaagctgcagtgagctgtgatcacgtgagacaaactgataccctatctcaaaaaccaaccaaccagaaaaaccccaagaattcaaggtgggagatgcagaaaaggtaatagtatcctttgcagacagagacacaaaagcatggacacgcgaatgatactgtgcaggaatagtcaggactcatagtcagctgatatgttttagtaaggctccaccagtgcttatacaggtgttcattctgagtagcctgtgcctcggtagtagctaataatgttgaacatcactctaggagtaatcacagattgcctgaaaccataggggttatacatgagggaaagaaggaagaagaaaaagtgggatgaaaggagaccagttatgaaggcacttgaataccaactaaggagctgtgtgtcaccaaattgtagttactgactcattcatttatttatacattccctggaggcagggataccagatagaagactagattaagaatccaatcaagaacaaacaattaattgagctaaggcagtattaattgaaatggaaaggaggattcagataagaaagatatttttaagaggtcagtgttctgactctggtgactgtctatggtaaaagcaagaaacagagaaatgaaatagaatctaaggtttccatattgggtaacagtgtgtcttgtatgtgctcagtaagggttgttgaattgaacacaatgttaagagcggttttctaatgcttttctccaaagttgaaattacagcagaatttcaggttctaaggcatgagagagagagagagagagagagagagagagagagagagagagagagactgaggatctgatgaatctcttggtgttcaacgtgttggcacagtaagcatttcccaccaataaatgatctgtatagtgattgtgataaactgagtttttgaaggatactctatggaggaaccatggttaatgtctcaatttgagaagagaaggacctgcagataagtgtgaatggctgtgtagactgaactgtacattttggcttgccctagccatgagaaagatatatcagatttaaatagacaaggtttttgttacctacatagactataaaagcgttctgcttttttagtagcacactatccaaaataatactaattacccaaaagtggggaaaaaagacaactgtaataagctcagagtatagttaaaaaccaaaatgattattgtgatgttcaaggaacatgaagtctaagtcaaatttgaaagcttctgttgtgagttgatttgtagacttttatggcaaattttggattcattgtatcatgttttgtgactgagtttgatctattcaatggcttgacaggtcctttagtaaagaagacctgtatctcaatgagccattactgaagttgtaatgagtagataggcaatgtcttgatgttcatacagctctgctcaagtggtctgtaattccttgcaatgccgcgaagaaagcactgggctaagagttacaggatcagccctccatttgccagccacatatctgtaaacaaatccctgaacctctttacacctcagatgccttgtttgtaaaatgggaataataacagctgattcggtataacccaaagggctgttgtgaagatcagaagagatactccatgtgcaatttctttgtgacatataaagctctgctgacttgtgatgctattactattgagaaggccacataggtggaatggttaaaggacctatggaagaccactacgtatgatgttaaggacagtaataggctgggacagtgaaatgtggtagtgccctctcttttttctggctgcatgggtaagctgagactgcaggatgtcactgtcttgagttgttgctccgtgctacatctgaatatattacagtagtaacgtactttcagagagctgacaaaattgtagtcagagatgatctttttgaagcaaaggactcttagtcttttattgtggatttatgtagctcaagggatatagttaagaaccaaaataaccattcctggatcttaagagacaaaggattcatagcagcagttgtttttgctgcacttgtgtttatctccttaaatgtgcacgaatatgtatatgttttttacagcatggggaaactcatgttaaaattcattgaaaccattaattggaagcagatatacttctattacatgttttgataatctgtatttacaaacaatttgtattatttttctattcttttttgttatctacctacctgaaggcgagtttcctattatttctagttcaggcttataagaatgactaatatatgaggggaacttctaaacagtctattactctgcagcccatttggataaagaagtgtgggaagatttgagaataagttccctattgtcatcaacacatgttgaccactgacccttctttcttttccaggcaacttaaagtggtcttaatttgtataaaattatatatcaattttgtccctaaaaggtgtggatcaggctgctaatctgattttgtgggtgtgaggagagggaagcatatatagcctatgatgtatgaatacatgtgatgtgcacatatgtacagcagatccatatccctgaaacattttaggagaactccttaaatgaccatattctacttgtgcagctgtggcagtaatgataactttggtttaatatggattattggaaatggaaatgcaataaatggaaactagtgtatatcaatatagaaatgcctattcattttcattaaaagagtattcagataacattttcataaatgttagaccaatgtgtcatgtggaggcagttattaaaaagactgaaggcaaggggagttgtttaactttaaaaaagacttgatatttgtaagtcaaatttatatttccatcccagatttactctgcaactcaggtttggagctgtgaagtcaaaacccaactattacatgcccagccacaaatcagcatgtcatggagagttgttgtgtgtgtttttgtggaaataagtgggagaagttaactgctgttgaattgttggaaattattggttaaatttgagttatatttgcaaatacacaagtatcaattgtgcaaagtgacgttaaagatgaaaaagattttttaaaaatcacactaactatgcccttgatggaagttacctttcagagctgcttcacttacattctctaaaggtttcctgttgctttctattcgttattcttaatttaaaatcaaattgtgccattgagaatcaagaatgtatcaagagcatttacaaaatgtttcagactacaatgtaaaaaagtaagaatgactaaatcttgaagctcacacttgtcaatttaggatagtctataaattcaaattcaagtaaatttaacttttattttatttacttttaattatgaagcagatagcatctcagttttctcacctattaggtccagggtgagaggagagagttacaagttatctattagcatggttcttatgaaagtaatatcagatatggtggcatgtctaaaagcactttgtaactataaagaacagtgtgagcaatgtttgtatttattattattattatttttgacacagagatttgcttttgttgcccaggctggagtggagtggcactatcttggcccactgcaacctctgcctcccgggttcaagtgattctcctgcttcagcctcctgaatagctgggattacaggcgcccaccaccatgcctggctaattttttgtatttttagtagagatggggtttcacaatcttggccaggctggtctcaaactcctgacctcaagtgatgcacccaccttggtctcccaaagggtgatattattattatagtaaatatcacattgaacaatttttatctaaaactaatgtcagaatgtccatttcttgatataaaaataaaaaagtttgcttttcatttttatctttctgtagagatgttgctttctcattgacacagaaatcaagactgttcagatgatgttaataaaacagcacatcaatataatttttgaaggagatttataaaaatgtacattttaattgtcattaaatcttaatacttattgagcaccaaggatgtgatgagaagtagcctgctaggtctaatgacactacttagctgtttgaataactaaatagcacatttctatttagagaccatataagtattataggtattcttggtgatgttataaagttcttcaaagaaaatatgtatttatatctggctttatatattggggcaaaaatagcaataacactttcaaaatagtgacggaaaaacgagtcacaataaatacgttggattctgaagataaaggagtatataattctcagagttacaacatctgtctataaaaatagtgcaattgggatatactattttagtaagaaactcattaagtgtaattttaaaagctgctgcttttttcttaagtttgacattccagtaaactcttaggaaaatgtccttccagttgcttttcctctaagtgtctagaagtggaagtacattaaaattaaaagcagaaagtcccttaaattccttttaagaagtccatcctgttagtctgactcctagaaaggctatggttgctattactttgggctggaacaagattacaaaagacctcaagaagaagtggaaattatcatgggagttttctgtcactcttatagtttatggcctttttgttctttttttagtccattaaacatttctttttgccaagaggtcctatctgtaaaaggaagtctttgataatgatagtttaaaatgctatgtaatgagatacttatatgcaaaaatccaaaaaagcttttttatttctataataatgataatagcaaacaaattatagtgaacagtaaacaataagctaattataattatgtgaattgctttctccctcactgattccttctatacctattattttatttctctgttcacaatattcctgtgctataagggagactgctaaatttgctcttttttagatgaagacttagagacctgtaaggttgatatgactgcctcaaagacacatggtcgcgctgtggctgagtcgacactcaaggccagttctctgtgtttctttttcagtgtgacttgatatagcttgtatcttaaacactgcatttttcttatgttctaggtttctcctctgccaacccctcctggaccattgtcagcagttgaacgacaaaggctgtgaatctgcatcctagtcttagcagtccctctgattctcatgatgagctcacctgcacagcctggtcagtctggttgcttcttaaactgttaatagacttcatgtgaaagatgttgctttgtgttgtttcaaaccaagtaatttaatttatgaaggaacttttttttttttggacaaagattgcttaatgtaacaaattttgaattttgcattcgatagctaattctctattgcttaacccagtttgcttcctggacaactgatttgatttgcattgtagtctgagcatgggactttaattcttctgcttccaaggtaacattcagattgaactttatgaagttatgaatatgaactattatataggaatccatttttcacctgtaatctttctgtcctaacatgtgtctgtatgcttttaaattatactgtggggctttggaagtcagtttgtggattgactccacctccatctctttgacacacaggaaggatatttttcctccccacccttctttgctgccattcctgtttcctatatacatatttaattataatctcagcacctgcttcctcctattccagtgatgtgtgctgctcatgtagtgctgtgatcagcacagccaacacccgttcctccaggaacaggctgtcatttttggagcaaacacaatccaagttttgggaatgatgaagtagggtcagataccacatactagtaacagacaagttttacaagaattttctgcttggatacttacagaagcatttatttctttatagattccttagcatattgatatccttggtttattgaactaagttgaagcttatgtactatcatactcagggcttataagggagacaacttgccaagattttcattccctggattgccacacccaagttagctgtttgggaattccgctgtttcatcaacctttccccacatccccaacaggcctccaacttgtatgctgaatttggaacttgattctaaatggtgcagtccagaaatccctgagtctttagtcacaaccatgtttgataattggcatgtcactaggttaggcagatggcagttacttacttatgcctgttagctctgagtctttattgcctagtggttctcaaactttagcatgcattgacatcactcggagagtttgttaaaacaagccctattctcatagtttttgatttcgtaagtctagagtggggcacaggaattgtgatttttacaagttcccttgacaatgctgttgctgcttggggaccacactttgggaatcactggtttagcttcttctgcccatttctcaccccatcccctaccagcctctacagacaaccttgtttaagtgtgttctgtgagcggcattgcttattacaattatagtctagtactattattctttctgttgggatgaacttaaattaacatttaccttatataggtgtatattgcattttaaatattatgtatatttatttgtatataaattcagtgtttcaaaattggattgtttaaaagaggcattaatttagaaccactgtggtcaagtatttttttcttgtgataatatttggcagtggatgttggtctaccctgctccccaagaatgttgattttataaaatgaaaatctcacttgaagctgctattttgatgaggaaattcttgcgagttgtgataattgttcagttatgaggagagaaaaggtgatggataaataagacaaccattgaatgaagctcacttgactttagggtcaccaaaatttcctcgtgtacttttttcttataaatcattctgctgtgttgacaataacattatgcagaagtctcaatcaactccatttgggaagtttttatgaatgaaatctgaagttgaggaaagtgatagtaaatgtgccaggtgggtaggagtttcttctatttattgcaagtaaaaaaccatgatcagagacctgaaattcactttgcatggataaaggaaaatgttcctgccacaaacataaaaaaaaattttctcctgttattagcctgcatcttagggtgccgtatatattctgagaaataacctgattgtttgatttagaaaaaaatatgtttttcttacatcttttttccccactatctaaaaagagaattaaattggtcttatgcaatcatcatccatttattttgcttttgttccacaaatggctctaaggagttattgtgcaccagaaagaaaaatagactcacttcagtagttccagaaattctttaatagtccatgtttcagactgagtatgtttgtcttcaaaattggttctggtatagtgtgaattcttatttttcccatacattaacatcattcttagaaacgttctccatccatattcaaatatggttgatatgaaatacaaaatgccgccgtcttaatcatgcattcagtcaaacaataagtgctgatttttgtatataaaatttactagtttttattttaattttgctgcccagttctgttcaaagttagagccttgggtattgcttttgggcactgaggatcctgaatggaggaaagactatctggataagattggcagctagctgctgcagttgagctcttcattcaaaacttattaagcatctaacttgtgccagccagtgtgttacccaatagggacacaacaagcactaaaacatagtttctatccttagggacagcaccctttcatgggagagacaaatagtaatagctttagtccatttagtgtcttaagtattttaataaatttaggaccagaaatttatttcctctgtacagcagtatggatactatttctagtaatgtaatttttatcagaattgccaaatctcagaaggaaggattttaggacttatctagcattttcaaaacatgtcagatagtaaaaatctcctgagacttgttaaaaatacagatttccagactcctccctgaaagagtatcgtgtggtagcctgggggaaggatactggattgtagaatgtatattgctctttgctatgacttggcaaagtgtagaaatgctcttagtccattcaacagcactagtgtttcatatttggagactataaacacaaaaacacatcataaagtcttatctcaagtaaatgtttctcttgtgagcaaaactatgctaattcagttattttgttctctgatgatagataaataaaaagctaacactggctaggtgcagtggctcatgcctgtaatcccagcagtttgagaggcctaggtgggaagattgcttgagccccggggttcgagactagcctgggcaatatggtgagatcctatctctacaaaaaattttttaaaaaattgcttggcatggtggtgcatgcctgtagtccctgctacttaggaagctgaggtgggaggattgctcgagcccaggaggtcaaggctgcagtgagtgagccatgatgaagccactgcactgcattctagcctgggccacagagcaagaccctgtctcaaaaaaaaaaaaaaagaaagaaagaaagctaacacagtggaaacctagagaaggcaataatttgaggggaacattctagtggctttgcgtctatctaggccatctcatttttatggggaggtggatggaccaaagagatttttatggagtgcctttattttcctcaaaagaagtttaagcatattttaacccagggcagctttttagtccgatctcaagattatagaaaacctaatttcagcctgaacgtttttaaataaattgggctacatcaaccctaacatgatttttaaatttgatgaatctattttttgtaattaattttgatgaaaacgcatccaaaggaattttccaagcatagaacacaatgtgcctgttgcccttagaattgtgcaatgctctggccttgtgggcttctaggtaaagtggccaaagctgtgttgcaaagtcctgtaacattagttttcaaagccccttgtataaagctagctcatctctcttttcaccattgtgggaagtactctactcatatgaagtgagaggaccaagctatttatagaagtgaaaggtttatagcaagatcttatattctgttcattttctcgtattctattcattttcttattggcaagtcttgggcaaaaattaattaagagatttatcttcatgcctctgttttgctaaacagctgaattcccccatagaaatgtagagtacatgtaactaatgatcaaaaagttctttgaaatataaattgttatggaaatgctaagtagtataaacaatttgggggcaagcattaataaaagcttctctgcaagcatttttaaagaggactaataaaagcttcatggttcaattaatacagcacaacatcaggttttttagaagcatatgggacccagaaggcctgcccctgtttttaaaatttacgaactctttaatgattcaccatttttactccagtgcattacccacagtggtgccatttagccattaagtaggaaactaaaaccaggacaaagctacaaacaaatatcataatgtccaagtgggtattttttcttcagtttgttcatagtgtgttaccaaaaaaatgaatgttaaatgaaacagagtcttagggcaaatcaaataggttatggcttccctagatgagtatgatcagttagctttttaatgaaatacaggtcaaatcccatgacaagtagctctacataactaaaatattttcaggccactggccaattatctatttcaagtaatattcaagaaaattattccaggataataaaacaaattagttttttgatgtttgttgtagcagaagttgatcacagggtatggtattaatgggaaacactgtatgttaaagttattaactattgttttggatttttttttttttttactactttaacttcacagttaagtgattcattcttttgccatttgtaagtcaaaacttctcaatctgatattcaagtttgaaacataaaccaaatgaagcattttattcattctctagtttttgaaggacagtgctttaataagtgaggcataaaccttttctgaaaatgttcagtataaatttgttttgaacatttatttgtttttatatttgcttttcacaattaattttggtgggtaattcaacttatataattttcattattgtaacactacaaacaaactccataatgcaggccaaacagaaaaggttatttctcgttcatataaagactgagtagagagctgctgtttttctaatggctaccctttgccccggacagcttctaactggtttgtgcttcttcagttcatgtattctaaggtcattgtgcatctccgcatcaagctggtgggagggaaattgaagaggtgcattgagtgtgagaggtttccaaaggtacatcacttttgttcacatttcgttgagtggaatttagccacgtggccatacctaactacaaaggaggctgggaaaagtagtctagcagtactccaggaagaggaggagacaggtttggtgaacagctggcctctctctaccacatttgtcttaaaattttatacctaggactgcagatacggtattgcttaccaagaggtgcagtattttataatgcactcttgatttaaccagtcattaaaaagttaagtaattttcctttgaagagattgaaacacattaaaatcagggcagatcagctcaccaacatttctaagagttgcctaagcctttgtttatgaatcatgcagaatagataatgcccagtgtagctattagaaaattcaagttcctgttagtgggaactctgcagaaaatgggagtaaaatgtatgctgaatattatatgtccttaattagtgtttaaaaataatgtcaatttatctgaaattataattgcacatatgctgaggaaaaagtactttaaactttataatcacaattcttatgtttgttctttattgcattttggggtcacgtttttcaacacctctgtagttttaagtattatgatgaaaatctaggccaaatatacagtggttgataaatacttgttttacactgatcttttcatgaacactactataaaacaatgctagactatatattttcttaagccctgtaagcaaaatcttgctacctctgcaaatacacatgtacagccctttgtttataacattatgtggaacctttatggaggatttttttgtctgtatagattggagtttactcttcagagtacaaaaactctgtgtgtgtgtctgtgtgtgtgtgtgtacgtgtgtggtgcatgtgtgcttgtgttgcagtactataataactctagggaaacacaaaggtatgtggaaccatgtaacctgtacttttacactaaatatcccccaaggctttactttctgtggttttctgcatatttcttaatttttgtcatattttgagaatgtcaacgtatagcagttttctccatttataattcactgcctctaacttgttgtagggttagaaagctaagaattgtgttaaataaaattgttaaaagatcacaagttctgaggaggtgcaaatgtcttgtttttttttttttttttttgtgtgtgtgtgtgtgtgtgtgtgtgtgtgcgcgcatgtgtctctgtgtgtgtgttttaaatagagttttgttcttgttgcccaggctggagtgcaatggcatgatcttggctcactgcaacctccgcctcttgggttcaagcaattcttctgcctcagtctcccaagtaactgggattacaggcatgtggcaccatgcctggcaaattttttgtatttagtagagatggggtttcaccatgttgctcaggctggttttgaactcctgacctcaggtgatccacccacctcggcctcccaaagtgctgggattacaggtatgtgccactgcacccagcctgcaaaagtattttttatgaacaaaatagaagtacttgtttttcttacatactgtaattgcattttaattgtctccttatccactgcacccctcttattttctcggttcttctgtctttagtctatagatttacagaattttgagtttccagcgggtgaggcatcgttatggttttaattttgccatacttttccttgcagttatgatacatcagtttttttttctttttttttaaattatactttaagttgtagggtacatgtgcacaacgtacatgtttgttaacataggtatacatgtgccacgttggtttgctgcacccattaactcatcatttacattagatatttctcctaatgctatccctccccctgtcccccaccgcacgacaggccccggtgtgtgatgttccccgccctatgtccaagtgttcttattgttcagttcccacctatgagtgagaacatgtggtgtttggttttctgtccttgtgatagtttgctgagaatgatggtttccagctgtatccatatccatgcaaaggacatgaactcatcctttttatggctgcatagtattccatggtgtatatttgccacattttcttaatccagtctatcattgatggacatttagattggttccaagtctttgctattgcgaatagtgccgcaataaacatacatgtgcatgtgtctttatagcagcatgatttataatcctttgggtatatactcagtaatgggattgctgggtcaaatggtacttctagttctagatccttgaggaattgccacactgtcttccacaatggttgaactagtttgcactcccaccaacagtgtaaaagtgttcctatttctccacatcctctccagcatttgttgtttcctgactctttaatgattgccattctaactggtgtgagatggtatctcattgtggttttgatttgcatttctctgatgaccagtgatgatgagcattttttcgtgtgtctattggcttcataaaagtcttcttttgagaagtgtctgttcatatcctttgcacactttttgatgggctgggttgttttttttcttgtaaatgtgtttaaattctttgtagatttgtcagacggatagattgcaaattttctcccattctgtaggttgcctgttcactctgataatagtttcttttgctgtgcagaagctcttcagtttaatgagatcccatttgtctattttggcttttgttgttgttgctttcggtgttttagtcatgaagtccttgcccatgcctatgtcctgaatggtattgcctaggttttcttctagggttttttttatggttttaggtctaacatttaagtctttaatccatcttgaattaatttttatataaggtgtaaggaagggatccagtttcagctttctacatatggctagccagttttcccagcaccatttattaaacagggtatcctttcccatttcttgtttttgtcagatttgtcaaagatcagatggttgtagatgtgtggtgttatttctgaagcatctgttctgttccattgttctatatctctgttttggtaccagaaccatgctgttttggttactgttggcttgtagtatagtttgaagtcaggtagcgtgatgcctccagctttgttcttttggcttaggattgtcttggcaatgcgggctcttttttggttccatacgaactttaaagtagtttcttccaattctgtgaagaaagtcattggtagcttgatggggatggcattgagtgtataaattaccttgggcagtatagctatttccaagatattgattcttcctatccatgagcatggaatattcttccatttgtttgtatcctcttttatttcattgagcagtggtttgtagttctccttgaagaggtcctcacatcccttgtaagttgcattcctaggtattttattctctttgaagcaattgtgaatgggagttcactcatgacttgactctctgtttgtctgttattggtgtataggaatgctggtgatttttgcccattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcttgcctgattgcgctggccagaacttccaacagtatgttgaataggagtggtgagagagggcatccctgtcttgtgccagttttcaaagggaatgcttccagtttttgcccattcagtatgatattggctgtgggtttgtcataaataggccttattattttgagatatgttccatcgatacctagtttattgagaatttttagcatgaagggctgttgaattttgtctaaggccttttctgcatctattgagataatcatttaatttttgtcattggttctgtttatgtgatggattatgtttattgatttccgtatgttgaaccagccttgcatcccagggatgaagccaacttgttcgtggtggataagcattttgatgtgctgctggatttggtttgccagtattttgttgaggacttttgcatcgatgttcatcagggatattggtctaaaattctctttttgttgcgtctctgacaggctttggtatcaggatgatgctggccttataaaatgagttagggaggattccttgtttttctattgatgggaatagtttcagaaggaatggtaccagttcctctttgtacttctggtagaattcggctgtgaattcgtctggttctggactttttttggttggtaggctgttaattattgcttcaatttcagagcctgttattggtctattcagaggttcaacttcttccttgtttagtcttgggagggtgtatgtgtctaggaatttatccatttcttttagattttctagtttatttgcatagcggtttttatagtattctattctctgatggtagtttgtatttccgtgggatcggtggtgatatccccttaatcatttttgattgcgtctatttgattcttctctctttccttctttattagtcttgctagcagtctaccaattttgttgatcttttcaaaaaaccagctcctggattcattgatttttttgaagggttttttatgtctctatctccttcagttctgctctgatcttagttatttcttgccttctgctaccttttcaatttgtttgctcttgcttctctagttcgtttaactgtgatgttacggtgttgattttagatctttcttgctttcttttgtgggcatttagtgttataaatttccctctacacactgctttaaatgtgtcccagagattctggtacattgtgtctttgttctcactggtttcaaagaacatctttatttctgccttcattttgttatttacccagtagtcattcaggagcaggttgttcagtttccctgtagttgtgcagttttgagtgagtttcttaatcctgagttctaatttgattgcactgtggtctgagagacagtttgttataatttctcttcttttacatttgctgaggagtgctttacttccaactgtgtggtcagttttggagtaagtgcgatgtggtgttgagaagaatgtatattctgttgatttggggtggagagttctctagctgtctattaggtctgcttggtgcagagctgagttcaagtcctggatatccttgttaactttctgtctcgttgatctgtctaatattaacagtggggtgttaaagtctcccattattattgtgagggagtccaagtctctttgtaggtctctaaggacttgctttatgaatctgggtgctcctctattgggtgcatttatatttagtatggttagctcttcttgttgaattgatccctttaccattatgtaatggcctgctttgtctcttttgatctttgttggtttaaagtctgttttatcagagactaggattgcaacccctgttttctttttgctttccatttgcttggtagatcttcctccatccctttattttgagcctatgtgtgtctctgcacgtcagatgggtctcctgaatacatcacactgatgggtcttgactctttatccaatttgccagtgtgtgtcttttaattggggcatttagcccatttacatttaaggttaatattgttatgtgtgtatttgatcctgtcattatgatgttagctggttattttgccagttagttgatgcagtttcttcctagcattgacggtctttacaatttggcatgtttttgcagtggctggtaccggtttttcctttccgtgtttagtgcttccttcaggagctcttgtaaggtaggccaggtggtgacagaatctctcagcatttgcttgtctgtaaaggattttatttctccttcacttagtttggctggatatgaaattctgggttgaaaattcttttctttaagaatgttgaattttggcccccactctcttctggcttgtagggtttctgtagagagatcagctgttagtctgatgggcttcccttcgtgagtgatctgacctttctttctggctgcccttaacagtttttccttcgtttcaaccttggtgaatctgacaattatgtgtcttgggtttgctcttctcgaggaggagtatctttgtgatgttctccgtatttcctgaatttgaatgttggcctgtcttgttagtttggggaagttctcctcgataatatcctgaagagtgttttccaactcatttccattctccccatcactttcaggtacaccaatcagatgtagatttggtcttttcgcatagtcccatatttcttggaggctttgtttgtttctttttactctttttttctgtaaatttgtcttgttgctttatttcattaatttgatcttcaatcactgataccttttcttccacttgatcgaatcggctattgaagcttgtgcatgcgtcatgtagttctcattccatggttttcagctccatcaggtcatttaaggtcttctctacactgtttattctagtgagccatttgtctaatcttttttcatggtttttagcttccttgcgatgggttcgaacatcctcctttagcttggagaagtttgttattactgaccttctgaagcctgcttctgtcagctcatcaaagtcattctccgtccagctttgttccattgctggcgaggagctgcgatcctttggaggagaagaggtgctctggattttagaattttcaacttttctgctctggtttctccctatctttgtggttttatctacctttggtctttgatgttggtgacctacagatgggattttggtgtagatgtcctttctgttgatgttgatgctattcctttctgtttgttagttttccttctaacaatcaggaccctcagctgcaggtctgttggaggttgctggaggtcctctccagacgccgtttgcctgggtatcaccagtggaggctgcagaacagcaaatattgctgcctgatccttcctctggaaacttcatcccagatgggcacctgcctgtatgaggtgtcattctgcccctgctgggagatgtctcccagttaggctacatggcggccagggacccacttgaggaggcagtctgtccgttctccaatctcaaacaccatgctgggagaactactgctctcttcaggcctgtcagaaggggacgtttaagtctgcagaagtttctattgctttttgttcagctataccctgcccctagaggtggagtctacagaggcagcgggccttgctgagctgtggtgggctccacctaattctagcttcctgagcactttgtttatctactcaagcgtcagcagtggcggacacccctcccccctgccaggctgctgccttgcaggtccatctcagattgccacgctagcagtgagcaaggttctgtgggtgtgggacctgccaagccaggagtgggatataatcttttggtgtgccatttgctaagactattggaaaaacgcagtatttggttgggtggtgtcccgtttttccaggtaccatctgtcatggcttcccttggctaggaaagggaattccccaactccttgcacttcccaggtgaggtgatgccctgccctgcttcagctcaccctccatgggctgtaccctctgtccaaccagtcccagtgaggtgaaccaggcatctcagttggaaatgcagaaatctcctgtcttctgtgttgatcacgatgggagctgcagactggagctgttcctatttggccatcttggaacggaccagtccatagttttataatgcatgcctatgtgttgatttgtgttgctttggagttgctttaatatccaaatgaaagactcatgaccatattattggtgaacttttaaaaaatattgtattgatttataggaaattgataagctttgaggtaatctgtaaaattatttttaacccccccccccctttttttagaataacttcctggcacttgattatataaggctcttgctgcttatgatagatggttgctcctcacatatcattgcataattaaccttttctcccaggctcttaatgtccaagaaaatgttctcttcataccagtaatgtagttccactggaaagtgttctgggtgagctggggatttttcctttggagctggaatttgccctagtaattctgccttctttggaattctgtgagttctgtgagagggcagataatcatagtggtgtatgaccaagcactcaccttttatctttaactctcagaagaaattgtttttcagaaagaaatgtcaaaatgacattattcatgagaaaaactagtcatgagttttggactctctaggaatgtaaacatgtttaataaaagctggtgacagtttttcggtctgctgttactggaaagcctgcttgatttccttccctgtgtttttctggtcttgagatctccagtgctttctgaagatccaggaatgccgtacaaatgggaaaagccagactgttatcttgaacctctgtttttgaaatctctgtctgataaggaaaaaaatattgcaagtcattgtagttacttgtttggtttgtcactggaattccaaatatttgcttggtggttcatggacatgtaaattttgggatatgttactattgtttagggtatactgtctgtaaaataagttattaacccagtgactgttaactagatcttccaaaagccctgtctcctatcattttatgtgtattgaaaaattattataattagagatttttttaaactcttagaaaatgaaagtatacagctatgaaaattctgtttgggtaattttttaaaaaatttattttcagttcagaggtacatgtgcagatttgttatacaggtaaactgtgtgtcacagggctttggtgtacagattatttcatcatgtttggataatttttatgttattttttaatgcatttttatccttttgtctgtattattgtgcttccttttttattaaagaagagttggatgtatcttactttggctttatgtttaaagtgaaacagtaaattgaaagattttaacaggtcgtggtatgtcaatgaaagaacctagaaattagcagaaaaatgcaggaagccaactatagatattggaaaaataatacataccataacttgagttaggtaatgtacactatcgagtctttgaatttcaataaagtatgtcaaagtagacattgtatgtcattttcccttctgttgggagaactgataatccgcctacccatctgccttcctacctttcttagttttctttctttttcttttattctgcctaagtccagaaaagatttggggtctatataagtaagttatggaaaataaaatacgtgaggaggaagggaaatgaagggaaattgggtacaccctgttagtacctgcatttaaattctgtgaagttgcttgaagacggatggatctgtgtctgagcttcctgattagcaagtctgttgtctatggtgcgattaatctcttctcagcctaactctgatatagtcactgccctgtataagaaatgtcagtggctctctatcacatctatttaaggtatataagaacccgtacccttttcaggcttatcttatttttctcctcaatgaaccccactctgttcaacatgtagagctgcttaccttccccaggtccagttttcttgcttggaggcctttgaatgacccttcctcaccactgggagtgtcctgtttacttatcttcaacacccagctcctactccattcttctgtgaggccttcctgggtgacgctgacatttgttacctctctcagttctggaacttaccttagtactggggttgtcttctctaataggcttagctttttgagggcaagggacatctaagtacattttgtggggtgtatatagagtgaagcagttggcagctgtatttatggttgctctcttagttaagtaatatactgcccagcacacaaaaggagccaaataagtgaagaataaagggcactttgtgaggaggctgattatagtggtgctaggggcatggaattggggaggagggaagcagttgaatatacctgagcaaaaccaaactgtttcatatgtgtcatgaatcatatcccttttctttttgcttattcatttgttgactttcggttcttttcacctctagtgctatccactgaacttcctccatccccctacctccccttccctcccgttccctcctccacctcccctcccctcccctctcctctttgacagagtcttgctctgtcacccaggctggagtgcagtggcacaatcttggcttactggaacctccacctccctagttcaagcaattcccttgcctcagcatcccgagtagctgggattacaggcacatgccaccatgctggctaattgttttgtatttttagtagagacagggtttcactatgttggccagacttgtctcgaacttctgacctcaggcaatctgcatgccttgggctcccaaagtgctgggatgacaggcgtgagccactgcacccggcccccctctttctaaggtggcttatctattcattgaacaacaaacattgcaatagggtagtcattgtttgcaagacttgtggtttcatactgagttctctaaatgtggggaagttgctaagtttggctcttcttcagctagcacagcggtagaagcagacctaccaccctctttccttttagtaacttgaacttctccctgtttcaatgcttataaaccacctctctcccaaaacaaatatgtattgtggttaagaatagtggaaagagtgacatgatttttaattgtggttgagcaggaaattgttttaagttagtttagaattcattgatccaacattctttatacttttaaaaagtaatacagttttgcatactgtataattagcagtaacttttaaatatactacgtttctgaggaccttcagtaaaatacatagaaaggaaaacatccggcttaaaatttgtgacttttcaatctgtatacattttcagttcctcttatttaaagtgatagactaataaatattttaatataatggttgaagtctttattaagattaaattaggatcttaaactttctgtgtgtctccattaaagatgtgtttttggcttcattatttgacagtgttgtggtatggcatttaatggagaacaagatctcttactttggaatgtatctggtcaaatggagttcctttcatatttgcccaggaagcttatttttctaaagattatggaaataacagatgtggaacaagcaagcactgcatgtctttcattcagagttctctgaggaaccaccttgggtaggcttttgtttgtcacacacatagcaagtatgtctttaccctgactgatgcaatagtccagcctcctgtggggtatcatccactaacaataatgccataacccattagttgattgcaaactctctgaatccatagggacttgccccagtccaaatgagtgactaattcttaaactacaaggtaaagctgaggtcctaagggaggagggacatgttaaggtttgactgtttattttgcttgttattactgcaggatcattaaagaaatgtttatatcctgttggggttctatgttcttaaccactatataaggatgaataagctttgttttttttgcttctacctctcttatatttctttccattctctaccctccctctcctaaggaaaaatggtgttcacactcattgggtctaaataaacccaaacgtcttttctttgaatattttattaccttatctgtttatctattaatgagaaattatacaaatgcatatttgaagttcttagtaaaagcccaaggacttaaacgcagctctggaaacacctgtcatctatcttttatttagtaaatctccctttgtcccagattcctcatttggaaaatatgtcatgaatttgttatgttggtatcataaaagatgtaattgtacaagagatagtaaagtatcacatgttcatttagaatgatcacacataaatatgtgcttttttctctcaaccgtgacctgtaactatccttttttgaatgtcacaaaaatctcatgtctataagcctctccacactgatgagattgaggcctaaaaccatcatctcccagctctgtcacaatttccagatttgtctctgtctttaggtttgctcacttttgagcacatagaattatgccatccttttcaaattacatgtcagctccttactttatcctacccccagtagtgagcgccttagttgccttgcttcatcttttgatgtgtttttacactgtttgtcatgccagcatttcttgtgagcaccctccccaagacacatacacacacacacacacacacacacacacacacacacacacacacacaccacattcttaacctatggacatttgctgctgtaaattcattatatatggtgcattgaaaatgtttgctctgtgtttctttctggaccttgtgctagcaactttgttttgtcatttttgtcaagtgattttcttttttcttttttttttccaaatcagctaagtcactgataagattgatgagtatgagagattgatcattttacaatttccatcctgcggccatatgagaggttgtatttggtacctagattagatcaaagagtgtcagaactcaatgggctgtataacatgtggcaggtagcagagtaaattggaaagaataagaataccagaaggagccaagaaatacctgttggaaaccccaatctgccctaactaactttgggcctttgagaacaagttactttatctctctggatatcagttttctatcttgtattagtttcctgtggctgctgtaacaaattaccacaaacttggtggcctaaaacaaaggaaatgtattttctcacagttccagaagccagaagtccaaaatcagtttcactgggctgaaatgaaggtgtcagtaggaccttgctccccacaaagactccaggggacaatctgtttcttatctcttctagcatctggtggctgctggcattctttggtttgtgactgtatcactccagtctttgcctttggggtcacattgccttcttttgcgtgtgtgtcaaatctcctcctccttcactcttatatgcatatgtgtgattgtattttgggaccacctggataatctgagataatctccccatctcagaacctttaagcatgtctgggaagtccttttttttccctaagaggtaacattcacaagttctagggataaggatgtgggtatcttttgggaggttgttattcagctactaaacgcctgaaataatatctgaagtcatgctggcttggcttgtaattgctattcatttcattcatttgttcattcaccaaacttttatttcatgcctaatatgtgccagacactgttctaggcaataggaataacccactgatcatgcctttagtaaattcattatattgttggtgagattaccatacagaataaatgctaaaataaaggtaaaagagacaatttagactattggattaattctttgtatgtctccttttgcacagttctggagcacaagccaccagcatgcctcagtacttgtaaatcatttcagtaactacaaggattatgtgtagtgtagcctgtggaccagaaagtattttacagaggtcaaagcacgcatcagcttaaattcaattcaggtgtatatattgagtacaaaaataaagtttagacctccaccacaattatacaatttttgtcaaccctggctgcacatcagcatcaatagcaggcctttacaaactactcatacctgtccccctaccccaccttgtgcttggttctaggtggagcccaggggtcctttaaaaaaatcttattagcagattcttacatgctgagggcattgaacagagagaacctgtggtctgaagaataggaaaaccaaatacaagggtactgatacaaatgcaagtcaaaatactgtaagttttctcaggatatatagaaacaaaatagtttggatactcagaggaaaatgagatcacatctggctcaagggaaatttgaagacggaagtgtttgaaatatccttgatggatgtgtaaaatttcaacaggcattgattaggggagggtggaggaaagggaatccacagaggtctggagtaggggaaaaggtgtgtgtcatggctggcagcagggcccaggagccaagatctaggcaccaattctctctccttttgctgagactttctggcctggaaacttgaagagcttgagaattctaaatttaaatctggtcctctaggtcattgtgaaggtatattttttcaaggcaggagggtaaaatgtattttatttgacaggtaataggttgatatatactttttaaaaatttagaaacatgatttctgggcttccatttgtactcttgctctatgtcgtacaagtattaggagcaggcttctgtgggggaaataaaaatggagaggaatgttttaaagtgtttcaaaagaagaatagccaatatgtgatgactgacgggaaaacagacaaacatagtgggaggtaacaaaggtaatttaaaagttcaagaatgacagtagaattagtgggagtgagacatattgatggaaaagatagctagcatttgttgagtttttctcacaagccaggggctttcactgcattttctttatgtcaatgaattattttcataagccttgaggtaggtactattcttatcccattttacagacgggaaattgagactttgaggggttagttatcttgctctatcaaggtcttacagtaaatctagctcttggatccaggtaccttaattccagagtttgtattgttaaccacagttctgctagttgtcaggagattggcttgagaataaggctgatgaagagtagttgaattcaaagacaggaatttaagaatcatcagaagagaggtcacagtcaaaaacttgggtagtcagcaagcatcaccttatcaattaaaaaacggaagaaagagagaagagtagagggacaagactaaatgtcactgaagctttcagggcagtatcttatacctgtttatggctgccagtcacttaacatatgattttttttttttttttgagacggagtctcactctgttgcccgtgctggagtgcagtggcgcaatctcggctcactgcaagctccgcctcctgggttcacgccattctcctgcctcagcttcccgagtagctgggactacaggtgcctgccaccacacccggctaattttttgtatttttagtagagacggggtttcaccgtgttagccaggatggtcttgatcttctgacctcgtgatccgcccgcctcggcctcccaaagtgctgggattacaggcgtgagccacggcgcccagccatggtttgtttttttaaaaaaagcccttgaatatttaagtaagcaaatgaaccaatccctcaatcgtgaatttttctacctgtgcttcagattctacatacataataattacgatggctagaaggagacaaatctaaagaatttcctcaacttttgctgcctgtttttgtgaccctgattcagtttcaaatccttggggatcttccttggattccattttttcaccttactccatcttttcccccacagaagatagctgcttttggaaggttatcctagcataagaagattggcagaacacttcactacttttgtcattttaaacagtttctttaatttaaatttttcatttttctgtagagatgggggtctcgctatgttgcctaggctgatctcaaaatcttggcctcaagagatcctcctgctttggcctcccaaagtgttgtgattacagacatgggccatcacacctggccattttaaacagtttgtaaactaaggtattaaagtaacaatacataaatggtaaagtatcctgggctgttgagtgtctttctcctcccctcctcttcgagtgccctgaaacttttttcattctaccattctcacaatgagtatgcataaaaagtcactattaaataatccaggaaaataaaactattgcctttaaaatatataaattatacatttttttgttacctgttattgcatgttgagtattcctcatctgacatgcttgggaccagaagtttttagattttgtatttgtttggattttggaatatttgcatataaataatgagctattggccgggcgcggcagctcatgcctgtaatcctagcactttgggaggctgaggcaggcagatcacctgaggttgggtgttcgagacccgcctgaccaacatggagaaaccccgtctctactaaaaatacgaagttagctgagcgttgcggcacatgcctgtaattccagctctacttgggaggctgaggcaggagaattgcttgaacccaggagggtgaggttgcggtgagccaagatctctccatagcactccagcatgggcaacaagagtgaaactccatctcaaataaataaaaaaataaataatgagctatcttggggatgagacccaagtctaaacatgaaattaatttatgtttcatacataccatatgcaaatagcctgaaggtaattttattcaatattttaaataattttgtgcacgaaacaaaatttgtatacctgaggtaaggtgaggaatttccacgtgtggcatcatgttggtgttcaaaaagtttcagattttggaatattttggatttcagattttcaaaataggtatattcaacttatattaaccagatcaaatgttctatgcttgtcttgttctcttgaccctcggattatttcacaatcagaatccagcatattcatttgaaaggtgtagggtattgaataaaaaggatttcagaacagctatatagttgtgtcagatattttaatattatagtactgtatttttgtgctattgtatcagagtcacatttttattaaaatttatgatttacacctaatctcttaaaaaatactgcagagcttgccttagtctgtatcctgcatgtcctatttctttttctagtactgtaattgagttgctatgtaaaatgtggtctgcctatgtaattcttcccacctaactttattaggaaaattaatagaatagcaatatcacaaaagtgtttgattagaatcatgggaaatgaaactaatttgcaataaagcccaagactggctttcaaagcaagtgatttttatggttagaagtcaaacaactttacttacagacagtgatcgaggcaaaaaaagtccatttgttatttgaaagacatcaggaaagccactgattctcagtttggactatacattaaaataacctggagaactaaaaatgaaaaccaaaagtctgaaccaggaccaccacctcaatgatactgacttaatttgacttttatgaggcttaggcgtgagtattcgttaaacctccaaggtaattataatgtgcaactaatgttgaggactgctattaaagcaagcatcaggaaagcacaaagaacaggataaagtaaataaatataaaatccttaccatttaggagatgacatgtcctttctaaaagaggaaatattgtctattaagttatgaaaactaaacttttagttctattttgaaaagagacaaattaatctcatttaaatattgttacaagcatagataagagtacatatctatactttttaaaaagccccttttttttctctttgtatttaaactcacttatcttcttatattcaagattattaaatctcagctatgggcctcgttttcccctaccttcatattgttccaacttatgaattgaaactgtacattaatttccaaatgaataatttaaaatcaatggagtaaatgggacacttgcagtcaatgaaaaaatccagcgattatctcgggcattttttttctccataaagaaagcatgattactcttacaaaatggtattttgtcacttcgtgcaaagtatcttgatcattctgggcctatgttgctttttctgtaaaactgggatatcacatattgctgaattgcagtgaccatttattgagtgttcattgtatttcaggttctaagtgtattaagtactttatatgtgatatctcattttatcagattgaaaacactatggagtaaggactattttctaaaatcctattttgaagatggaaaaccaagccttagagacttgcctagctaggttaacatgtctaaagttatatttcttgttatcgactgggccaggatctgaatttaggcagtccaacacggtagccactggtaacaaggtagcgctaaccctctgtgaagacaaatttttctgtttagctgactggttaagactaaaattaaagcttgtaccttctttacagggacgttttccaaaaagacagtcttgatatttcccaactgagcaacaggtttttctgttgaagctaacaaggaacaggtgcactgctggtgttggcatgtgccgctggcaccggacttgtggtaggatggtgctttctggtgctggttgggttttaaggaaggagcatgacactcaaaaattcccaaagcccataagactctgccccactcttcactaccaaatcttagggaaaacttcgggtagggagaaaatagaagagagctcttctggattaacatgaagtggcttgaggaatgtcaggagtgggaagccaggaaaatttgtggtcagaagaccttaattaaattcctggctctgctcttcatgccctgaaagtcactcaacttttctgaatctcagttttctcaactttaaaatagaaatgatgatgtggtaattgaattccatacttcaaaggacagatgatcaaataagataatgtactgtaaaaactctaaataaagcataaggtggttttgaaaactgttaatgttaataaaagcagatttttattttctaattggaagtctttatctctttaacatgcagaataaaagtaaaacaatatttactctacagaactacttaaattagaatgcctgtgtggtatacttggactgacttttacttccccaaagtgttcaaaacccctaggcatttaagcaactttcagtgtattagttactgcctaatgggcaaaccctatgatcttttctcagtcttcatagaattatagcagtaataatttattattcaataagtgtacattgagtacctactatgtccctggaatgggtttaagtcattggaaataacagtcagtgaaaataaaggcgggcaaaaatgaaattgtctattaagcacctaatgtggacaaagtgttacatataatctcattgaatcttcacagcaatcctgtgacataggttttactggcattacttataaatgaggatactgagggtcagagagtttaagaggcatgtctggcacatcctagcaaggagaaaagtagaactgggattaaaaccctattctatcttcttttctagcaagtggcttttcttgtgaccatttatttgttaattcatttattcatacttcactcagtagtcgtttgactttcttctttctatgaacatcacagatattttcttagccacctgtggttaaaaccatggcaccatctttaaaactcttaactctattcccctccacatcaaatctgttccaatcttgacaaaccttgtcttccatttttgttgccaaccttttgcacttattactccttgctgctactattctactagacttagaactagtctactttccctctcccctccattcagcctaatccatacagtgttgcctagtgaatcttactaaagcacaaatctaattatgtaatttctcgaaaatcttccatggcttgccatggcctacagaaattgtcagtaatcacaaggcattcctactgtcaagggtatagggcaaaccatattttcagccttcttcagtgtgcttcttcctgtgcacaaaattcatgtttcccaggcttgtctgataagaatcacctggggctaaaataattcatagattcagtggtattcccatcaaaataccattgacattcttcacagaattagaaaaaactattttaaatttcatatggaatcaaagaagaccctgtgcagccaagacaatcttaagcaaaaagaacaaagctggaggcatcatgctacctgatttcaaactatactacaagtctacagtaaccaaaacagcatggtactggtaccaagacagacatatagaccaatggagcagaacagaggcctcagaaatagcaccacacatctacaaccatctgatctttgacaaaactgacaaaaacaagcaatgaggaaaggatttcctgttaaataaatggcgttgggaaaactggctagctatatgcagaaaattgaaactggaccccttccttacaccttatacaaaaattaattcaagatggattaaagacttaaatgtaaaacctcacaccataaaaaccctagaagaaaacctaggcagtttcattcaggacgtaggcatgagcaaagacttcatgacaaaaacgccaaaagcaattgcaacaaaagccaaaattgacaaatgggatctaattaaactaaagagcttctgcacagcaaaagaaactatcagagtgaacaggcaacttacagaatgggagaaaatttttgcaatctacccatctgacaaaggtctaatatccagaatttacagggaacttaaacatatttacaagaaaaagacaaccctatcaaaaagtgggcaaaggatatgaacagacgcttctcaaaagaagacgtttacatagccagcgaacatgtgaaaaaatctcaacatcactgatcatcagagaaatgcaaatcaaaaccacaatgagatactatctcatgccagttagaatggcgattattaaaaagtcaggaaacaataagatgctggcgaggctttggagaaataggaatgcttttacactgttggtggggatgaaaattagttcaaccattgtggaagacagtatggcaattcctcaaggatctagaatcagaaataccatttgacccagcaatcccattactgggtatatgcccaaaggaatataaatcattctgctataaagacaaatgtacatgtatgtttattgcagcactatttacaatagcaaagacatggaaccaacccaaatgcccatcaatgatagactggctaaagaaaatgtggtacatatacaccatggaatactgtgcatccataaaaaggaatgagatcatgtcctttgcagggacacggatgaagctggaagccatcatcctcagcaaactaacacaggaacagaaaaccaaacaccgcatgttctcactcgtaagcaggagttgaacattgagaacacatcacacagagaggggaacaacacactccagggcctgttgaggggtggggggtgaggggagggaatttagaggacaggtcaataggtgcagcaaaccaccatggcacatatatacctatgtgacaaacctgcacattctgtacatgtatcctgtttttgtttgtttgtttgtttgttttagaagaaataaagaaaaaaaagaatcacgtggggcttattagtatgtgagttcccagaccccacttgaccatactgagccagaatctgcaaggatttacagagccttgtggggcatggtaagactggtgttcctcccaaagacccagaacacaggtgcatgcctgtgattatcctaggtctcttgctagcactgtgtgttgaggtagtcagccagtgtcatctgatgtgatgacactttgtcatatctgagacctcccagtcaccctttctcacgcattactgaggtgcaaaccaagtgtcaaaaaacccaaagacacattaattaaattgaatcctccaaagaagtgtttttctcacatttttaagagcatgagatatttttatgtgagcacaatgtgaaacacataaaaagatttaacttgtaaataacttgtgtgtggtgtgtgtgtgtgtgtgtgtgtgtgtgtgtacgtttgagacagagttttgctcttgttgcccaggctggagtacagtggcacgatctcagctcactgcaacctctgcctcccgggttcaagcaattcttctgcctcaacctcccaactagctgggattacaggtgcctgccaccatgcctggcaaattattttttgtatttttagtagagatggggtttcaccatgttggccaggctggtctcaaaactcctgacctcagttgtcccaccaatcttaccctcgcaaagtgctgggattacaggcgtgagccaccacgcccggccataaataacttgtttagctcatatgtgattgtccaattttgggcatgtatacatagatacatatacatatataaatgtatataaataaatatgtgtatatgtgtacataaatgattatgggcatatgtatttgtgtgtttgaatatatgtgcttagggatagggacacacatgtacatgcatagatgacttgccttcgccaaaatttatacagatgtttctcaacttacaatggggctatatcctgataaacccattataagtcaaaaaattgtaattataaactggcttataaaaagaccacccaatattgcaagataaaaggcattaactgtaagattatgatgcaagaggaaaataatgaccagaaaataagttggagtggaaaacgtttctctaaaactttctacgctatcattgaaatagctattaaataatatattgaaataaagattgttgcttttctctttttattttcccaattttcactcttattaagtaaaattactcagcttttaaaatcacttgtatcatctcactgtgtatttacagattttttgcttctcagaaatttctgtatgtcccaaattccttttaaatatttaaatattatgcatgttttacctttgtaaactcctacctttgtaaaacatgcggaatattatttatctcatggatttcacccactgtcaaaagtctacttccctatcaccaataaatacttgaatactattaagtgataattttttagaatcacagggatcaaactatagttgacttttgaacaacacagggattaagggtgctatcaccacccccagtggaaaattcatgtgtaactttttgactccctgagaacttaaccattaataccctactgttgactggaagccttactgataacataaaccattgattaacacattattttatgttgtatgtattatatactgtattcttacaataaagtaagctatacaaaaaaattaagaaaatcataaggaaggaaagatatattgccatttattagctgtgtgggtgaagaaaagttacttaacttgactacgctcagtttattcattaaataatctttgcagacctggtaagcactggatgaaataatgtaataagacaaaaatgtgaagattttctccatagtcttatcactctgtatcataatttaatcatgtttctttacacggtttctcaattcctgagagaatgattttagacaaacccagagaactctctttgaatatcattctttgtttcaaatgtatttccttgtggcaggaaacgataaacacacatggcacagacagctagtgactgaaggggaagttaatggtgtttgtttttcctccagaattagtagttcagaaattaaaaataaaaatgtggcttgccaagtttgtaaactacacagaattctttgattacaagatgacaatgaatttaatttttttgacatttgtatttctttgatacttatgaattgaaatgttttgaaaacttatgaatttgcagctttacattttataaactataatgattaaaatatccaaatccattaatttcttccttgccctgtaaacttgaaaactgagaaaagatttagagtaaagcattttgaaatcattgacaagcacaaatactgttagattctatgtcaagattgtattgctgcccttgaggagacattatacgtgctttctaagctatgacgagaagacataaacaaggtctttccccagctatgtgctagaaaaaaacccttaattgtgattgtacagtattgcttgatgcaaaagtcaactcatttttcaccagggattcctgtccattcctggaaatgaggtaggatgaacccggccggggggcgggggggtgtcacagtagaaggtggtggtttaggaaaatctacaagtgacggtaaatactattctagaaagttaatttttttttatttcagggagcaaatcctttatatttggcaggtagaatgcaacttcttggtagtgtctttcatttaattaaaattaagattgatgtggcttgctgctgctgcgtaatatcattctgacttttgcatagctattgcatttgtaaatattcaaatgcactttgttatggataaaagggagttccttgggtagatgtttaacttttattgcaaaacctcttgtgctcacttacgttgccagatttggtagtagtcatgcaccctgggaaaatcactggcaaagcagtggagtggaaaggaatcatgggtatttactgtgaggagaagggaaggtaaaggtgttgtaggggttatatcatttcactcaggaatttgcttttggaaatgtcattaaggatatagtatttggggatggtaggtatttttagaatgtttctaagtaaaatcacgatttttcttttaatgcactgtgaagaaatcatctagtccagtgctcatgaaatcaatttagtaggttgcaattcaacaatggaatagaataggctaaaatacaacatgccagaatgcacacacgttgtaacatttagtgttaatttatgagactgcatgagttttatatagataagcatgtttctatatatatgtgcattgtatttaatatgtatttctcagtatgagtagctgttgaaaaagcttaaaagccactgattgactttttctcccattttacagatgaggaaactgaaagaggctgattctcattttatttgagtgggtctccttgaggcagcttatctgtcatcaggggtctcttgttataatctgtttaattacctatgcatcttttacaatttttcacccttgctcaaaaattgctatatttttgtgaccagaaattggatcaaagatgctgattctggggagataatctttgctgagtctctgagcaccatgttggatgggtagttggtgcttgtaataccaaggggaaaagaacagaatatttatagctctctgtagaggtaagatcttaggtaaagtcagatgaaaaggtggaacaataatctaatacatttcatcaatagatacaacaaatcaccattagcttctaccatttgtttcagttcagttcaacaaatatttattgagctcctacttagtatcaggtattttaaaagctagccacttacttccttctttatgataaattaattagtcaaacaattaaattattctctccctttgcttgtggtgtacagggagatttactgaagtaaaagggggtttcgtttgtcaaagatgaaagagatgtagcgccatgctatataacacaatatgctacttggaaatctgttatgccttatctagaaatgttcctaatatcttgaactccacctttcactcattaggaagtcctgcaatataaagctcacctataatattttctctatatttgctctcataacacattgatttatattgaactttctccttgttgctatttatacagtgtcagttctgctctatgagctgattttttttttctctgactacctgagaattgaggcagcagggccaagggggccgacttgccacgtgaggttttgtctttcccaccttgttaggctgcttctttgcctttctgcctggcaattcctgaaggtggtgttctgttttatctcttttttgtttttaaagtgtttgtgcaaagcatattattctgtttttactttgcttcttaattgagtatcggccatgtaacttattgtttgaagcagttacagcatcagggaatagtcccaaatggcacgatgagcctgatttttcctgatggctgtcactgtggaaagggacacccatgaggtcggtccaagccaaagaaaggagatgtataagtacagcctaatcttattagtgggtctagaaaaactgcttctttattaactgtcagtcttttaaatctttgctaattataacgattaaacatgatattttgtagtcatttctacttgcattcttgattattagtagttttgagcttttttacatatctctgtaggattttcttcccatgtttggaatttctgtttgtgtcctttggttatttttcttttagactattctgttttgttattgatttataagaccttttttctatcctattgaaattaatcattttcattgtggttaaattttatcattttaacatattttgagtgtgcactttagtggcattaagtacattcacaccatttgccaccctcaccgttgtcccatctccagaaatttcccgttatcccaaactgaaaaaaaccatggtaggtgctatgaaaataggcccaagggcctcttcgattcttaacaagagagatgctaaccccttttttcccacaacactagtaacacttcttgaatcatctaatcccctaattatttctctggatccagtgctgccatgatgattgcaacttcattttaaagatgtattcatacattaaataaacaggcaaacagctgttctcatatgaccatcttattgagcaaattctgttttgtttagtctttatagttcttccacttgttatttaatctactggtgtttgatgttttccttgcttgccaatgtggtatttccagctgtgcatggaaattaattttctatttgaatagacaattccaggaaattatctattaaggttataggaggcaaagagaatgttgctttatagttttgtgtgtgtgtgtgtgtgtgtgtggtgttcttggcattataaggaggaaaggttggtttaagagttcatgattgccagtttttgtttttaactaatattacttaaataaaacaaactctgccactggtcacaaacgctgtcaataataggaagtatggggaactgaaaacttattctctatctgaaacaacaattctaaatggattgctcatggactctgaaaccttttttggacaatagacctctttgtgtatctgacagattctgtggaacctcaaaacctaaggttcccatatttttatctaaaaccctagttgagatgcattttggagtcaagaatttatcagattttaaaaaggtagtatgatttaaaaaatgtattgggttttcaaaagtaccatatacccccatattacctatcacctttaatggggtctgggatggttccctataatcaaaaaatagtatttctgcagttaaattcatagatcttaatcttaaatgagataaataaaaacatgaaatagcctcacatctgtgtaggtcagtttatgctgccagataagttgaggtttgttgccaaacaatttctgaaaaatcttttgttctttaggatcagtgataagggacaaacacaatttcacctatactctagggggttccactgttcttggtcaggagtgttttggctccatgcttcagccgggcctgcttctcctcagccctactcaagtcatggacttagcattttcactgttacagacatttttgcttctggagttctgcacctgtcacttttttgatgaatttaatcctcttttttgcagccatatcgtatatgggctctcattctttatactcaatatgtttgccgttatgtataaatgtttcatcataacgtgaacacatatattatgttcatcatcatccctattcctttgtattggttaaaaaattggttattctcaatacttgaaatgccttttttctgtcttcctcctgttaatttatcctctaccccatcattgtaccaggataaccgattttctccttcttttatattctctatattcttttaaagctttgtgtctaccactgttttagcatgcattacattcctccataattatttgaatatttatccatctcttatataagactgcacatttcttgagagtaatacctctttatatatccattgccttgcacagtgcctggcacatacagattcaaagcttttcagcccaagataaatagaaggtgtacatttggagccagtggggtaagattggagacatgagaaagagggatgtacaatcttaataaattagagttcaagacagaatagtgtagaggaacagtgattttgtttagtttatgtgcacatgaggattaggaaattaaatgatatatatggtttggagaatggagaaatttcaaaaaggaggtaaagcttcagacaaacctgggcaaatggatgagattgggatggaataggcaaagaagaatgtacagtgctttcagagaagggagtatgttgaggagcgaattggcattggtggctgaacaagatatttaagctattgccaaactataatggaagttctgaattatgagatgatggaagaaaaaggtcagtaggccaaatggtgctggattatgtaaagcaatatataataagaaaaagaattcgatctattcagagtaaggtgtcattataagttaaggagtagaacagggatggtaagataaaaaacatttctgaaaataaatgtgtccacagcgtacgcagtgatgcctgaactaaaaagggtgtaggggtgtggggctgagttgttttacatcataaggacctgaaccgagaagacagtaatgagactggagaaaagggtgtgaaacttttgaaaagtaaaaccatagtgtgatagttaatttcttgtgtcaactggagtgggctacaggttgcccagatacttggtcaaacactacttagggtgatactgtgagggtgattttagatgaggctgacatttaaatcagtagactgagtagagcagattgccccctttaatggggatgggcctcatgcaattggttgaaggcctgagtagagcaaaaggctgaccccccttatgtaagagagaattctcttgcctgacagtctttaaactgggacattgaccattactggttctgcagtagccttctggcttctgactcaaaactgggaaatcagctctgcagcttttggacttgccagaccccttaatcatgtgagccaattccttataatcagtctccctttctttctctctttctctggagaaccctgactaatacgcgtagtatatggagactgactagatatgggagccacaggagttgagaaaggaattaacaattacttaggaatgggaatggagaaattgaaaagggcagtcaattttgatggaaaatatatttggttttgattttgttgactctgaagtgatattggagattcaagttaaattactgtaagcagctgtagtgaggtaggtagcttgtgtgggtgaggctggatgttgcatctttgaatcatctacaagtagggcaaaagaagttacgtgacagaacagagttcacaggtgaatgagagagacaagcataggcaaggatttgactgaggttcttcaggtgggaattatggggctagaggagaaagatgagccagtgtataaaaatattggtggcagagctctcttgacattggtttgtcagcctcttgcaccagaatgtaagctccatgaggccaacaatttactcagtcctttttccctagctttaagtgttgtacttcagatatttgagatttgtagacattgttttttcttcattttccacttgagacaaagccttttaaggaaaactgaaccaggaattaggatttatttgctgtaatcttgactttgcacttagatatagagactgaggtttgactttttaattcctaggattttgactcctttttcaaaaaatgaggagattggattaagaatttgtaggattccttacaactcaaaagttatggagaaaaatatctataggctgaaaattgttctaagctgcaaaaatggccttgagtaacttcagaaaataaacattaaagcaaatcatcttttatatcccttttttgaatgttttatttatttaatatcaatcaaaatactgtaatagattaaataaatcaaaacacatataatcttgtctagaagcagctttggactaaaaattttcttcgcaaaatattaaaggtgtgacttttaaagaaaatctcttaatacaggacctaaccccattttatatagcattaagttaatataactgtaaaaaagaaaaaaatataagcagcatttttcttttaatatcaacaccatagagaaattttggttcttatggaaattttattctattacaaatcttccaactgtaaaatcttctcttagagttgattatgtaattgaaaacaaagggaagaatcagtggctcaaatggtcctgtgtttaccatacttcattcaaaattctcttgcatctcctcatatgtttctagatatgttaacatcatacaatctcacaatatccatttttaatttatgcaagaatactttctgttttgaatagcacattattctaggttatatccaatgtcagttttgggtatttgatcaatatgtgatggttaaattatagatggctaactttttttcctaattgtacaatttgaaatatggtgaatttccaaaaaatagtttggagaaaatatgaactctattttaaaaatgtgcatgtatgttgatatcatgtatttgacatagaaactgtcaaacagaaatagatgtcataaactttaattcaaaggcattagactactagcactaacaaccaacattttttttttatcaaatagaacttattttgcccccaggatcatgcgttgttttagatattaattaacattataattgtcttctcactttctggtatgcaggggtactctccatgaccaatctttgtcatttatcacctatagtgtaaaatttccatcaggaaacaatcttctgccttgaactaccaaagtgctgattttgctttttgtcattaagttttttgtttgtttgtttgtttgttttaatttgctttagagcttctttattgaggacaactaacagttaagagttttcttggggaatagtgtcacagcaagaatcacacatagacttttcagatacaattcttctatctccaaagtaatgctagaaatattgttgatttacaatagatataatttaaaattatttatttttattttccacagatcccaatttctggatttcttgtgaagtttaataatttatccttggattcattttatttttgtttatatttatatagaaggcatttagccattcatgttgatcagctgacctcttagttccatttgtataatgtaatatctggttatataaacccaaggatctgctgttattgtttgctctgcaatctgatagataagagattaaaatagggtgggtgtagtggctcatgcctgtaatcctaatgctttggtaggccaaggcagaaggattgtttgaggccaggagtttgcgaccagcctgggcaacatagtgcgacctgtctttacaagacataaaaaaattagttgggcgtggtggcatgctgaagtcccaacactctgggaggctgaggcaggagggctgcttgaggtcatggtttcaagaccagcctggacaacatagtgaagtcatgtgtctaccaaaaaaaaaaaaaaaaaaaaaaaaaggctgtgcttagtgttgcacatctgtagtcctaccacgcaggaggctgagatgggagcgaggattgctggagcccaggaatttgaggctgcagtgagctatgatcacaccactgccctccagcttgggggacagagtaagaccttgtctctgaaacaaaaaacagagagagaaaaaaaataataagatgtatgtattcagaaacataaaaaagcaagagtaaaacttttgtgacaactttgttccatttataagtcacactaatgactgatttgcttcttagtaattttccatttgtaacattttgtacctggatacacaaatgtaatgcaattgaacaagaaaacaattatctgtctgctggaaataatgtacttatctcattgaaacaattgacttgtttaaaaatacacaggtctgttcagactgcagttacctgtaatttgtaatgaatttccaggaagaattaaaatcctctgatgtaattgaatcagtagttgaaaacactgattgtgaatgataaatttccatgcataattcccctcttatataaacctccatttggagccattttagatttgagaggttttttcaatattctatgagttttggctggatccctggaaaacttcactcaaaggctgtatcttccagtgaaagcttcatgttgacttgtgggttctgtgtcagtggaacgtttcagtactttttggcctggctcaaatgtttcttggcattttctgtggagtttggcccaaccaatctatagtatcacattggactccagataaaccctaaaagccgtaattcatccgcaagctaatatgggactttattggggtttggtagtagactaacaccatcgagcaattgggagttcaacattatgaatgatatttctaaggacatatctatctgaaaaatcatacaaagagaagctacttttcctttagcccagcacttatttttctcagaggtctctttcacagaggtcaatgtcctattttaattcgttattataattttttccctcctcagcagtttctaaacctattgcagatcaacagctttttcttctttcttaaagtgagatggctctggctcttggctgacttcagtcttgtgatgtgggactgatgtgcgttttcatttttcactttgaaggtgctgccaaagctagttaattttagttataccatcatagaatgctggagcctgtaggtgccctagaaatggtttggtacagcctcctcgttttacacataaggggagccaggcccagttccttagttctcacaggaagctacggcactgttaggatggaactcgtgtccgcctcgcaacagaacgggtctctgcaagtctatccggctgctgaaagatccactccccattcccagtctcagattttgtacctctgggtagttttcctcttttccttaaagctttttaaatgtagctccccatatgttatattaatttgggaaaccagccaacaaattagttttacatttgttaggattctagggtgttatttatgataccattctctttgtgttctgagtcactaagaaataaatataggaacaagacagagatcaaaataatagcttcattataaacagtgttaaattttagaacacatagtggacccaaggtggaagccagcttcttatgcctttaacagtcccctactgagcttagccactcagtcatagagaagtgtgcaactgcaggttcctggtccagccctcatctgcagggcccaccctcagggaggactagctgagcagcacctctgagagactccaggaaccaagggcctcctgccaagggaagggcctctttctcaagtctggccaagtagagcagtccatacccactcatggaaagcagtgtccttcaatggctcaccttctggtgagtgtttctctttccttcttttctcttgctttagcattcctgtttcacactggtattctgaaaccaatattagtatatttcttttccttgtaagatgagttattttcccattattctcctgaatagagttgaaaaagcaaaggtagcaaaatcagcctaggcaactgattatttacaatagagaaaaataaatgaagaattaagtagccggtaatgagagatggcaccatgggaacgtgctcagaatacttcccagtaatggaagatgaataatttttcctgttctctcctgaccaggccattgttctcacatttttaagaagagaaagttgggaaagacttttacctctctgtttacatctttgtttaagctctagacctctgccagcacccaccattgtattttgataaatatattctcagccatctataggtggattcacatgatcttgttttgctttcattttcctgtgattttgaattaagtaaaatttcagatcacagaactctcttggaaattttagttgattcatgtaggtaggtttctataggtttcactatttcattttgttccagatatttttccaatgtttatctctttttttaaatcttctacattagctttcaagatacttacttatgagagcccagataatatttaagttttcttcatattaagggatttttttttccttcagatttcttgccttgtggtgcatgttgcacagacacttgtacttaattcagaggtaaatgaaaagtaatttacaattctaatactcttgatactcatactttctcctttactgtttttatgcttgcaggtttcacttccttttagtaggttgagggccatttagataaaaaagatacagaattgcagactagtagatttaagagtttatgtattatgatttaagttgttaagatttaaggtgttccagtagcatacttggagttgaaatcatgattattaagatgaattctttttgcgtgagcagcttaacagacttctcttgaatcaccataatgtttttgcttcatgggcatgtcaagtatctgttatagtggaacctgagagaggtcatacaggaaatagcatagaagttgtcacagtacacctggaatgatgctcaagtggttgccatgggctcaggagccatttgcctgggttgaaactcagctcttcattcctttgtttcagtttgctcatctgcacaatgggcatactaattaagatatctacctcgaaagttcttgtgaggattaaatggatgaatatatgtaaagcagtttaaacgagtgtctgaacattatatatgctttataaatgtgagctgttaaaacagtccccacgtgcctaattgggtgaatagatcagggttcctctgtgttttcaagtgtttctctcagtacactattatttaggaaaaatagactaaaaagatattgtctgaggtgttactggctgatattttaaaaggtgaaccatgcattaaaagattgtgagtctaaattttgtgtaatttaatattaataaataacctgacttctttgatggtctacgtgaaatatgaggatttcaggcactttgtttccacagccaaaccgtgtatgttgtcttcattactggcaccgattttggcattttgatttttaaattattttgtgcagttttcacagttgctcccattagaggggaagtattgaggaagtagtcttccagttattgacagatcttaagaagcataaaatggtttggtattttggagaaatgtaggataatataagacccagaggcatactattccaagtagaaaatttcatcatataatgcatttatatgtatgtggtatatgtgggtaggcaaattccatcatgaaaggaataatgaaggaacagttttggggcaacctaaagttttactttagtttgtataataattaactcagctgcataaatgccaggaaaataattagaacaacagattatgttgaatgcctaaaaaaatgtgtttaacaacttttaattttctttcctcccacacaccacttcctagtttgtttctggcacaccagttgtgtctcaacacagcggctgatctggtagagttgtgtgaacacctgtgattgtggcagaacaaattttctccttctggttacatttatcgaaagtaaaagtagaaggagcactgtattttggaggtaatgtagagatataggggatagcctaccttttctccaaagctatgtatgagctttcaatgttttgaaagctcatgcatactgaagcgtgtgtccacatggtgaatgtaaacaaacaaaagctgattgtaaccatcttgcttttcctagttagatatcaatgggctactattggtcagagaaacaaagagggacctccattagtggggaaaggtaaaaaaaatttagtgacagtgaaagttttaaaaataatatatattttttctgtttaagatattccattatatttatgacgttatgagattccttcaggagtggttgtttgataatctgtagtttacttaatcattcctatggtgttacagacagatttataaagttttgctattacaaattatggcaccacaaatacctatttgaatctgccttttttttttttttttttggaattatttactcagtttaaaatttctggcctgatgttattaggttaaaggctttgcatatctttgtaagtcaaaggatgtagattttaacaaatggcttttcaagtgctttgccaaattgctttctaatataaatatataaattgttaacaataatgtatgggtttttcagtttcactttttgagaccctgaacagtgatcgttgttgcttttttaaaataattttttgtatttattcaataaatataaagtggaacttcagtgttgtttcagtttgcattgctttggtaaataaaatgcgtgtgtgttctttttttcttcatgtgtctttaataatttaatttcctgttgtgcatgttcatgtttttgaggtatttttcttcttgattttctgtttttctgtcagattgtttatcccctgtatgtaacatacaaatcaacattttatcttatgtttgataaacatatttctgcaatatgttgtttttttattttaccatgactattacttttcttagtgttaaagctcaaactgttgtaaaagttatattattttgtttcttttattgactctaggtttaaaaagttgtcatctttcaaaaaaatattcaattctattttatgctaatgtttagtgaactaatttatatgtgtgtgtgtgtgtttataaacccacggatacatatatgcacaaatacacatagggagttagagacattagtattataatgatagtatatggcatacattttgatccatttttttcctcaaattactagccagttatgtcagcctcattgattacatagctttctgtcttctcctccccagttgttttaaatttcccctttatcatattattacattctaacatataattagatattttactgggctttatttttttattcactgatctatttcaaattagatataaaaatatttttaaaatttaattcttcaaattattaatgcttgataatatgctttaaatgtagtaggttcaggtcttcttttccaaaaacattgagcttctcctgtgttacaaactgtgaatatggaaattaaaattatacggtttccccactcatagtaatcaaagtcttgctggaaaaacagacatgtaaaaatgtaattatactataatgctacaaatccagaatggagagatgaacaaagcactgatagcaccgaggtgacagtatatttttacctttttcccctatattttctagttctaatgaaagtttgattatgatctaaattgctaatttattatatctacaaaataacttagaaaaatttgattttttaaaatcctataatcttctccctcagggttattgtctgtttcatctttttaattttctaattaaattctgtagttttccttaatgttaaatactggttagaaacatttcatgttaaacatacgcatcttatggatattatttgtgacagtctacaggtaattcagtgtttgatttatttctttaaagaagcctatattttgggtttaccattcacagggaaaatcggagcccatacttttttatctttctttattgagtgtggggtctcaaacattcattggtaatacctttgggatttggtaagaaatactgcacacagatacaatgtagaaatttcattgagatttttttaatagtaacttttaatagttaaaattttgaatagttgcttttgaaatgaatgataggccaatgaaaaatttgtgtgccatgaaagctatatttttatgaaaacctgattggaattatggaaaacaatctgtgttttatagtcatggaaacctgtgactgatgatcatttttggaatgttaattgtaatttctatcattgcagctgttaattggtaacaaggaggggattaaaggcattaaggagttttggaaaataaaacttaaacacacatcaaatagcaatcatttctggaattctgctcatattagttgtataaacctgactattaaaatatagaataaagtttatttcattattccagtttctaaactgtatattatttaaaaatatgtttgtatttacaaattaggtcaggagtaagcagggcctcagtgacgtaaataaatcccaatggaggcttgtctttggactttctcttttgtgtaattctttgtatatacaagatccttggccaagatcccattatacaaaagaaaaggtggggatgtgggggagggtgaatattcccagagaaattcagcctttcaattacttgattattcttgtggttgcaggaaattaaagaataataagtttgtttcctatgtgaatcataaaaaaataataagggtacacacagggccattgacttaaataaatggatggaccttaaaaaattcactttttggaggggtgcatcatgctttttgaggacacactgaaattttgttggtaatcccagttccaagcctttcaagttagtttaagtgtaggaagaggagtggcagcaactggataataaatttagtacaaatgtttattttatttcatttatgtattgcctcattcaaaaaatgattcgagatatcttttcttttttttttttttttgtcttttgaggcaggttctcacttggttgcccaggctggagtgcaatggtgccatattggctcacagcaacccctgcctcctaggttcaagtgattctccagccccagcctcccaagtagcttgggaattgtttttgtttgtttgtttggtttgtttttgtttttgtttttgtttgagatgagtttttgccatgttgcccagggtggtctcgaactcctgaactcaaagcaatctgcctgccttggcctcccagtgtgctgggattacaggcatgagccactgcaactggccctgatttgaaatatcttataagaacatgttcaacttaataataataaaatgtgtatagaagaaaaggtgcattatctggaaaagtataaataagaagaaagtcctaactggaaacaagaaaataaatattttaggatccatgcaattttgttttgattcattatttttatttatttatttttaataaagataggttctcactctatcatccaggatggagtgtagtggtgcaatcgtagctcacagcagccttgaactcctgggctcaagctgtcctctcacctcatctgcccaaggagtcttttttttttttttttttgatttgagctttctagcagccaaaacaaaaagagtgctgtggcataaaaggatagatatagatgccatgtcttttgccacacacgtgtgcatgcatacacacacacacacttacatactgtctctcataattatttatttattattagatttatttatttattcatttatttttgagaaggagttttgctcttgttgcccaggctggagtgcaatggcgcgatctcggctcaccacaacctccgcctcccgggttcaagcaattctcctgtctcagccttctgagtagctggggttacaggcatgagccaccacgcccggctaattttgtatttttggtagagatggggtttctccatgttggtcaggctggtcttgaactcccgatctcaggtgatctgcctgcctcggcctccgaaagtgctgggattacaggtgtgagccactgtgctcggcctatttatgttatttttaaaaagcaaattgctttcatgttccttaggagtggcacagctatgtggatctctaatttctaaaataaatttctcatacgtatgcttagtagtactttcgtttcaaagaactagcttacctgtgggtgatttcagaccaacctgttcagttcttctgtttgagagacaaattcaaatgcttatagttacccagatgaccacctttcacattttctatctcatcctagctaccacttctcccttaacatcacctgcaacaaacaaaatgactcccctaatctgaagccaattttaatttatgggatggacctagtcatttgtatccaaaatgtctgagagtatcttttttttttttttttttgagacagggtctctctttgtcatccaggctggagtacagtggcatgaacaaggctcaggcagcctccaactaactcctgggctcaagtgattctactacctcaggctccttagtagctaggactacaggttcgcaccaccacacctgactaatttttatattttttgtagagactggctttcgccatgttggccaggctggtctccaactcttggactcaagcaatccacctgcctctgcctccaaaagtgttgtgattacaggcctgagccactgcacccggcctgtaatatattttaaattgtaaacaaagttatcattgataagatatagaaaaaaatttaaaaaaaaattttatctagctgtcaatgagaaggaaagcaagctaaataatgaaaattaaattagcatgaggaaaatgaaaaataaagagagactggaagataccacataattatgtggctcataagtctaagagttttgaaataataattgagtcaggaaaagacttctgccttactcatatgtgcattttttgcatttaatattttattatatacaacttaattgtcccttagttaagtcctaatccactgaataaacaaaagtaattagtcaacataccttgcttagcagctttacctttttcaaattttattttgtttatttattatgtcatttccaaattcctgtgggccttttggtctgtaatctccataaaccactgtaggcatagacattttaatggaaagggctagtgacttttctggttttgtgaccttttacattctgattcaacaaaactttattggtcacccgcttatataacagtcactatgccaagagatttttcataccttatcacatattactttccataataaacccatgaggtaaatactttatggtccccatttaatataggacactgctaataagcctcagggagaaatgagcccagatcacattgctagtaagtgctaaattttggctcaaacccatcttgacgcttgaagccagtgttctttctatagccatatctcttgctaagtacttctgacttttacttaagatatagtcttctctttgattattaattactctggtgtgaactgtgatcttttatgaaatctaagactgctactattatccgggcaaaattgtggaattgaatcattgagatgctgattgaattgttgttgatggttcaacaattttgagatgagacagatcaaattttcctttattgaaatcagagtggttggagcttaataaaaaagcagaacatcttaaggtaaaagagcaggtacttttttctttttttttttgagacagagtctcactctgttgcccaggctggagtgcagtggtgtgatcttggctcactgtaagctccgcctcccagtttcacgccattctcctccctcagccttcagagtagctgggactacgggcgcccgccaccacgcctggctaattttttgtatttttagtagagatggggtttcaccatgttagccaggatggtctcgatctcctgacctcgtgatccgccctccttggcttcccaaagtgttgggattacaggcgtgagccaccgcgcccggccaagagaaggtacttttttttttttttaacactgacattagttctctttttgactgctaaggataactacaaatgatacattctgtaaaccttttgtctgaaataataaagaaagtgaagcacagtaggaattctttaaaatgttgtcttgttcattgggcatttattgggtacctagtataatccagatattctgtggtgttctgtgatacaaccttaaataagacaagacatagatctggctctcaaaatatttatagtctaagggggaaactttgaatttataattagattgttaattttcaaaaattaaaattcaataagttgcttattagcgtcatcggctttggaaatttaacacttttctaatgaagaacataagttccagttaagagggtttcctatttcagacaatgtagaataaatcagcttgttccataacttttaatatttttcaaatataactcgcattttacctttagaactaaagatatgtcgagaagagttcattataatgtaattgagtcacttaccaagcctattttaaaaccagttacttccttttcttactttgcactctgtgacacatagacttccagaatcagagaagtattgtttttgtttttaggcacttgctatattatgtggaaccaaagccaagttaatatggctaagtaattttcagttcaaggtaggatattagatagaaattctcttttctacttctagatttggacatgaagtagcttttcatgttataaaatgacaaattttatttatttgtaatgaaataatcccttttatttatagccaagttcatcattttaacacttaatcttccatgacagtccggaggagaagaaacttggcaaccattcattattatctgtttttatcatcagaaggtatttatttgtagggggagtgtagaaatgatgtcaagggtaggacatttttgtacaggacggcctttcctttggagtcatgatggtaaatatgaccacagttacttaaaatgcatgcaaatagttaccagtcaagatgtataaagttccctggaaactcagaagcatgtgattatagctgtggaatgagaatgcctaataataaaaggagaaaatgtcagttttggattagtgatttaggaatcccatcagtgactatctaatcagcagcatttcacccgttgttttacaaagctcttattgagctgtgcttccatacctttgggcttgtatgaagatctgctcatcatagaagcccacttacctatagtttcaacatgacaaatctgagcttaaacacaaattagaatatttaggccctgaggctatttcttggatttaaatatagcacatagtaggtgaactttgagcttgataatgctgtggtacagtgagagaaggccagtgtcaaggatatctgaattgatttgaccttttgtccttgcatgtgaaaatgacgtgcttctgtagaagtctatatactcatgacttccttctaaaatgattattgtacagtattctatggacatttgatttgattcttctcacaaaattatcgagacatccactagtgtctacttaattgatggcaaacaagaagaaaactgtaatctggagataactaggtaaaccacatattctacatctgtgcctggatagaatgacttttgtggttatgtatgcagcaaacacttttgagtgctggtcatttccctaagctctgagaatgcaaaagtgtgccgtgtccattgtgattattgtggtgaatacagagtgttgtgagagtaaataatgtggagggagtgagaaaagcctcctgtgaggacatttagctgagaaggaagggtaaggaggagacttaagagggcgtcagaagttctggagggaaggggagagtgggagtttgagggacaaatggccgtcatggtggagtgaacgaaggggaaagtcacctgggattaaggataaagagaattcttgagtaactaaaaaattgatttgttcacgttgctcagtgattctctgactgtgtttctttggggagaggcttataaaaattagaatgtccaagtcttcatagctatctaaatgttttctgcatgtttctgtccagcacctatgtctgacttcatcccaatttgatgattaggatgatgataaacaggatgatgaataatacaactatggagatttaaattagaagaaaaaatcttctttatctttttttattgtaagatttattaatacaaatctgtattgttattcagttctagaatgttctaatatgcttcttccatccaaagttatgattacttctttacctcatataatattattacattttcttacaataaaatacatttttaaaattcactattaaccctgtctgtgatgagacagcataatcttgtggttaatattagctcaggctctgtagccagaaaatacgggtgtgaattcttgttgcgtcatcaaagatacagatgtgagtcctggctgtatcattcactgactgtttacatttaatatgttatttagccttcaaaacctttgtttactcatctgtaaaatgggataataattgtaccagcctcctaggataggtaagatgttgcagtgaagtttcttgttacgatgtatttccttgattatttcataagacagaggaggcatcttttctgtgttcctcccttgagatactaaaatggccagggagcaggtaagttccaaagattaggtttcagactgtcatatacaacttgtagtccatctgtgcagctggagactaaaccaaagtgtcacataaaccttttcctaatcaaagtggttgttcatttattaatgtaaatgccctgtgccttggatgtgtgagtcctaaaaatacacttccagggataaaaatagatttctgggagttctgagatgctgcttaatcagaaccagctgcaagctgtctagaaaacgcaagttatatgagccagatggcttttgccctttttgctttagacagcatgtaatttggataactacagctacagtaatacattttgccagtcacagtgtttgataaacatgtttgttgagaacagccacttccaattagagacccagtaaaatgttaatttattttaataaattttccctctagggcaagacaaagaatacttttgacaggttacagaaatatctgttcatggaacagagtactgttcaaaagttattgtatgccagtgattaatttttcaatttggcatttagagaatgatgagcagtattcatgacctccccctccatttttctccttacaacctcatgtatatataagagaccaggatttttcatatttgaaattatgttgctttacgtgtagaaagatggtttagctaatttttaactttcttctacccatgtctaattactataaactctgataatagttactgaattattgcttgcttacagatgcttattaatgtggtagttcttgggatttttcttttatgatcgtattctttgagaagaaattttctctgttagtcttatgtagccatgactgattttcatcagctgaggactgcaaacgtagtcactgatattggctgaattctaattttattcagctcctattcagacaaaatagtaaagctaaatgtgtaagctattcacactgtaagacctaaactcagatacagcctacttttaggagatgtgaaactatcaattcttccattttcactggtggcaccacttcttggaaaagcgtatttaagccctggtttcccattacaggaattgaaatattctgtgctttatttcttgagacatgtctaccaggcatcatgtaacagactgtgaagtacctttgaaggatctcttgagtcataatttttccataattccagtccttccagctttgtaagtttagtaatcacccagcagttgtttttttccttccccagtttaagaggagagggtatttcatttccaggataagtgatattagaacataaacatcattataatagtagctacaggtttatttactcttaccaggaactatgctaatcactttatacattattgcatttaagcctcactacaacatagtattataaggtatatatttttattctgttttgcagataaggatgtcactattaatataacatttttatattaatagagtataattgttctagaattatcactagaatgatgattattcaacatcatacagaaagtattacagccagaatttgaagctactcttgtattaatggtgtgtctggctcaggatctttaattccacccattaagctatgaaaattggcatttgacctaactagggctgctttttcagaggtaaatgcatgcctctggccatcttcatatacttcaaggaatttacagtattgcttcttagcatttattttaagctcagattgtatgtgaaagagtctgatctctctcatcccaccttgttagatgaattataactgatgtgctttaaaaataattcatactgctggggaaaaaatctcactttgatgcttttccagtatatagttaagaattacactgatgggtagtaattgaagaaattggtaagcacttgtgtgatatgaaacagcataggaaacttatatataatatatgatagccattatatataagcttatatataatgtgtataacatttacaaaagcaaaataatacctttatgtttttatttaacaaagtgagataaattcattagtgaatgcagcagggcatacctgcaaattctgtcataggtagcaggaaataaagcaaagcattgtttataaaaagacctctttgttatggttctgtccactcaaagcaaactgatgggggcatggaaaagatcttattacttttgactattttggaagagcatactgttggtattattttcatttgcagctataaaatggtacttcttgaaagataccataaaataatagaacagtttatacttaagtactatggtatgataatgggcttatgctgtttgttagcaaagagttggtgttatttgttgtttcttggaaatgaaagggagaaacagataatattcctttctaataaatggattattctattctaccctattctattagacaattttatatccaaacaattactgaactctatttttcatatttcacagagttgtacgcaagatctagatttgaatatgaaatctgatacctccgtgggccagtcgaaaaaagcattttgatatcattagatgagagacattatagacatattagttctagagaaagtcccggtcctttctttatgtcaagagatttgtgttagaaagagccaacaaggcctatgcactcaattaatatacatcagttttctgttagcatgtaaggtcctatagttggtgttcaagaaaagaacatgatacatgaaaagtgatctttgccaaatgtatccatgtttatgctaatgtgggtaaattgttcctcttttaccatgtgaaggattggtagcttaatagtttgctttgcttaaatgattttatgtggcagtgttgaggatctgcagaagtgactgtgtccttgccctcaaagaacttttggcatttggcaccaaaagggggcactgctctcttgtgacataaaatgtagtccccgaatagtggggcttttgaaggttagtgactccaaaggaaatagtagatgaaaggaaaacgtatttacttcatctcatgggggtctttcttgccttggtcttcctgaagaaaagataagcattgggctgaaaatgtttgttatatacccttgggcaccattggcatattccaagctgtttttgtcaatcatataaatacatatttagacaatttctgaaacatttctcataaagaaagaagtcattcatctggtatatcatattcatatgcatgatggctttctagagttgtgtcatttcttcactatggcttctctcgtctcgcacctcttcagaaggcacccttcctttcttttttcagtaaataccacaattttatttttaggtgtatgcagcatgaaatgtatgtgtgtatgtgtgtgcctgcgtgtctgtgtgtgtgtgtgtgtgtgtgtgagagagagagagagagagacagagagagtttgagagatagaacagagagattgattaattggttgattgattagttggttagttggagcttttcccagaaagttttccaactgttcttattggcatatttgaaagtttaacaaaatctcattaaagttcatggatttcactgaaatctcttatttttattagataatcagtaatattataagtatacataatctgccatcccaatattttcaaattttagttctttttctatcgtattggtaagaatgttacagtttcttcctaatgttggtgataggcatctgtacatctggttttgttggaaacaactctgctaaatgtttaataaggtgctcattgtaagttaaagatagggaatctttattatattatagaactaccctggcctatgcacatgtattgagatgactgcatgttatttagcatgcagggataggttctgttttaacatattttgacctattgatgtcgtaacttcattagtagattacctagtattaaaccattctgggatttctgatgtaaacacaattggacatgttttattattatttaatatgctgttgggtttggaatgtatttcatctagcatttttgcctctatatttgtgatactgaatgatagttttctgttttgtcagctggttttcaggttttagtgtcagggttactaggcccatcacttatgattatacaagttgtacactgccacctataatattgtcatttgcatagttattatgacagttttacaaaggaggacagtaaagtatcttgaggaagggacttttttttaaaaccgtattgacttaccatatcaactagcagaatgtaacattctaaaacagatttttaaaaaattccatatttttccattccttcaatgtttaaaagaatccacgcaaaaaatcagtcaggtttatttgacaatagttgtttacttaaatttcttctagaactgttcatctctttagggtttatatattctactcagctgggatgatcttttaattttattgaactattaaaattcattctttaacaaccaactatacataatattctttataattcttttattcttttctgtgtttttcatcccccttttgttactttactattttatctttttcttgaatattaagatttgccttttgttttcctcttttttccttctccaaatacttttggctttatttactggaatgtaatattttagtatttgaaattaacaactgtttttatctttattattttttcctcttgctttccttagatatagtttgttcacttttttaaaaggtatttgcattgaatatttagctttcttattttctcttattttttattttcaaaggacctttttgggtacttttaaagtttgctaatttactgtaactggaacatttaatatggagttgaaccaactaacataggtgtgctatccatgtgagaatccttcggaaacatttagcttgacaaattgaaacactggaattaatcttaaaaatctgtattaggattgcattgacaatgtctagtgttttaaaatggcagtttattctctgattttaaaagcagtacaagttatccgtggatatttggaaaatatagagaaacatgcttagctatgtaacaattaccctaaaatttaacaacttaaaatgacaaacattaattttctcacacagtttctgagggtcagaaatctgggagaggtttaactgggccatttttgctgtgtctctcctaaagtagtagtcaggctgtgggctggagctgctgttatctgaaggcttgaatggggctggaggacccatttcaaaaatgattcactcacatggctattgactggaggccttagttcctcactggctattggcaaaagatgttggtttttttgccatgtgggccacttcttgctgcagagtgagtgatccaagacagagtaaagtggaagctacaatgtcttttatgaactactttcagaagttacatactggctgggtgcagtgacttgtgcctataattctagcagtttgggaggctgaggtgggcggatcacttgaggccaggagtttgaggccagcctggccaacttggtaaaactccgtctctactaaaaatacaaaaattagccaggcatggtggtacacgcctgtaatcccagttactcagaaggctgaggcataagaaccacttgaacctgggagatggagattgtagtgagctgagatcacatcactgcactccagcctgggagacagggagagactctgtctcaaaataaataaataaataaataaatttaaaaagaagtgacatactgttccttctactgtattccattgaccctactaaccaaccgttatacagtgtgggggataatgacacaagggagtaaatgccagaaggtgcggatcattgggccatcttgaaagctatccaccacacacagaaggacatagaagttacgcttaggtccaccattcagtccctgtggatcttccaggtttttgttttcccttccattgcagcagaccataaacatttcttatattatgaaatagtgttctaaaatgagatttttatatgtttgcttagtatccatttttagggcatgccaatttattttaccagtttcttaacattattttataattgggttgttttgagcatttgactattataaattataatatttcttgtctacaaatccttgagcacatctcctgccatttacctaaaatagattcctagaaatgttactcctgggtcaaggcatgtaaacattttaaggctttttacacataatgtcaaaatattctgcagaaatttgtacccaaatttatactagtattgccataacaaaatgatgcctaacttcttatgtgcttttcaatactaggtacaatattttaaaaatataaagagcctgataaggaatatagtatctcatggcagtttgaattttttattactaataaggtaggggaattattttaagagtcttattcttgaatctatgtagtatttttcttcttgatttttaaaggtatctttatcataattacttttaaagttgtaattagttctctttaaaaaaattatagtttgctttctttcaaaatttatttcactggatgttttcattaaggctatacaatgggagtggttctgtaatgaacctggaagtgttgaaaaataattgaataacttaagcactttcaaaataccaattagtttgttggtgactaaactaagtttctctaacttacattttattgattgaacatttgctagaataatgagttaaaaagtgagaagatgcttttttttttacttttgttgtaagccatctgccaaaatttggtgagtgctgaggaacatttgtcaaggaataaaatcataattgagagttgtctagtctgaaaaaataataaaaacactctcagtgtttccatgtgatagaatgagaatgactgttattacttcgaaagtttcctgcccaggactttcatataactgatgttctctgtgttgtacaaaaaagaaaataaataatagcttgctgaacagttttctggatttccaaaaaactttattttggtttttgatattttcataataattggttttaaatttgaaagttgttaagtaagtttaacagtgagagtggatagaatatgttgtctggcaaggcaggagcagagtgtagcagggagaccttggaataaggcgcttattttatagtcaactctgtttcctgccttgtggctttggtcctttcagcctgttttctcacctatacaaaaggaatacattttgccagatttgccagattattttcaaaactaagttatataatgtacacatagtgcctggcacacacaagtgcatgatacatgtataaagcaacaggaataactatggaaatgtgtactattcttaacataagtagttggaaggggagatcttcacaagaccataacaaaatgaaaaattcagtgatttgtaggtgaacattaaatttatgctataattctgaccaagagtgtatgtgatgggagggaggggaacaaatatttattttttgcaccagtgaagagttttgcaattatcgcattgctataaaagtttgctgaaagattaaaaatagaataatattagccatgactattcagaactgaagaccgtgccaaacaaagcaagcaatagactagcagtatgaactttgaaacccatagatgtgatgaattctgtggaaccagctcttaagtgtatagatacatagatgttcatgatttcactgggggaggctgatgatcataggtcttgaactggaattgaagaatgggttggtttgtacaagagtaagagagaaggagtgtcataagcccaggaatagtatggacacctacacagagacagataaccatgtagtgttttgctgtgaataaattgacctaacctagagaatctgtgtttgggatgcagtatggataggaatggtctgatcagaatactgagaaccttaattgtcaggcaaaagagatgaagcaaactgtagaccatcagttgaaaggttttagagactttaatgtagcagtgatgcagggtctctgtcgtagctcagatgtgggatgcactcttaaagtgagctcagtaagtcaggaagaaagcaatcagattccaaacactggaaccataatttctcacttatttcctactcaagaagcttttagtaatgttatcttgttctcttatgaatatgttgttttaaaaagaagaaattaaaatgtgacatagctgttgctttcctttggttgacctcacttttactttttattttaacactttatttttcaagaaaacacatactttgaaaaatcgtataattataattccacagtgacaatttctataatattttgcatttctattcctttttttttttttgtgacggagtttcactctttttgcccaggctggagtacagtggtgcaatctgggcttactgcaacctcctccgcctcccaggttcaagcgattctcctgcctcaacctccagagtagccgagattacaggggcccgccgccatgcctggctaattgtgtatttttagtagagatggggttttaccatgttgtccaggctggtctcgaactcctgacctcaggtgatccgcccacctcagcctcgcaaagtgctgggattacaggcacgagcccaattgtattcctttcttggaggtgtttcctatgacttatcctggctacagacctgctggaaagggagtagcatttatgaaactcctacattgtattatgcatgttagtctcagcatcccatttagtctttacagtatccttataaagcagatgatgttattcctattttacagatgtgtacactgagcttccagaaaattagatgactggtaagtgttagttcagaatgctctgctttgtaacatgatgcttcctgagagaatctggggaatgcacaacttttggcaggagaaataaggactaaactaagaacagcaatgttaattttttttttatgccttagagatagggaagttagtctccctcagaggaatccaacttgattttttctgagggatataatatctagtcacagggctgttcctttgcttcctgaggaagtgaaattcactaaattgggtagtgaccttccatatttaaagatacagttacagcttgctttagtaaaaatgttaacaaccttggaaaatgcaaaatatctgatctcaagaagattctgatacccttcattaatgaaaaaagaatgtcttgtttcctttctactataatgatcatgaattttccatgtcactctagttcctgaaagaagtgaattagtttgctagtagtgggtcaaaggtaactttctccttttaaaaactatgatgaaaggtgcgaggtttagatagtatggggaacttctgagtttctaaattataaaacacattttgaaatttgaattatgtgctgcttaatctggttcataattcttggtttcaaatactaatggaaatgttacttgcaagttaaaccctgaactgagaaacatgcttttctttattcttttataagtggctcttttaattgtagttcttttaaaaaggaagttaacacttaagtatctattaattcttgacaaggaccttattaaacctaagcaacgtgttttcaaaagggcaggtagctgttagctttatgtgagaaactaaaactaggaaagtaattattatgagcttcttaatcttttattttttccaaaatagaaatgtccctattttttcttattataaaaggaattgttaaatgtttaaaagtattgaaacagtactggacagtatacattaaaaagtgaatgtttcccataatcttaccccctacagatgaccactgattacagtttaacacatgtttttccagaacttgttatttgcaaatgtaaacctctattgctgtctacatatttaaaacattttaaatgggattgattgtactacatgtactattctttattttgctttttcttattgaaaattgttgttgatctatttccccttcagtaatgacagttctgtttcttagattgttggtttgttttgctattttaataacagtatgaagaaatacctcttttgtatgtttttgcacacttctctatttccctaggctaagttcttacaaatagaactgttaagggaaaggtaatgcatattttaaacttcaatatatgttcataaactgctctctaaaaggttttgccaatttactctcttgtcagtattgcaggagaaagtcctttttgactaactcttttacaataatatgaataacagtttttgccagtcaggtgagaaaaaagaaatgtatttctttgattattagtgtagttgagaagaatgtcatatgtttgtgggcctttatgtttctctcgggaacagattgttcatgacatgtaccttgtttttcttaagggtgtttgttttttctagtaatttaaagagcttttaatatagcctttgatacgtatgttgtaaatatttacatacgtctttttcttttacctcttatgatgatatttgttgcacaaaatacctaaaagttgacatatttacacacatcccattcttttttgcttatggtttctggcttttgtttgcatgctaagagtaaaaaccccggtcaattttttttttttttttggatgccaaggcactttatgtgcatgttcttattgaaacctcccagcaacccaatgaacagaatactttagcttcccttttatagatggtgggtaatcacttatccaaggctacaccgttttaaatgatagtgccataacacaaatacaggcagtcagatatctccctaggcccaagattattaatacaaacaaacaagaaaatctcctgtattgtagccactgtgttttctttttttaattgttaaatatttaattcctgtggggttcacctgtttaatttcattttcattttatactgtttatttatatatgcacatgtgtctacatgtttcctatatactcttattataataatcatcatttctttgtcagtaaaacattctttattctgattttagagtaatttttatatctaagggaaagtctccctctttattttgtctttaaaacttctctcgactattcacacatatcttttcttccagaatcaacatgtaaaatttaatgtacaaattctccttttaaaatagtctgtaattgcactaattgtaattgcacaattatcgtcattacaatatttatctttctattcaggaaaatagtatgtcttttaattaacttttttagtaaagctgaatagttaacttcatttagatttggggcatgctattgtaggtatattcctgggttaaattttgattgtgctcattattgttcacatgtacgtatgactgcataccattttgacagtgggtacatgttaaatcattactgtttatgaagtcagtgtccatttttatgaatattatgctagttcatgtcctctttttagacattcagtgttagagagtgaggaataattttaatgtcttgatggccaagactctacttaaccagctgttggtgactgaaagtccagtttcctttagatatgactcatagttcttggttggttcaaattctggatatcaatttaaaattgtatttaaaaccatagtggtccttaggggcccagaattcttcaaaattgaactgaaagtcacatagcaacatggaaataggcaggaagtcacatttaaattcttagcacaaattaacctccgcaaacaggtttgttccctgccctgccacccagcgtgggtgcttgtgtcacagtaggttctgggaagggttcagtattctcttgagattgggaggcacagaaacatcacacacattcacatggaggctctttcctaatccctccattactgctccctgtctcccataaccaagagaaaggaggcctttctttacaaagcgtgaccaaagattgtagaattcgaagttgaatggagagtgtataagaaattgaattcctaaaagaaatatgaggatgtaaagtaattacaataatcaaagaaggtcagagggaggagaaaggataataaagaggaggtaaataagaacatgaagaacattgaaccttccctttgtccccccaaaaaaagctgcagaggaagttggaggatatagaggatggatgaaaggggcaagacagtagaaaaatgcagcaaagtaaagatgatggaagtttagtaaaatggactgatacttacaggcatagttggcttaaaaaaaaaccctcactgatcctttcctttaaactgctcagtagctaaataaagaacttgttgatttctctctctttagcaggctctttcagtagtacattttgaagatttcttcatagaacattaggatattttactacctgactgaaagtggataaacagaactggaagatttctgctttgcacatttctgaagctttattttatccttatataggtaaagagagaagttatacactgagtatgccaaaatgaccacatgcttcacacttgcactacctctttttatgaatctaaatttggagttttcaaaacctcctgtttaaaaatacatcccaaaagacttctgcttattgcacattttgttcctgtcctgtacaactgagattttcatttataattctttttggaatgtttttctttttgtcataaatacaaaaggaagctattgacatataatccttcattatgttttatgcagtagcatcataattctcaaattttgagaatatatattttttctttcaagtctagagacaaatcttacaagaaagtttaattatgtgttcatgcatatacatggaatcttaaatataattgaatgaataaaaattaagttgccacaaattagtttatgcaggcatctttcacttaaaagatagtttggaggagaaaaaattcactgacaggtttttctattatatgatttatattttcctgttggatttcatgataaagttacagtttcattttatcaaagggaaaacttgttccttgatttttaaataggaagtcatattcagagatacattagtccttttaaaataacatatttaaacataaaatagtaatcttataaaatttattaagtcatacttagagtattaactgttttctgttatgctcaataaaaattataaattaaaaatgagggtaccagaaactcttaaaatataataatctatctctcctaattttactcataatataattcattaacccattattccatcttccaaaatgctaacttgcctctttccagctatcttgaaatgtacttaactgtaacatatctatactttaatgtatgtcactgaataagataaatttagagtatgtgaagtttaaggctgaatgttttgtggaattgttctttaaactaacccaaaataccacctttagactgctatagctgatactggagcatgtttcttgtctcaaggagcaaataatctttctaatattaaaccccagaatcagagagatgtacccatccagttttgggagtggtggacaactgcaggctcccctgcagggaaaagacttggcccctgtgagacatacagcacctggaggttgagcacatgctccctgtaggtgagctaactcccaggaaaaaaaaaagggatagaagaggcagactatacattgccctttttaaatctaccaggtcagtcactcctcctggaagaataagtgtcacgctagtagtgctccttccataaaaaaaactaaaggagtggggaagaatcattccctcccatagcaataatgatgtgtgtaagacagagttgatgaaaaaggaagtatggaatatggtgggaacatagcctagcctaggggttcattggaagtgatatttcagctgaaggaatagggagtaggattgaggaaggtgggtttgggcaagaagaaagatgtcttaacacatctgtggaatttacagcaattcagcatggccggttacagcctaggctaagagacagaatctggagtgatatagcaggatatgtaggcagtgaccagatctcagagtgagttgtgagtcaaattcagatgaataaagggcaacagaaacatttgaagggtttcaaatagagcgatgacagaatcagatttatgttttgaggggacaatcattctaactgtaatttggagggaagcaaagctagagagaggaagatctattagtggtatgcaaggaaaggaggtttgtgggaggggacgtgtagattagtatagttttataaattttgcccttgaagagcaagacattcaaataaagttgttaagaaagttagatgggtgcatacacataagtctttctgtgaatgccttttatttgaaatactgatcaatgggtttatgttaaagctagggtagccataaatttaattagccttctcccattttgatagagactttgtaatccttctgagtattttctttagttttctgatgaatccacttatttaaataaaattattcagttaaaaatttttttgaaagaatataaaaattcgctgtttcctgccactgtttactacaagatactgttgatatgtggtaagtgttctggtttatgggaggagaaaggaaagtttaagttcatttttgggaagacacatttccattgacattgaacttgctaaaattgcatgatcacacacaaagtgattgcacagcaatttttttttttagttgctgccaatatacaactatttaaaggctggactatttcaaaagataataatttgttatcaacattcttaggtgcagataaagagcctggaaccatgtctggtaaaacccttcccaatttacaccagaaagtctttggcaaaggtaatcttgtgctgcttagctgaaggcccttcagtatcaactaataatgtagcctgctgcctgctgtcattttttcactattagaaatattatcatattactatttttgtaccttttgtgtaatgttataatagcttctaaaggttttctcctaatattttgagaacttttgtttgcattcttgatttgaaacagtgtgacctgttagtgcctatcggatgaattatactctttgaatgtctctttttctaagccgctgtgctaatacactttttattcattttcccctgtgttataataactatgtttaagtctcatggcaatcttctttagtctatatatgctgaaaagatttatttgcatttctatccagaataaatcaaaataaattttgctggaaatggcatcatgtgaattgagtttctttagcttgcaatttttaatcattgtgctttatctggtggaaatgttaatgtttagtggcaaaagaattgtaaacagtgtttaacacacctttagtcacagacactttcatagaataaagggggttgtttaatactccaagaattactattcttatttgaattttatttctattgttgccaagtcattttttaaaaagaaaaatgatcccagaagtagataaccttttttttttttaataaagcagataaacttactgaaaatgacgtataaaactcaatttttctggtaggtacatactcttttgattaaaagttatcttaaacgccacatacctgaaaacacagttttacccattcaacaatcttgatgttcactgtcactgtgataaaggaaatccaagatattagatagcaatattctagagaaaaataaacaaattatatttccttcccctgatgaagttgtctagaaagctcatccaggccatggggtgagaccaagaagtgagaagttctagtgtctgaaaggaactgcagttgaaggactttattcttagcattatatatatgtatttttttaacctctctttggttctcagatcaacaccaaaatgcatgtgctcaccttctcttgtctttatgttttcagtaggaggaaggctggcattagcaatacaactttgaactcaggaagaaagtttagcctgaaaaagataggctgactagggtaaagtttgcagccttccaaactagcctgttatctttataagtttatgaggtagtaaaatggaaccaacatttctaacagaatacagtcgtgtgagcctgtcattctgaaagggactttatgtgtgctgaggtcaaaatccagtatgggaacccatgcagggcaggatccaggttttgtggcttattagacttgtgcagtttcatggggccctctttaagaaaaagaatgtggaattacaaatgcaaaattagtgaaaagatctcggaaggggcctatgcaaggaaagggccctgtacttaaacttcattaattcacaataaattcacttctaacctcatacataaacctgtatctaataagttaaattgtgaattgataatacagctaaatattttaaaatgagattgaatgtcacattcttgaggaaaccttccctgattgctttctttgtaatgccactgtgtcacatatacatggtgtggtaacgatccatttacccatctaatttgctcattagattctaagctgcagactggctaggatgtcttgcccactgctgtatcttttgtgcctagcacagtgcttagaaaattgtagttgttaaaagtagagtgcagggatgctggagtcacaacaccttcgaacgtattccagcagcaggctcggtgccgtgcctgatgtgccgaaaggtgcctctagtgctattacaatgcagacacagtttccatcaatcatatggacagcagctgccaagttctcttttacttggtgagttatggatggcaaagatgtctttcaactatgcacaaaaattggtaaagaactggctaggtgtccatccgtcaggtaggaaggagtgattataactgatctgaaggtagagtgagatacaaaatgccctctgaggatattttacttattcctgagagctgctgctgtctttgaacacctttgaacatttactttttaagacaattagatcaagggaaaaaatcatggaaagcatgattcaaagatcaaattcttcaatttgatgaagtcacacttcatctaactgggtcattgattttaaaccagaagcctatttactaattttacagcaaagatatttaactgtttctacaagtcatcataataaatgttatttctaatgaacagtgtcttgaacttaaataagagagagaaaaatagtggcatttcctctactccccaaataattctattattgcttaagtttagtgtttataagatttaaaaataatgggtgcaggttgggatgaggatctatataaccatggtggattatttttaatactgagaaaaacataggataaattctgcaagtactatactttttctgccaaaggagaaacatcctaaaacaagaaacttaggggctgatttaagaaaaagctggatgaaagatgtccagaccagctacataatttatagtgcccagtgaaaaatgaaaatgtgggaatcctggttaaaaactgttaatagtttcaagtcagcaacagcagagcattgaaccaagtgtggggctcttctaagcttggggcacatgttacgtgcccacgaagctagcccttatagatgcctttgcgtggttcctgagagctgctgtcaaagaccgtattcaccatgtaacctggtgaattgcaaagaaaaattcacatgataaattcctctttgttctcagcaccagaatagcatttatcacccgaaatgacctattacgttcctgtaattgagcaataggagctaccagaattaaatgttgtgctcaaatgaggtcgttttgctcagtctgggttttgggatgccatttcgttgttgctatttgactttgattttatatgcaatgttaatgggttttggtctttgtgttctaaggcatctcaaatccttttttggaagtagagacagtacgtaagtaaacaaaactcttaaaagtagttttaaaagttgattttaaaagcctatcatcaacattattcactggtggcagtaatagctctattaatgagattaatgcgttccaacaacataattattttttagagactccataactacaggcagaaataatccaggaaagcagaaggatgtgttccacataagcaagaatatataacaaattttaaatagtgagaaaagtatctttgtcttaagcaaagctcaggcaactaaggttaatggaggtgaaggttggggctagtttataattgggaatggaaagcccactggggacaagcttagagcgagggaactgctggcagacaaccctttgctgtggtgatacaggctcacttcagaaaatgtaacatatactcttttattccctgaagtttccaggagccttagctgggatcccagaacagtaaggaaccagtctggccttacagtgtgcatttgtgcattcttccccaatcatcccacaagaattaaattggattgccctttaagcagggctgccatgttcagttgtggaagattttccattgcatagactcattgggtaataggcagtggcatctgcgtttctccccactttacggcgatcaagctgcatcccctctcatggggctgtgctccccactacaccagtcccaagaagaggcaccatatgggctagtgtttaggactacctgagtcagctagataggcttagtaggcaacctaagtattcaagaatcccttaaagtgagaaaatgcctttccttatcaggaataaaaaacattgccaattagagagctctagaaagtgaaaatattttgagttaattttaagtatgaatgagtgctaattagagtggaattttaacagcagtcattctccactttttgataagattatgggatgtgaaggaccagagcctctatgtgggagttgggagctaggaaatgcagaaaattgatgcagaaggaaatagcgtttctcattacgttggctttggtttacatgcctccttcctaaaggacttgttaatttaactattacttgtatatgttaattgaagtactactcgatttgagtgtaattttctctaagtttttcttatcctttggtacaaagaaatcatttgtattccattgttaaaactgatgaaaacatgtgaaatcatacatgaagacatggaaagatacaaactgaaaaatgagttaacattgttgtaatattaaatgggaacaaattaatttccatcgaaggtaaaataatgagtgcatttgtgatttttgttgcttactcatcataattatgagacattatatttaagcacatataaaataagcacactttcacatttaaaactctagtgatcttctgtatggaacttacactgaaataactgccctagctggggtcgtctccctccttgattccatcgggcttggctgccttccctcaatatgtgttgagtgactactgtgtgccacgtttgttcctagaggatccaaaacccaaaccagaagctcccagggttgcagtgtaattaatatggggtgtaattatagccttttatgatagtctgtttctttccttgttactgtagtcccaacacttcctgagatgtgccctttaaccaagtttgtcccaagcctccacatcttaggaaaattataaacttttctgtgttctgtcttttctgtaaaacctttacctgtccccctagttggacctaatcacttcctccctggtgtttcacagagcgcctcaaaatttacttttctatcgtagttatttctatttgtgtttttatcccccactaggtttcaatgtccctagaggcatggattctaatgaattcttgtatctctattgctcatgatatttgcagaatgcatttctcataattggtacttactcaaaaatatagcatattacacaaatcagattggattacaataatggtttgcatgccaccagttcagggacacaggttgttgaccccaaatactgtagagccaggttgagttactgtcagcattcttaattcatgtttactgcataacagaaaatttaatgccctttgcccaattcctgaataaatccactattatcattctctgctcccctttctaatctgctatccatgcaaacatcatttccattaatttatgagcataggttcataataaacagttttgcgtgctgtactcttctctcagatatctaggagactcaattaaactaaaggaataagcaattttgtctataagtataaacttctgaaaaattgttgcccccaaacagcctttaaattctgagagaagcatgtctagaggtttcttatcaagcttcagaaagtacatccttctgaacatttttaatggcagctcataattgctgcccatatacatcagaggattacctaaactgggcttttcctgcagtgaaacagtgtctaataatttgagatgaaattctaattattttaatgagatttttctgcttcttggcatcaagcaatttgttttacacctttactcattatttttcatttttgaggacttaaatagaagagacatgacagaataggagtcctgtttcatctcttggaccattaattatgccaaggcggtttcagtactgatgagaccccaagaggaatgaatctttttgggtcttacttggtttaacggatttcattctttatacttcaaacaagttttcttagaaaaccattaatcactaaactatggattaaatagtgacaataatggaaatataaccaagaacaaattgttcatggttggtttctccaaggatttgacagctaatttataaaacaagttgtttttgttcagcaggacttttgtgactaaagtaaaattgctttggcaaaaggctcagcaatattctatagcctgtaggggaacggagcacacacagaccttcctccttctttcttgaccctctttccttgccactttttgcaagatttcaatttgcatacctgtcctgacttgttgccagcatgtgcccttgaaacagttactaagtttgctagtataaaaggttctgaaatttgttttatcttgtcaacacaaggtccacattggagagctttcaagacatactgtaggaaacttggcaaataggtaaaccaagtttttttttttcttaagtttggtcttcattttatatagtcatctgcatcaattacattcatagtttcataatccaaacaaacactgacataaaatatgtaagggttgctttcttaatctggacgttttcacctttgttggttcttcagtttgcctagctgggtgatgtgtgttagattacgtagttgtgtgtacaaagcgagagctttctcccttccagacacatgttatatgagggaggcagtgtaccaggtattacagagtgctggtaattaagcctgtgctgggaaaagtagggccaaaaccaagaacacatcttggatgcttccctcaagggtcttaggtgtagttggggaacataattgtatttaaaattgtgaataacagtaaaaagcagtgactgataaattgccaatatgtagaagagagaataagtgttatagaaatctagagaaggggtaggtaggctagagtggccaaactaatgttatttcttagaaattgaactgaccgttttcctcattcattcttttattccatctactcatttattattaaccaccttattaataaaaagcagctaacctttatttagctgctcaggcactgagtattatatgtacaactcatttaatatgccatcgttttgcagattaggaatccgaggcatagcatttgaccaacttgataatgagtggaagagactggtgagaaaccaagtctgtgtactccagagcctggctcttaaccagcatgtcctattgttttttgcctaacatttgctgacagcttgtcaagtagtaggttcacagagacagctgggatatagagatagtggaacaaaatccctccatttgagaaaccacagaagtaagtttgaaggccaaggattctgttgcaggacagtgatggtagcttctgaattcaggggaggcacacctgtgggaacatttggagatggagagaaggaagttaatgaccaggtggtagaggactttgaaagccagaatgtggggtttttgtttcatccatagcttcacatgtcatcttaggaccctctatttgggatccccccagagcttgtgaaaaaagcccctttgggatcctttgcccagagctcttgttcagattcttcttaggggtagggctctgaaatttgcattttaatcaagcaccctagatgattgttatcccatttgatgtggaaaatcactgctgcagataaaggagtacatatggtaaaacaccatatttgtttatattttaatatgttttgcttaaatgaaaacatttttgtgtggtataaaaaagagaaaatctttatcactttatcaaaatctgactatcactatattgaagtttaccagaggtatattggaaatatacctccgagagacccagtatgtcttataggcagtggtattctggtaaatgttttaacaacgaactctctgaaaacaatgcacaagttttgatttgtagcatttgttgatttcaaggtaccaacttaatgtcactgaacatggggttaggaagagatgtacacagttgggtccggttccccactgcctaactgcctatgagtttgaccagtgagtgaccggcagtattagaagtattagtgagtatttacaagaaaaaatatttatatgtatccaggttttataaacttttaaccacttaggctgattggaagttatttgcatcataacttaactttaatccttaactattttcaaagcatgatctcatacattacctttgaattttgcaaatattctgtgagattgccatggcagggaagatattagccttattttgtagtcgagaaaattgagagcaagtaaatttaaagaacttacctaaggtcacaatgctattaagagacaaagactgattatttctagtcatttctcttcactgtatactggatcaatactatgtaacaagctacaggttacaaccaagggggcctatgtgtacaatgctaagatactgacactaaggatatagtgaaatcataatttgggtatattagtagaggtgcttctacaactgcacatttctttgcattatactgtatgaatcatcgtcaagttgagacaggtagggtactccttccaccctcactggagttgttttgttgtcaaacgcagagatgataaacttgagagaaacagttcagagactggaaaaagaccaatgaggagctaatgtcacctggaagagtcttatccttgttccagtggctctcattgcatgatccctgagacctcctgcagcatcagcatcaactaggaacttgttagcaatgcagatccttgggtccccacctcagacctgcacacactgtgggctgtaatcgacaagtcttccaggtgactttgttgcttcctgaagtttgagaagagccctatatcatcccctccaacccagaaaccctagagaagtttgtgggatcttaaagaagagaaggcatgagtgtcttattccaagttgacagagtttaaatcagaagtaactgagtagtcactaattagattgcatttacttgaagtgactcaattaagttgtctgctgttagctggaattgggggtttaaggtaggaattaagttcagtttacggaaattaagatagttacacatcatacacacctgggtttgtagcttataaaatagaattttctatgtacactctggatgcacttgcaattttgtcctggaatgaaccaaacagatgaagtgaacagacagaccttggtgcctcatgtagtgtcaggaggtagttcatacacttggccgaattaagactcatgatgtacggctgtgggggtgggggcgacaaagcttttgaaatggcatgctgtggcaaaatatgatccacgtgagttttccttggcctttggcaccatggactctggccccctaccccatggccttgacttccctgacctgattgtgcttagtgcttctcctgcagcttggcaacgtgcatcatggtctcaactagtgctaccgactcatcccagttggcttgagactttctcagttttaacaaagaaattcccatgtcccaggaacctcttagttctgggcaagccagtagagttagtcactctgttcgtatcccacttgacttaagacctccactgggtgttttctttgctttttccactggtgcaggttggtcccgcatctttggcaggctggcaaccccagcttacactgttgttggttggggagccagggcaactggctacggagagttgctgtgaaagagtcaactattactttttgtacatgtaagatttgtaggaagcatgattagaagttatttttaggctgtgttgagtatttcttgctgatttggaaatatctagtcacatgtaactgacatagtaatttaataaattaccaactgcaatttattaaagcttggaaacatcttgctgtggagtgacttcaattaaggaaaatcactttgagtggaatttgaaaacttggcatggtactggggtattggttatttcgaataaatgggtgatacctgaaggtggaatcttaagaaaattaattctggcatatgtggaataaaatagagggattatgagtatggaggctcatgggagaacacatgttagtctaggattgagatgataaaggcacactagggagttaatggtcagaataaaaggaaaatttttgaaagatattttgaaggaagaacggatgaagtactgagctgggtaattgagagaatgatgacattattaatgaaaaataagccagcctaaatttagacaattgcaatgaattaaactttaggactggtaagtgtcaggaactcagatgatttcaaacagttaaggatttgagataaggcccaggagaaaggtgtgggctgcatatgttcatttgtgagcatcttatcaaaggtgatggttgaagcactggagttggtgtagtattcttgcatcagtaggtaggtgatcatcagaagcagacagctgagttgagtaatgtcaatggccataaatcttttgtttggtccttaatacatttggtgctatgaaattaacatttattcaggattttattgtggttccttccatgctattttagcagtgaaatttcagtgaaccaattagaacagtgaacttgattgcacatgctaatgaagatcttcttaattaacttttaataataaaaactccaagttctcaagagctagtttacttccataatgataaggaaattagagtttgagcataccaatagtagtgtgatcccttgatttctacagcatttataatttgcaaggcattttattattttatcaatgaccaaaaccctttgggacagttggctttctctctaatttatagataagtaaactgagtctcagagtgagtgcgttgcttgcaaaggcatgtagtaacatcagtcataaccacgtcagattgtcttttagttctttgaccgatgaactttccacagtgccataattgctggttgccacacattaacactagcgtagtgggaggttcctccagtatttccccagcgcagtgtagatttcagaagcttttgatgacatgccttcattaatcagagaaagatagaccctctatatatagaagttttgatggataaatatatctgacattgctataaggcgttagtaccacaatttttagattcagtcatcttcactgagaacccaggaataaaattaggctgattgagggcagaagaaggctgagccaattaaagaaaaccctgggaagccaggattaagtagcacaaagacaaagatgagtgagctgatgaaattgcacccctagctgaaaagcagcacacttgaaggaaaaccatagaatgttccgctaacttttagcagtgggagttacataatctaataattaattgtctgtagcttccagatctattagggaggtgtggaacagactccagaggcaaatcactggctcctgtgcaagtcaggaacattgccttaggcactcagcttcaaattggtaatgtttacaagttgttttccccataattttttaactctgggcataatctttttcctcttaatgggtattttaagtgtatcttaaagatttttcaccggctttacacttacgattggaaattgtctagtttgtcactatacttctgagtgtcagagtacacatcttatttttgttttttttttccccctaaaagacaatgttcaaaatacaaggtgatagaatatccctggcacactggagaaaaactgagatcatgtgcaaacagaaggatacatccttttaaaatagtttaaactgccattagaaatagaaggaaacccattttatctgggttactttgacagatgtaactctcacaaaggatgaatatcaaccaccagcaccctcttgtctgacattctgacttgaaaaggaagagcccctgcaaccacatagcatggagaggagataggagagaggctgtgagtagatgaaggctttcagtcatcaggggccataggtttcgttttgatgtacataaaagctgaccaaggactttgtgaaaactttgggctgccttcctgaccaccttggtttttttccttcacccgtagatcagcgtcattgacaactgcattcttttcaagtggcaaaaagaagttaaaaataaaattctattttagatgtacctttgattttcttcaaaaacatttcagatgacatgaaagagaaatacgtgataaattttagcagagacctggcagagtcttcctatagtttaatcaaaaatgggctcagtttcaaatatattaagttgccacaggagaatgggaatgacttttgggaacagttaatagttcctggaattttaatccccttttatcacaatactgggtaaaagttccaaggtaagtaggcaaataatacttaaaggaatattgcatgaaatgtaagaggtgacgtatttaaaagaagtatccttgtacagctcgcctttcctgtgataggtgctgcatgtttttttttttttttttctggataatttgtcctggactttgtccaggacagaaaacttcggtgtttctaaagtttatttagtcggtctcatctccttaacaatgtcagaagaaaccttttaacttggaacttggtaaaagtaatagaaaatattgtttaagatctaaatgtaagcatttggggtgaattctttaaaaaagtctggctatttcctagatttataactgcaaatactgtacaattaaaaccaccatggtattcctcatgattcttcctatttgggtattgatgaaggccttaatcaaccatagctgtttagaattttgagtgtagattgtaatttgggatattttctactggggtcctggatttgcattgtgttctgatttcttaccctatactgcattttcccctatggaaaaagtaccttccttgtattggaattttttaaaagattgcagttatttgtaatttgtaatcccccagtgtttctagtttatatctttaatgttgaaatatgaagaatattttattctattttccaaacagctggtaagagaattcctctgagaaaaaaatatctgcctggactctcacagtcgtctcctaatttatctttctgcttctgctttccatgatttaatttttttttgtacagtatccagagtgatcctattaaaagtcagatcacgttactcctctgctcacaaccatccagtggcttcccatcttatcagaacaaaatctagaaaagtcatcctcttccacggttctataagtgatatgcacctcaaatctttctggcctcatctgtaaaaaccctcttccttgttcattctactccacactggccttcttgctggttcttgcatacagcaaacacagacctacttcagggcttttgcatttccctttatctcttctcccagaaatttgcattatttgcctctcctcctttctttcaggtctctgctcagatgtcactgcatcattgagaccttccttgaccatctgaagttaaataggaccagtacttcaggtgtatacagagtccagaccgtgagatctttgatctcagaaattaggagatacccttaggggattagggcttcccaggttctagaattgagatggtcgttctttctaggtcttaaaggccaggggaccccagctaaaatttgggtaacttcaaaatacaaatactttcacttaagttacactgctgtttatcaactatgtgtctgtagttatttagtttgttaattgttactccacaaaacaaagtatatactgaaaattcataaagcctatctttttgcaaatgaaaatgtgatctaatggtctctttgtgaattccttcttggaaatgctccattattgtcatagttggtttatagccttccttggtgttaaaaagagaaaagatgttttctctttccattattgggagctcttttctttctgttgtttctgttcttcctgccctgtggctgctcagattctgtgtacagctgtttctatgaagtaatctgtgatctcctcacgttgctgcctctttgttgttttcactacatgtagaccacagtgtcacaataagacaagagaataaaataaaatgtttcctattttattaatgatttaaaagtccaatgccattattcaatgaaaagcccaagtcaacaacattttagtgtaatttagtgagaagtgttctggtcacttggctcaaccatgcctgcaagccaagtttcagtgtttcctgacactgaatcgcctgagtaccattgtggttatacatatggtgggatgacgtggccagttgaggtatatgtattaatatgctgaagaaaagagagtagtggcacttgcttcgtgagccaaaaaactgcaatcacttttaaatatatgccacaaggctgtgctgggatatgaaggaaggtaagatagagcctaggtctgtctagggattgggctgcttctgttatataaccacagcaagtcagttcagggattttagcaaacctttgggaatagcagggactgagctttagatgatggctctgaactgctggtttccaaccactagggtgctctacctgtgtcagattttcctggatcccatgcatttccccagtccatggtaaaggaatcactgggtatctgcttgtcattccccaatacacagcattctaccacattctgacttagaatttccttaccactattttccccccactagcctctgaggagctttctgaacatatagcccaactccttgtatatgtaaggcatttgttacactttgatggagaaatgaaattgtgtgacttaacaactattatattttcttttcattaatccttgtactatatttgcatgagtagaattttgtaaggttgtaagctctaggttactggaagaaacagaagtccgattgatttgttctgagaaaaatgactggataacaaagctaggcatatagagttgaatttaaatccttgagatgatctaacctgataatgtaacatcatccatctgtaatattttctcagtcaatttttctggtattcttcattttctttttgagaaagtgaagcatatatttatagcattatagcatatatttatgccattctctattcttaaggaatagagacagtattattttctcttcaatctgtatttcatagtgacatcaaagtaaaattctacttaaattgtgtgctaatcatagctttttatgttttcccttttctgccttctacttttttctactatatctccacttcaggtgcttctctcacattttccttaaatgtttctgtcagttccttagtctctacaattcaagagatttctatgaatctcttggtctattatgtacctttagaatggaagggtcttactagaaaaaaaatatttttatctgcatcacatttgttgacagaaagagaccttcatgctctgttgttaggtgcataaactagcacaaaacaatagatactgagtgctctacttctggaaaaacaaatattttgttttagctatttgcatatgaaaagatgtggaaggttacttatcaaaatattaactgattgagaatgtttagagtcttgttgattgcagttttccttctttcttttttccccactatttcatgcattcattcacatagtcattctttttctgtgcatttttattttctgattttctgtattactagtgtaaaagcaaacactaattgggaaaatatacaggaaaaaatgttcgatggatgtaaagaaataattgtgaacgtttatagcaccaatggtgctacgaaactattcttgacttccttttctttggttctaaggactaaagcataatccctacttctttggagctttggagggcttggattgtgtcttcctcttagagttagaatgatccatgttttgccaaagtgttcaagaaagggccccatgttggatgtcccttacagctttacctgggcatggagaaggcccagtcacacagtgatgacttgtagcctctggacaaatgtcatagaatggctgtgctccttccaaattccactcagagtggggacagctctactgcttgctgagcagtctccattcagaagtgtttcccttaaataatatggcaaaagccaaaaggtaagattggggaagaaaacgtggacctaggctaagatcatctcctctcccccactgccacctacatgtttgttttgtttacttgaatgaaacatggagctgttttaaatgtctgtgtaacacagtggtatcaataaaatgcagcttagttaaaaaatttattttatttttctatctgtgattacgttaagcttccgtgaaaatggaatgcaccagtttcacagcaggagaagatagatacagcaagattagggaggcaagatgttcaggattagaaggatctgtatggctgaaagtgaggtaatgataatgattatgtgataatagtactgttgtgctgttttgtgaggcagtaatccagctcccaaagcagataaactatgggggagaaggctgagtttatcccatggaggggaatagactgttgctgaatagcccagcatgacagtaaggctctttcttttttgaggcaagagctcaaaagtaagtttttaaaataaaacgagtaacttcccaaatacgaacaagtgaacagctgagcaagggtaaaagaaaatccaatagtgcaggagggtgaggggttggaggggtggggatgggattctttttatgcaacaaaaactggagttctagtcatatgagaaaaaaatttcagggccaaacacaaaaacaaaacccccctactatgcaaattggcagctgaaatgaagtggtattttctagaaaagtattaaactactgcaaaatgcaaacagatttccattcatctcattttaaatcactatttgttcatttcttgaaaacttgcttcatggaagggactgtaattataacagacaaatggcatattgtccttgacttctctgagcttacagattggtattgcttagtaagatgttgcggctaggcgtgctggctcatgcctataatcccagcactttgggaggccagggcgggtggattacaaggtcaggagttcgagaccatccttgctaacatggtgaaaccctatctctactaaaaatacaaaaaattatctgggcgtggtggcgggcgcctgtagtcccagctactcgggagcctgaggcgggagaatggcgtgaacccgggaggcggagcttgcagtgagccaagatcacaccactgcactccagcctgtgcgacagagtgagagacagagtgagcctctgtctcaaaaataataataataataataataatgttgcaatagctaaatcttcactttttcttttgtattcaggattgactggaaagtaaatgtcactcagtctgaggattcctccttcctgatatatatctatatctgtatctgtatatggacataacatatatatacatctctctattatctaatctgcatctatctatctatctatctatctatctattgatgcattccaagcttattcagttctagaaaatggaggagggatggaactcagtcctcagttcatactgatgtgacttctcctgggctccttgcttaggcatgtggggccaatttgatttggatgactccactggcagctggtttcactctaggacagctgggaaaattttgcttcatctcccaaaggtttactgcttagtactaattctttctcccttgcaggctgccagcaggcatccccttgtggtatcgtcacatcagaggctatgctatcaaatgggttcatatgtcttccaacctgtagaattgcaacccctgacttttctatgtatctggaagctcttagacaccccaagggatggagccacttctaacactgagacctcctcttctcctccatcttcaaacaaaaactctagctcagtagcctcatgggctgtagtcccagctactcaggaggctgaggcgggagaatggcatgaacccggactttgacctcccaatgcaaaggcccatttagcctctgggggagcccaccaagatagaacttcttttcaacttaatcactcaaaaaggctaacttcaaggacactgagattaccttcaatgttactttttgggagatgtgagaatgagaaacaatagctttcatttctcttcattgaagctaaatttgagaagaataagattaagttaaattctcaggagcttattctgccaccccgaattctccacaaagtccctcctgtacttaagaagagggagttttgtgctcgtttgttcaccattgaatccctaacattcagcaaacctcttggctcaggaggcctgatatatatttttgaaataatagtgaatgaatcaggcttaatgtttccagaagttagttaccatgactggatcagtcattgcttatatctgggaacactgaagagcattaattcacagataatcactgagtctatgtaccaggtgcttatctgggcacttggaatctgtcactgaacacaagggcaaagacccttgccttcatggagctttcattctagccaaggagacaataatcaatgaatttattgaaaaagtaagttatctagtatgctaggaaatagatattatgggaaaaagaagggttgagcagggtaagggagatacagagtaaggagcagtttgcattatgaagtaggtggttggcctcattagataagacagtgaacagagacttagaggtggaagggagtaaagtggaatttagggcaagagcactctctgggcagaggaaacagctacagcaaaggttggaagtctgcttggcatttttactttagtaaaatacacataacaaagtttacaattttaaccatttttagtgtacgattcattggcatttcgtaaattcacagtgtgcagacatgactactgcctagttccagaacatttttatcaccccaaaggagaacccatattcactaaatagtcacccccccattcccaccttcctcagactcccggaaattcctaatcttctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagagtgagagtgctagaaggaattgaattttagtaagattttgaatctaggaccaagagaatttgctgtaggcttggatttgggatgagacagaaaggagttaaggattctccagttgttctaacgtgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggccacgtggtgagcactggggcatattctcctttagtggtgaggggcacagaaaaaaactataaaagaaagaattgaagtaggagaaaaatcatgggtgtgtagtgttttggaagccatgtaatgaaagtaaaccaaggaggagaggtcaactgaatgagatgctgctgaagtgatggacagttggctttagcagattgtggttggatcaaaagtcatatgggaatgggtttaagggaaaatgaaaagaggagaattgggaacagtgagtagggacaaatatttggaagactttctcataaaagctgaaaaaaatgagggcagtacccccttcttcggtgcctcaccttcactagaaagctccatatttcttaattattctaacaaataattatagttaattctggtgagtgatgcatttctttgcaaaatattgtctcagtttcttcctcacagtttctcaggatgctctttgtcatcatttaaaaagaataataaactaatgagcaagataaggagagaaaagaaacagatctgagagaagattctctttctggaacactaataataagcttaatattttacaaaataaaacacttttaaaaactatcctgtaaaggtcttatttatgtactttttataggttagcttataactgtttctataaaaactaagaaaatgtggaaaattttgaagtcatggggagaatatctgaatagcttttcctcctagtttcttggaaaaacaggaaattatatgcaagactcattttaaggcctttacagtgtttaatttacttaagtacataaaaatgtattatgtataacttattaaatgtattatgtataactaataaagtcgtgtctgggataattaaattttaaaaatatggtagattaagaaagcaattgcagatttactaattgaatttgctatttgatgtttttaattttttaaatcacaaatagggttctaaagttgttgcagtgaaatgaatttaacatttcttatatgctcaattaattgggaagcaggcaaacacctgaacaaccatcatactagtattgcacataaatagatcctgttttagctagttttatgctcgtatgacattaaaaaattttagagacaagttttctggaaaagtagctgtatcataaaggggagaaagcccttgaatgtattgaacatggtgggcatgaaacttggtggaattgttggcagtttttgaggtgtcactttccacagtctcttcaggcacattggttcatgtctcattccttctcgcatgctactctactatttcatttgatcattgttttacaatttccgaatgaaaatcagcttttttcatgcactacatgagagggaggaggctaaaatgcaataaatgatcttagaggattggtctgtaaaagtcttctcaccaaggctgtgggaaggaacgtttcctccaagaactatttggcttatttatctgctatgtgccaagtattatgctaaattctgtggtgcaaagatgagagctagattcattcattcagcgatttattcattcagtcaacatttatgcaaaatcatttggattattcaaaaaatatataaagacagtcattatcctgcaacaattgaaaatagagttaaagcttatttttgctttgtaatttaatcaaataaacaactatgctacttgctctaacttacttttctggctttttaagtcttgagttcaaactactttcagctggaatcttagggatacagttgaggacagtgctattataccagttttcccaaagctcataaaaaaatcctaattaatctttaacttatattctttacattttcatattttggtatatattttcttaaaacaagaaaaatttagtgaattcttaaataaaataatattttcataaaatctttcttcagtctgggtgtggtggctcacgcctgtaatcccaacactttgggaggctgaggtgggcagattgcttgaggtcaggaatttaagaccagcctggccaacatggtgaaaccctgtctctactcaaaatacaaaaaatagctgggtgtggtggcacgtgtctgtaatcccagctagtcgggaggctgaggtgtgagaatcgcttgagcctgggaagtggaggtttcaatgagctgagatcatgccactgcactccagcctgagcgacagagcaagactctgtctcaaaaaaaaaaaaaaaaaaaaacaaaaaaaaaactttctgaacagatctgttttttaagtgggtagttttacaggggagaggttatttcctaacgttccttcaagtgagcaaatctgtcagagtttgctgctccccacaggcacctaccattctacccccaaattaactctttcttatcaatgaaaggtatttccatttttttctgggagagaacaccaattaaatagttaggtaatttggtacctaatgtctttaacatttcttattaataccttatgaattataatattataatcttccttttaatgaataggttatactcccctgcaggtggaacacttagatgagaagttgtaaatatctttaaaataagggtttaattaattataaatatgcctgctaattttaggcaggattctactctaggaactggaaaagaaaccaagaaaataaatgtcttttcagctgtgaagtaaataaccatctagtgagagcaacagagtgagccccacattattcaggtggaattggattaaaaagctctgccagtgagataaaaacaatgggatcagtggtggactattgaaataggaaggaaaaccataccttatttagatatgatactcgtataaagatgttgaaatgcttttatttctctgcattgtcatatgattcaagttgggatgggcccatgtaagatagatgaagcagaagagcaaacagcattgggtttagaggcaacatctaaaacaatgtgattattttgcccctcacagaaattagtgtctcagtaaaagtaaatacatttcctgggcaaccagaaacatatgttgcatgttctttccagtacagtatgaatcctcagtaagacaaaaagagaatggttctcactaagcaaaccttccaacttttatgtccctgagccttcagttgctgttgttggttgttaacatctggctttccatcatcccacttttctcactcatagttgtgggcttactgtgggtattccttggtagtctatcaccaacatgagggcaagattagtagatcaaaatcttgtatgtttaccacttagctgagagccttacacatagtcactgctcaataaatattttttagcaaatgagttaccacgcaaatctcaaagcctttcttgtattaaattctagagtggtctttgaggaatcaccacactgtcttccacaatggttgaactaatttaaactcccaccgacagtgtaaaagcattcctttttctctgcaacctcaccagcatctgttgttttttgactttttagtaatagccattctgactggtgtgagatggtttctcattatggttttgatttgcatttctctaatgattagtgatgttcagcttttttttcatgtttgttgggcacatgtatgtcttcttttgaaaagtgtctgttcatgtcctttggcctctttttaatgggtttgtagaaataccatttgattcagcaatcccattactggatatatacccaaaggaatataaatcattctattataaaaatacatgcacatgtatggtcattgcagcactattcacaatagcaaaggcatggaatcaatctaaatgaccatcagtcatagattggatagagaaattatggtccatatacagcatggaataccatgcatctgtagaaaggagtgagatcatgtcctttgcagggacttggatggagctgaaagccattattctcagcaaactaatgcagagagagaaaattaaacaccgcatgttctcacttataagtgagagctgaatgatgagaacacatggacacactgggaggaaacagcacacactggggcctgttggagaagagtggtggggggagggagagcatcaggaagagtagctaatggattctgggcttaatacctaggcaatgagatgatctgtgcagcagaccaccatggtacacatttagctgtgtaacaaacctgtgcattgtgcacatgtacccctgaacttaatataaatattgaaggaaaaaaatacaaaaaaaattctagggtggactttggagaagatggagggcagggagattctaagaacaaatttttgtgacactctaaaaacaaatgaaagtgacattagtcattgagcttttgaattttttctggtaggactttacctgcaactaaagaaaaaagatggacaacctttaatcttgtatcacatcaatactgtcattaccttgtataaaatttccatttaatgcatgttctttaactatctgagtgataacaggtgaatgacatttttgtatatgcgtatgtggcttacatatttcccaattctgcaaactaccatgaagttagtattagaaacttactttgttatggttagatgagttaaaggagggaaattagatgcactgtatatacgtatgtccccgagagtgcactttccatgaatgatggcttgcatcttctcattttcctagatttttcacttctatcactatcatgcaaataattacaaatagcaaataattttaaatgtcagtaagctagtcttgagagcatgcagcatttactgtcatagagcaaaataaattaagtagaagatgaagtcttctgccttcatgaagttagcattcagtagagaagttgggacaaaaaaaatatgaaatatttgttgccatctacaagagaaatgtggaactacaaccatttgcagtgatcctcaagtcctgaagtggggcaggagtcaatgtggccactggttccaggaatggcctggagaactacaggcagattgtctgaaagcagagagcatatcaaccttctcctctcttcatgggtaacagatgcaccattaaaatgtgaacatcacacatgtaaatcttagactttaatgtttttataactgcaaaagtatagcttaattagacatatataatgaacctatcctatatgtaggatatatatcctacataccctaaggtgcatgaaacataggaatgacttcagaaatatcaaaattaggaatccttctctgttgccatgttttgaaggtaagatttttggagttgtatataattcattttttaacactttgaatgtattactttgtctcaagcctacttaacaccaaagcacattcataaaagcacttagctaattgtgaaagctagtaataactagggaatctgaacctgaaatcacatacttttttttttatttttgttgattattaaaagagaaattaagttatttgctcatgtttatattatggtaggtaaatttaactcccaaaccacaatcttacataggtagacttgcaccacgggactttgctgtacacattatttcatcacccaggtattaagcctagtccccattagctatttcttcgtgaccgtctccctcttccatcctccaccccagtgtgtgttgttcccctctatctgtccgtgtgttctcctcatttagctcccacttacaagtgagaacatacaataattggttttctgttcctgcattagtttgctaaggataatggcctccagctctatgttcctgcaaatgacatgaccttgttcttttttatgactgcatagtattccatggtatatatgaaccacattttcttatccagtctactgttgatgagcatttaggttgatcctgtgtctttgctgttgtgaatactactgcagtgagcatatgcatgcatgtgtctttataatagaacaatttatattcttttgggtatatacccagtaatgggattattgggttgaatggtatttctgtttttaggtatttgaggaattgccacactgttttccagagtggtcaaactaatttacactcctaccaatagtgtttaagcattcctttttctccaaaacgttgccaacacttgttattttttaactttttataatagccattcttaatggtatgagatggtatctcattgtggttttcattttcatttttctaatgatcagtgatactgagctttttttcatatgcttgttggccacatgtgtgtcttcttttgaaaagtgtctgttcatgtcctttgcccatgttttaatggaactgacaaaccacaatcttgattgcttaatacaataaaggattatttctcaccatgtcaccatccagtttgagttagtattcgtggtaaggggacaggtgttgggaacctttgctctgcccaatcttttaggaattccgatttcttccactgataggcttcactatcaaggaaggctgtggagtccccagtggatcctctgcatttggcctggaaacaagggaggaagaagtgtggaggattgtgttgaagggttcatttttcatccagaactggaggtgctagccatcacctctgaccacctttccttagccaaaatttaatcatgtcattccacttaacttaaaggagcctgggaaatgtaatctagccctttgctggggaggaaaagaaaacagagttttgaaacatgcagcactgcttctgccatagtgtttaaacatcatgcattgatgtaaaattttctggactttcaatatacatcaaaagtttccagcttaacacaaagtcaaatgaaaaaggaatggccaaaaacataacaaacaagaaggaaggcatatcaaataaattggtgaatttggaagcacctattttaaaagaaatggctgtccaaagacagttctagtggaaatgaaaggcaagtaactctatttcaaatcttggactaaatggaatagtgtaaagagttacctatctaggaatcctcattaagtagccatacacccttggactattcacttatcttctctaagacttgattgccttgtatgaatagtggacataatgctaatatatgttttcatgcttgctttgaagcaaacaattatatatatgagggtgtttgtgaaatattaattgctaaacaagttttctttcaggctagttgcattaaggaaaaattacttccaagaccacctgtaatattcacctatgactcatgaatttccagttggctagagtagcatagaaaggctttcagatttgtaaaatcaaggtttatctgaggtaacctttgctgcttgttggaagtatgtagctgagtaattgttcaaaaatagcaggttattttgaggtagaacatatgttctttaacaaataaaataagtgttctgaagggaaattttatagcatatttaatcacacacttaaaataatttaaatctggcagtttagagcactgtgtactttgatatgattttttaagtgctttattaagtgcagtaatactaaggtgagtactattgtgtggatttgcattttatgagtagctcttttcaacttctgtaaagaaaaaccatgtcatgaataaccaaaactgaaaaatgtagactaaacattttttatatttgatatgttttataaaattatgaatatatgctttttatatacacacatatacatatataaattataggtatgataaaagtgacttgtttcataagtcaaacaagcaaagaacccttttttatttatatcaacctgttaatgcatgcctcttggttgttggatgtattcatttaatagacatttaaagactaagttgttgttggtagtagggagcccagtaggtgttttcaggatattaacaaaaagcagccataacttccagcacagagctaaacacatagctgatattcatacacaagaaaaataaaatgtagtcaagccagtattttggaattggtcaggagacagataagtggtataaatatggcagagtgagattctttttaggttggagagccgggcaagacaacatcatgaggaaggaagtttttcattgattcttggagaatgggaaaaatttagtcatgtgacagccataagtcagacagggagcatggtatgagcaagacaaagggaggagctgtttgatttgcctggagaattaaataagtacaagaatattggaaaattattcagctcggaaacataggttgtggccagactgtggataaccttaaaagcccacagctttatggatagttttgatgatgtgacattgatgagttttcttttctttttctttcctttttttttttttttttttggagatggagtctcgccctgttgcccaggcgggcgcgcggtgacgtgatttcggctcactgcaccctctgcctccaggtttcaagcaactctcctgcctcagcctcctaggtagctgggattacaggcacgcaccatcacgcccagctaatttttgtattttgggtagagacggggtttcaccatgttggccaggatggtctcgatctcttgacgtcgtgatctgcccgcctcggcctcccaaagtgttgggattataggtgtgagccaccatgcctggcccaacattgatgagttttcacaactcatcatgtgatgtgattaaggaagcattgaaagcacagtttaaaaagccttaattgctgagatgatttcatgattattgttgtttctttagaaaccttgacatctcagcatatctaggacttttcttctctcaatatcttgaagagctaatttcgtttgcccccgtttttaggtttccacttcctatttttatgttgcgtatctgagattattatacaatgccccgtattttagggttcctacaaaagatagtaatgctgttgcttaagcagaaagtaatattgattctgactacgtggaaagtggggtggtaggtgaagtgaggaacacacaaagatataaaaccatgatgttataataataataatactgcataacatttggggaatagcaaataaataggatagaaaatacaattctgtaggagtttggagctgtgattggattttagaggagctagatggaagagttgaaaggacctctaactccaaaactgagtaatgaaattgatggtgtattatcaaggagcttcaggtaaatcatgcagccaatgaagagccttttctacctctccaactagtgtttctgtggcattgctttagcataattcattgtcatcagtaatgggaacaatcataaggaatttttgaagctgaatcttttaaaaagtaattgtgttaataaaaattttagttgctttatagtttttgcaacagataatggtggaatgtttaggaactgtggtgggtatattttctgtttcttaaaagttgaacaattccgttcttttattttctagttccattgctctcttatttgaacaggattttaagtttgtttaaaatacataaatgtggctgggcacaggggctcatgcatgtaatcccagcactttgggagggcaaggtagggggattgcttgagcccgagagtttgagaccagactgggcaacatagtaaggccacatctctacaaaaagtaaaaaaaaataaccaggcatggtggtgcatatctgaggtcccagctacttgggaaactgaggtgggaggattgcttgagcctgggaggttgaagctagagtgaaccgtgattataccactgcacaccagcctgggtgacagagtgagaccctgtctcaaattgtgtatgtgtgtgtgtgtgcatgtatgtgtgtgtgtgtgtgtgtgtgtgtgtataaatatataaatgtaacaaaacaaaaataagagaagaaaacattgggtcaggtgtggtggttcacacctgtaattccagcactttaggaggcctaagtgggtggattgcttgagctcaggaggaggatcgcttgagctcaggaggtggaggtcgcaataagctgtgattgcgctactgcactccagcctggatgacacaatgagaccaccctgtctctctgactctctctctctctctctctctctgtctctcccacacacacacacacacacacacacacacacacacaaaaagaaaaaaagaaaaagtagcataaattaaagatgaagttctacatagaatccaggtgctaaggtactatccattttgtataaataaatgacccacatacttgtctcttgagttttctgttagccacacaaaagagtgaacggtaggaggtttataagattggcactgtctgtagtataaaaacaaaccagctactcagaaagagcacaacccttcctaataccaactctaggcagaaataaatcttttctgtaggttctctgagagaagccccatagaatgtaatgagtaatgaatatccttaaaaacatccttacaagtagatagagaaaacttgttttagtactttaaaaatacatgtttataatgctttgggttaattgcataatgcctaagcatcatccagaaaaaacttttacagaggtcaaaaaaatgtgcactagacacaaactgtaagggagggacttagagccgggccagtcagtgtcagttcacactgcagcatcatctgtggcctcgttagaaaggcagactctccaaccccatctcagacccactgaatcataaccttcaaggcactgttgagaagcacatattaaagtatctaagttgacttaaaagacagttagataagccttcatgaatcatatttcccttaactgagtttagataaacattatggagcagtaaatttggagatttttctttgtgaaaaggaaatgaaataaatataaattcttttactggttaagcgtagatctattgcttttgcctttacccaaacattgggaagggtgttagacattcagttactatctaatatgggtgaagcactgggttaaatgagagatgtaaagatgaacaagacagacatggtaactgtttcttttatttattttttatttcagtaggcttttggggaaccggtggtgtttggttaaacgaatactgttctttagtggtgatttctgagattttgttgcatccattaccccaagcaatgtacactgtacccagtgtgtagtcttttgtcccttaccccagtcccaccctttttcccaagtccccagagtccattagcaggggcaatttagttgtaaacaagttgagggaaggaaactgcaaggtataaacaaagtgctgtgatggttatttctattctctagattttatacagaagaagaaactagctcagagaaataacttggtttagattacacagctaatatgttacaaagttaagaattgaactcaaggtctatgtgatactaaattcagtttacacttctgaaatatagcttcttgaaagaaaagaaagggaaaactattcagaaagtgagaaaaatcatactataaatcagtagcttctctattcaactccagtattttagacaatgtaataattttgaattacatctcctggagcaagtgctgtttttagttaatataaactgaggtgactcttgcagttttcctcaggaggtaataataaagtagggattcttcttctcctttttttttttttttttttttttttttttttttttttaaacagggtctcactctgtcgtccaggctggagtgcagtggcatgatcttggctccctgcaacctccgcctcctgggttcaagcacttctcctgcctcagcctccccagtagctgggattacagacatgcgccaccatgcccagctaatttttgtatttttagtagagatggggtttcaccatgttggccaggctggcttgaactcctggcctcaagtgatccacctgccttggcctcccaaagtgctgggattacaggtgtgagtcacagtgcccagccaagggattaaattttgccaaaataaacagtgccatgattgcagtcccctgccaccccccaataaaagtaagattttattgatatatgaagacaagcctgttttttcttttttgaaacaggatcttgctctttcccccaggctagagtgcagtggtgcagtctcagctcacagcaacctctgcctcccaggctccagagatcctcccacctcagcctcctgagtagctgggactacaggtgtgcaccatcatgcctggctaatttttagtatttttttgtagagatagaatctcaccatgttacccagactggtttcaaattgctggactcaagggattcacctacctcagcctcccaaagtactgagattacaggcgtgagccatcatgcccggccaacaagccagttttatcctcaagtgttgtgtgaggattcatgaagtgtttagcacacagcaggttttcaataaatattgattgaggaaaagaatttaatatttaccctttagatcacctttcgagcccacttttattgggtaataaaagagtagaatgaaaggaatatatttagaattttaaaaatcttacctcttttagaaacattttatagtataccagtcgtcatgacaatatgtgaactccccatcactatgtacttcatacttcagttggcattggccacagtttcccccatatcatactgatatgtatatttgtcttatattcccacaatagtatgagccttttagagagatctttatatttttctttcctatatgggctactgttaggtgtgtgtactcagaagatggtcattaagtatttaaatgaagaatgaatgatgatcactacaattattttaagtcaaatctgatctagcaacctgtgcctttatagtgagttcccaatggctgccttttaaacctggtcaaagccttgctagtcaaagatgatctatgaccatgcttctgagtatttttagtattgctgttgagagggctagcatttacggggtgctaattctgtgacagacacttttttttgtttttttttttgttttttttttttttgagatggagtgaactctgtcgcccaggctggagtgcagtggcacgatctcagctcactgcaagctccaccacctggattcatgccattctcctgcctcagccttccgagtagctgggactacaggcgcccgccaccatgcccagctaattttttgtgttttttagtagagacggggtttcaccgtgttagccaggatggtctcgatctcctgacctcatgatctgcccgcctcagcctcccaaagtgccgggattgcaggcatgagccaccgcgcccggccaacagacactatttaaaacattatttcctttagtcagtacaacagtcctaggaactcttactgtctgtagtggagatagggaaacaggtttataaggaattaataatttattgctcaagagtaagagtaaatgaataactaggagataatgaatgtcctggccatttattctcaaagagcatgaatatacagaataggctgatttgagacattatactgctttcttcctggaaactgactttggtggaatggtcaagctcttactttagaagtcataaagagctgtgtatggagaaggtaacagtcggtatgttaaaacaacagatccggccatagaataggtgcctaatggttctgaaatataagcaaacatgctggacaactttatcattatttctggcatggctggctctggggctcatgtttgtaatcccaactctctgggaggccgaggcagggagattgcttgagcctaggagtttgagaccagcccgggcaacataacgaaaccatgtctttacaaaaaattaaaaaaaaaaattgggtgtgcatggtgatgcaggcctatagtcccagcagctcaggaggttgaggtgagaggattggttgagcctggaagttcgaggttgcagtgagccatgatcatgtcactgcactccagcctgtgtggcagagcaagaccctgtctccaaaataaaaaataaaataaaataaaacatagttgtttctgacttagcagaatgtgttatattggaaactctatgcttctgtgaatccagtactgcaactctctcccactcatttaagaataaatccttaagaatcccaagaaataaacatataccacagttcagtccattgggccagtatatttataggatagtcacacaagtccagaaactgtcaggctgttactctgtgagaataatgggaagggttcttatcttcattcccactccaaagtaaggtttactttctagaagtgagatgcaatataaagtacccacgcaaaaggtttgaggcttatgcagaaaacaagcatggattaggatagttagggtttcatggagcatactttttccattaacaccaagaagataaatttagttgtctttttctgctagagctttgtggaatggagttagtgaagtaaaaggcatattccctttgtttttgttgcagaaataaatgggcaaggacactttaaagatttcgtgtgtgcattgtggctacttgtcctaaacataaaatcatacaactaaatgaaaatctctctttcaattcattttaacatagtgatttgctgcttattagtgcaatctggcaaaaaatgttagccaagcagctaatattttgtttacatttttgccctagcaaagatatatcaaatcccctgatgtacacctcttactcaggtattattgtaaaaatcaacaaggaccatttgaacactgataatactaaaaactgtcggttcccttattgtttctttaaaaataaaaccaaaacaaagcaattaactgcaaagggctatagtaacccaaagcaaagtttacatatttaaacataggggagtaaggaagtacagaagttaaacaacaagagagataatcttgaaagtggcaaaagtgacttatctcacttaaaagagtctcaataaggctgacagctgatttctcttcagagaccatggaggttagaagacagtggcatgacatattcaaagtgatgaaggaaaggctatcaagcaaaagttctatctgtagaaaaactcctccaatttttaaggagaaattaaggcatttccagataaacataacctgagagaattttccactagtagacctgttctacaagaaataccaatggaagtccttcaggctgaaataaaagggtattagatcacaattcaaatccacatgaagaaataacactaataaggtaactgcataggtaaatataaaagacagtataactgtatttttgtttgtaacattttttcttctgtctgatttaaaatacaatgacattaaagcaataacgataaaactatgtgtttggctaatagtgtattcagaagtaatttgtgtaacaataacacaaagaagagggtagagaacagagctatttagaagcaagattttatatactattgaaattaacttggtattaattctacctacattgttataaattgagataatattaatcaccagggattaagaaaacaactaaaatgcatactaatagaaataacaagggaattaaaatgatacattataaaatacagattttttataaaagaaggcaataatagagaaagagaggacaaaaagacagcatatagaaaacaaataacaaaatggtagacataaatcctaccttatgagtaatttatttaatgtaaatgtattaaatagtccaataaaaaaagcagatgttgaaagaatggataagaaaatattatctatttgtattctctatgtaagagacacatatgagattcagagacacaaattagtaaaagaatgtagaaagtaaaagaatggaggaagatatgccatgcaaacagtgactgaaagagagctgactacactaatatcagtatgttgtgtgtcagacccaatagattttttttaaataataaaaccgcatttttatgttacaagaagattttatataatatctgcatgatataccaattttctcataatctcttctgtaatattatttcattaacactctggtccacagcttgattcaacaagatcaggagggcaggcaggaggatgttaaaagaaaggtactgaggtgtaaaaggaaccaaacatttactgactcaggcacctattcttgatttctgttcacctgttgccttgaacaaactgcctgagctcatatgccttacctccataaggagcatgacctttgggaatttaccaggtcctcatccctgtggactcagaatcttgcttggtaagagtttataattgactttttttttttttgagaccgagtcttgctctgtcacctaggctggagtgcagtggtgtgatctcagctcactgcaacctccacctcccaagccccagcaattctcatgccccagcctcccaagtagctgtaactacagacatgtgccatcacacctggctaatttttgtaatttttctgtttttaagtagagatggggtttcgccatgttcaccagtctggtcttgaacccctggcctgaagtgattgacctgtctcagtctcccaaagtgctgggattacaggtgtaagccaccacgtgggcctggctgacacaatagattttaaaggacaataattttactacagacaaaaaaggacatgttgcaatgataaaaggctcaaaccatgaagaagacataggaattgtaaacatttatgcacccaaaatgtatgacacaaaattgacagaataaaatggagaaatagaaaatttaacaataatagttggggacttcactactccactttacataatggacagaacatccacaaggaaatagaagacatgaacaacactgaaaactaggcctaataggcatttccacccaacaacagtggaatacatattcttctcagtgctcaaggactattccaggctaagccatatttgctaggccataaaataagtttcaggaaaatttaaaggaccaacagcatgcaaagtatattctccaactacaatggaatgaaattagaaattaaaaaaaataagaatttagtaaattctcaaatatatgggaattaaacaatatactcccaaataaccaataggtcaaagaacaaagcagggtaaacatacatgtatatccatattaatgaattaatttaaagaatttttagtcacattatggcttaaaaataatttttcagtattgtccaaataaagtacctcattgccatgatgaaattggatacgggagatgttagcttgctaaaaatgacatataattattatgtaagagggacattaaaaggctaacaattaattttgaaggattaacattcttattttagaaaggatgactcctgttaagacattcttgcctatgcatacctgctgtttggattttctttctaatggaatagactagtttatattactatctatcttattgacatctcaaagcccttggtttaaattgatggttcagttagacaaaatcttaacttacaaggaaaagttgtttatgcaagtgaatttagaaatttagctatctatacttttaaaaacattggcagtatatctcagtggtatgagatagtccacatctttttatggactttttgttttattataggctttagtgccattaagggaaaactatttagttactctaggaatagccaaacattgttcccagaaatgcttgtgttatgtctgtcatggtacattgttaagttcagagcacatgtgtttaggagtctcaatgctggctgaagaatggaaaggacttttattacaaatagtggattttatttaattttgaatttatattaaatgatgaaaaaataggtcctgcaataatttagagaaaacctgtctcttcagggcaaggacaaatcaatattgagtgtttcaattgaattgatgcactttcaattataataatcttcatggtagttgaaaggcaggcccaagcaaaaatcatgatatgcacaaaaatattgctggaagcactatctgctattagctatctgctcatgctgtttaccttcacggaatttctaggttcaaaatcagccatttatttagaacgccagagtacccaccaaggaagcatattgtatagttttgttctgacgaagcatgtggctagaaaacaccagaaattagagttggggttacaaagagtctatgcacatttcttaagtctgagaggtttttttccttatgataattcagtagattcctataaatgactctttagtcacaagtttttttcatttagaagaaaattaaaggtatttaaataaataaataaataacatgcccattacatgttaacatgagaaacttttttaatgaaagataaacatattttcgaaaaaaatttaggagagtagcagtgtttgcattgttgcaaatagctttgatatttaacttaatacaagacagctggattttcatatctgcttctgcatgcaatctgtagcaatatgtgtttcaggttgagaatatgtggaaaatttggccttccacagataatattgctcaaagaggaagaagtattttaagaatctttgcagacaattatggagattattctataataccacaccgaaacttcaaaagtagtagttttctaaaggttggtcgcaatgtagaagctgacaccatatcaataatttttaatactcttattacattaaaatttgttggtctatcttgcactttgaatgggctttttaaccatgcttgatattgcatcactcactggtcatttggaaaaaatgtgtgtcactaaattatacagattttccaaatgctgacacacttcattgtacattatctaacaaaacactttcattaattacaccatttatctcattagaaaattctaagtattgacaagatatcatggtggccaacgcacaatttcaaaaatttaaagttttccttgaaagttctaattttattagcaacaattactctcagttattttccttaccgtgacaggcactttgggttcatttttgataagttataggccaaatactcaggtctgaataatcagttaattgaatcattcaagtaaaaatgttttttctgtttttaagaaaacagctagtttggcttgcaactcaaacaattgcacaagtacctttcctcaggacagacattgtgcatctgtatgcagcaggaaggctttatgtgcacgtcccatctcatcacacagaatattaaaaagatgcatgcccaacagttgacattcaataaaattaattttttcctgtttcatcaagaatattagtaaataaaatatatgttgtaggttttttcctaaaggtgggggtacagttttaagggatacaatgactgtaaatacactgtgataccactgccttgattgttgataattgacagcagcagttttacctgccatcacttctgtaccatcggtgcaaatatcaacacagtgagaaaacatataacatcttagtcttcttatgaaagtcattttgatgcccaagagcccatgtgccatgctttttgagaactagtgctttatttatatttatgatggagccatccaattttagagatgcaaaaacattaggtacataggttttaagaattttcaaactgagaaaaaaaaattacaaaaatcacatatttaggttttaacctgacttctgtgctgttcagctgtgaaaataaaaccatgttattaatataaattgtgaggggaccagtctacagcttctgtactccaaagtacattttgctaaatcaaggtcatatctaaaagacatggctttattatgatagtgtagtttagaaacattaaaacttatttctaaatttattttaattgactttataatgtataatatgttgttttgaaacatgtatacattgtggtgcagctaagttgagataattaatttatgcattatctttcatactactttttttgtggcgagaacacttaggaatatttctcttgcaatattcaatactacaatgcatttttattagctatagtcaccatgacgtacaatagatctcttgaacttattcctcctatctaaccgaaactttatatcttttgaccaagagctccccagtctcttccccacaacactgttattagtacctacccttctactctctacttctatgagagtaatttttatagaattctacctataagtgagatcatgcagtatttgtctttctgtgcctggctgatttcactgaacgtaatgccatctagttttgtccatgttgttgaaaatgacaggatttccttttatttgttaaggctgaaaggtattccgtgtatatgtatacatcacattttctttattctttctttattgatggacacttagtttcatttcatactttggctgttgtgaataatgctgcagtgaacatggcagtgcagatatctctttgacatatttacttcatttccttttgatacatacccagtagtgggattgctagatctcgactggaaatattttgtgcttctgcttctgtccttacatagctgtttatgatagacaataaatattaggcagatacctaaacactcttaaaataccaacaaaaaaacctgtgacaccattcttatagtatttccaattttactctttctttacatagtacttgatagaatgctgagcaccctgacttaacacaatcttaattgatgttggtgctactcagttattggaataatttaaaatgtgcctttcttgatcaattagtattttcattacagctcacttatttaattgatctaatgaaacactaagcctattagaatgtgaagaaatcaaagagaaatgtagaaaatattttataaaattcatctaacatatccactgtgctgtgtattttgcagctattttcaaaaagtttatgtccatgtccatgttttattgacacacatacagtcgatacatacattgcttgagatgatagtttctttgatggctatatcttatttctcatatacctgtaatatttagcacatagaatttgcatgaccaaagtttgttattagtttgaattttaaattttactttatgggcataagtttatgaactcatttccagctgagtttaagagttttcaagtgccagagaggttgcaagaaccaaattaaaaaaaaaaaagttgttgctgaaaattctctcttaggctcaagagcctcaattttcaaatgtggttgattttaattaaagtttaaagagaaaaagaaactattggaaagatattggaactaaataattcacttgtagtgaatagggagtttgtggtttgagttaatagtattcattacactgattaaaggcagtgagccattttgcccttgtttattttccaagccagtgtttccagtaatggggggtggctggtatttgatgttttatgtaatgaggtatttactgatgggctactttgacttctctacttaaatggataaccacttgaaaggaactgatcagaagaacagtttcttttctagagctggaccatttattccaaactcagacagtaagaaaacaattgaatagcttttattgccaccagctgtgctgtggttatttgaacaaatggaagactaaagtaatggtacaatctcattttatacagcattacacaaaatcaggattcttttgcctaataaatattgcatttatagttacttagatttccatcattatgatgagtttgctgccctttgagggttaataagtgggtctatcaaagttaagtcttctggaagttcagggaatgtgctgcttcagggcttatagcaaattcatgattatttgttttgcagatatacacacatatatacatacacatatatggaatatgtaacgtggaatatatataaataaaactctaaactttgaaaaattatagttcctcaaccaggaattctagtgatttgtatcacttggctactctagggctttggaaaaaatgagaagtgggtgtttaaatgttttaagaggtaattttccaagcaattgagcaggtagttaaaaataccttgttttcatttccttgcctgagaaaatcctaaagtctaaaggtttaaaagagagtagaaggaactacactgaattgggcctgaagtgtatgcaccagaaaagaagaccttcaccactcaccagtctccagagtttactgatcagtatatgaagtcattgtgttcgaaatatgagcatgggaagctgggcatggtggtgtgtgcctatagtcccagctactcaggaggctgaggtgggaggattgcttgagccctggagttggaggttggagtgagtcatgattgtgccactgcactttagcctgggcaacagagggagaccttgtctaatacacatatatatacgtatatatacatatatacacatatatatatatacacacacatatatatgcatgggaaccaggattgcctcctcctagttgggctgcctaaatatgtagttgcatggtgattgttggtgtgccttttgattcttataacttattaagtgttatcattgaggtgaaaagatctcttgagtttgatagagataagcagtccacacaaaagggctagacaggggtttctcaacctcagcactactgatatattgggctggataattctttgttgtaggggcctgttgtgttcgttataggaggtacagtcatatccctggcttctatctactggcacactcagcccacattgtgacaaccaaaaatgtctttaggcattgctagatgtccccctgggttggggcactgtgtagtggcagaatggtccttgttgaaatccactgtaatagacagtgaactcctagcaagtggtattggttctcggtcatctgtgtatcctcagtgggatatcttgaaagggcctggcatggagttgcttctcaataaatgtttgtagaaattaaacaaaaaaaaaactgtgacttagaaaagaaaggggatttcttttcctgttaccttctctgccactgatttcctgttattggtagaacaggcatagaataaaaaagttcaatgctacattacttataaaaagcaaaagctcagaaaaacttctggatgcttaataatatagaaaaggccaagtacattggtactttcctttgtgggatatggtacatttcttttgtgggatactaccttcataaaacaggttgtctatcaaaagtttaaacgttattttttctgtaaaaagttaggctataaacttacataatcatctgtttttaatatgtatgtatgtgtatacatacgtagtatattatttcttggtgaaaaaagagtaggaggaaaaatgctaaattattagtcatggttgcttttggtagtatgattacattttatgtgcaccttctgactaattattgagaagatgccttctttttctttggtcttctgacaagctaaataaaaccaatagaaaaccagccaagtctgagtgaattttatatcatcattggaaatggattttttcattttttaatgaaaagaaaaataaataacaagttaacaaaattttccctttaattttattattcgattctgtgtaacattgttaatttgcaaaaataaatttagcattaaaattgattctgtgtgctaaacatagcctggaaaaaatgctcagggtatttagtaactactatatggaagtttcttaaaaggtagaagaaataatttctacaaagtttgtctgtattgcaaacattgcagtgtaatattgattgtttttcactattattccttgtgattatctcatggtaatgctttcttgtagaacgtgtaattggggaagaaaacatagatgttgcaagtgtacagtgtgattttaaaagaattacctgttttcaattagagagataatgtggctatatacctgtatgtatatatactctatgtattgatttgtgtattgaagtgagattgtaccggagctttttgtgaaatactcccagctgtcttgcctaagcacacattagatacatacattttagaaggatccataacttagaacattagtggttcccagttttcctcctcaccatggtgttggactgaacagcccaagtggtatatgtattcagcctgccatatgtttcagtaagagcaaacatctggtaccagtttcccccttgcttttcttgatccagctgtatagactaactttgaatcttagaaatgctgcagtcttccatttcatgcatccctcagcatgaagcacattttttttcacccgaattcctacatttttattaagccttagtttgaaagcacttcttcaagatgggcatttcgtgatgccttcttccttggatgctaagttgtgctcctgacaccccatgcttcctttgcagcagcattttaatacaggatggagaaccctcctttgatacctgccttctgcaggaatctataagcttctgtgaaggcaaaaatcagtcacgtcctgttcaccacagtatctcaggcatctaacaaagtgcccagaacattgatagcatttagtaaatgatgaatgaatgcatccataaatgaaggaaggaatctgttccaacatctttgagaggaaagagtcagaagcatcaaaaattaattctcaaataatagagattagtacaatatttgttgaacaataacagccattgaaagcgcattcatcaccaatgtactgatttggaaatgtgaagttttggaaatgtgaattttagtaatatcatagattattatggaatggcagtatttcaaatgtttatgttttacaggatgagtgctaactctaccagcaattatagtattaacagtttcatcaaatattttccttgtttctgaatcttaccagttgtgcataggtgctttcctatttgaaagcagcgcatcattcagcctcctgaatgtatttagaccttgtaagtataattaactctttcttgacgggggcatatttaagattttttaaaaaatacatatatagtgtgttgcagcaaaacctttctaagaaggagtcagtaggatgtagggataatttttttctacaataaatatttccagaccctttatttataatcaatatatgaataaggaccactaaatttaaaatgtttaatgagatgtgtatagaaggatcaaaaagatatatttccacagttacaaaatgcaatggaagctgtctctaacactagctatcgaaataaaagaaacctcgaagtaggcctaatcaaagattcaaaatatgttcatgtacaaaaatgatttttaatgaaagtcatttaagaagatttaaatcaatggagaaatactatttttatggattggataagtcaatgttataaatttgctaattcttttcaaattgaggtatgggttcagtaaaattctaatcaagaccttaacaaatttttaaatagaatttgacaagctaattctcagatttatctggaagagtaaaggtcaggaaagaaaagacaaatttgaggagaaagaataaagtgggaagaatggcattataagataactagactactgctactactactactactactactactactactactactactactactactactatttcttcctcctctttctcctcctcctcctcttcttcttcttcttcctcctcctcctcctcttcctcttccccttcttccccttcttcgtttttttttttttttttttttttttttgaacaagacaggatgtctgttgccctcgctggagtgcagtgacatcataactcactgcagcatcaaactcgtggacttaagctagccatcctcccacctcagcctcctgagtagctaggactacaggcatgccacaccatgcctggctaattgttaaactttttttgtagatttagggtctcccttttttgcccaggctggtcccgaactcctggcttcaggtgattctccctccttggcctcccaaagtgctgggagtacaggtgtgaaccactgcagccagcctagacttcttataaagccataaggtatattgtgtatagcaaaatagaccagactggagagccagaaaggactaatttacacataatatatacatatctgaaagaggtgtcattgttgatcagtgggaaagggatgagtcacttagtaaatggtgctgggacaaaagtttgaaattgtatctttacctcatgaaagcacaaaagcaattccagataaattacaaattaaaattggaaatggaaattggaggatatttgtgtgatatagggaaggacagtagtttataaacaacattttaaaaagcactaatctcaaaggaagggattataattatgaataaaaatgatgaacattaaatataacaaagaattagcattcagaataccaaaaataatataagtaacacagtggaagacgggacaaataagaatagttaatcctaaaatgaaacccaaatgtctactaagcagccaagacaaggattagggaaatgcaaatcaaaactacactgttatacaattttacgcatctatcatattgacaaaattgtgaagttcaatgtcaccaggtgttagtgaagatacggagcagtaggaaatttcataattctgaggaatgtaaattggtgacacctgggagaaaatttcacctatatatgtagtaaagtttcatattttataaggacccagaaattctatgggaagtataatccctagggataccttctcatatgtatacaaagggacatgtacaggaatatttattcgggattgttcataatattaaaaaaatagaatcaaagtgaatagccattctattagttcattttgtgttgctctaacagattacctgaggctggataatttatttttaaaaatagttttatttggctctcaattcaagtggctggaaaattgtctgcatctggtgaggtcctcatgctgcttcaactcatggtggaaaatagaaggtaagcaggcatgtgcatagatcacatggtgagagagaatgcaagagagcaaatcagaggaagccaagctctttttaacaacctgctctcaggggaatgaatccattcttgaaaggccaagaactcactcacccccaagagaaggcattaatctattcatgaaggatccacccctatggcctaaacaccttccaataggccctacctcccaacactgccacatcagagaccaaatttcaatatgagtttgggtggggacaaaccacatcccaactatagcagccatcagtaggaaaatggataaataatttgagatatttttatgcaatggaatattatgtcggtctgagaaagaatgaactagggattgacatattgtcatggacaaatctcaaaaatatgtttaggaaaaataagttgcagaaaattattatactttatcatttatataaagctgaaactatgcataacactgctatatattctttaaggttatgtacatatgaaataaaacacaaagacatgcttcagaatgataaattcagaatttcagaacagattatttgtggggagggatgcaatgaagcttcaagtctatttgtaatatatttcttagggatgggggctgtgaatgccatttacgtgacagtagccccaaatttgtatgtctagcccaggcagctttcctgaacttcaggcatgtatatccagatgatctggtagccttctagaatggccagactgaattgctagcatttcagcaaaattgctctacacacagtgtttcccatatcaattaatgacacttacttctaattgctcaggccagaaatttttgaaaaatcattgaatgttgtcttttcctcatgccctaaattcagtcagaaactcctcttgtctgtaccttcaatacataaggagaggcctgttattccttctcactttacagctaccctcacagatctatatcaccacaatcttttgcttagattttcaaaatagcttcctaattggcctctcagctttcaccccagaaactcttcccagccccaccgtttattcttaacacagctgccagaatggtcctgttaagtatgaatcatgttgtattactctttttctcaaagcccagcagtggctccctatttctcttccagaaaaagccaaagtcttaaaaggcctcaaaggcgctgtgtggtatggtccttgccatctgtctcacttcattcttttaactctccccttcgttgaattgctgtggttgcaagagcctccttgatgttcactggacctgcctcaagtgctcccaccagacatattttatccttgagcttttctctcaatctgcatggtcaagtacctttatgggtttgtttacgtggcctttcccttcctcgggtgttttctcagaagtcaccataccactgagcccttcactagccactctatttaagattgtaacactctcattccatgcttcgtttttgtttatagcacttcctattttctaacatacctgtcatttacctctgtttagtgtacactctttattgtctgcttcccatgataaaacataaagtttgcaaaagccaggatttttgtctgtcttatccacaggcatatccccagcaccttgaagagtacaggtatagtagactctcggtaaacatatgtttaataaatgattgaatgaatatgcacttgtttgttatgttattctgtgtatctataatgtaacaatttaaagaaagcacctggttgagaaagatgccatggttcagtggtagatactaaaaataattgcaatcatagtatacatttttatcagattttatatctattcttatactatagcttgactccatttttaacctgtatgaaactaggaatggaattaatggtaggccaggtgtgcacattgaataggtagctcagagtaatgaaggaaaaggcaagaaagagctttcccaagagcaagtgtggtattgatacagtatttcctttataataccctttaaactcttatatggaaccttagaaaaacacaaaacctcctattttctacaaatacttcagaatgtcttgcctaatgcattcagtttgtgtcagcttcttgatattattttaacacatctttctgtaattgttttttaagtgtggcactcgagttttcaggagtgttctgagctgtgattgatcatcatacatgcattttgaatagggacatctgtctctgcagcatattatgtctcctgacatgccatttctcagcttgacagagcacctctagagggcataggctttaataagatagaatatgtgacttttttttacttccatagacagtgagtggtgttacattttataatgaaataatgaatagctgaagtgacagcttacccaatttgcctttcttcgtgagccaaatataaaactagaaataaagcttattcattttagcctgtctaatatttacttcaaaaacattttaataggacaatatttactaaataagttttcttgtattcatagttgacagtgacaaaaatggcttctttgtctttttctcctaaatttttctctttttatccttatcattttttctatacctaaatttttcttgcatccttttatatgagcaaattgcctctaatcttgaaacatatagtttattaatttgatttgaaatttattttgatgttatttttaccagtcattcagtaatcatagatagttacattgttaaaaaaacaaaacaaaacaaaaaacaaaaaaacaggcacaaagctagatgaatgagcgttgtgtggactctgccctagaggagacccaagtttagtgtgagaaggagataggaaacaatgataaagtttgtgcactccagaagaagtaggagcgatcgcctgcggcactgaagaaacagtggcaggctctgcttggatggaggacactggccaagtggtcaagctggcagagaaggcaactgatccatgtcttaaaaagtgcatgtgcctttaccagcaaaaaggagacgagatggggcagacaagcagagcagcaggtgcaaattggaagagtggaaggttttggcctgttgaaagaaagatgaaaattacttgtacctggagtagtaggtgtgcaaggtgggaggaggaggatgacagatgaagctggagaagtaaatttttatttatacgtagaacttatagttcttttcttccattttgatattgtctgcctgactcaagtatcttattttacacccacaactgcaaatatctcccgtcatttgaaagaagacttactggaagtcattttcctacctcattttctcatttcctgacaacttctttcgactgtcttgattaatttccaaatatgggaatattttcaggtcccatggtcaaagattttattaaaaagtcttacctctgattcagctaaatggttagtcaatttactaattaataggaaatgctttgtagttataggtaattaacatgttaatagtttaaataaaattgattgattcttctctttgcttggttaatttaactatcccagagatcaagttttaaaaaaacttgttatcgtttagctttatgcaactaattaccgttagtcctttaccatgtctatgtcattgcacttgcttcttcagctagtgacatcagaaccttcacttcactagcaacatcgtacaaacaagaggaagcaccatcttgaacttccacaggaatctcttcctttcggaagtattttaatcattacttcaccagctatgttccacttctggatattttggtaaattttccgagcatttagaagccacatatcactcctttcagttgcaggaaattggccttttatatcagaacactgtgatctgtgaaatgggtactcagtgactttagaacacgtcaagagattagcttcgtgtctagagtctgcctaaacagttccaaggtgagatttgttatttcacatttagcaatgatttaaaaacaaaaacatacgctttgaatggagtgctttattaaaataatggaagaacatggtagaggaagaactccctgggaagagtttaaatagtataaatagctttgctgagagagcaacaaagttctgtattgtgctgttgccacagcagcaccaataattcaaaacaaggaaatggagtctcatatttaatataatacagacttttccctagaacttctgtggtctagggtttttcagggattggcatgtttacatatgtctaaatttagacatgccttttatgtaatatgatgaaagagaagtacttaaaattctatatgatgcagttatttcttaaactttttttttgttttaaattgactaaaatatcaggaattttctgtgctgaagtcaatgccccaggacattgtgaatttatgcatatgaagggagacataatctcttatgcaccccacatttgattttaaaagatcactttgaaaagtatgaagaggtgtttagtaattcaaggaagaaaaataatttcttttctattgaatattctattgaacattctataacaagagttttctctgctgtggaagtaggtactctgttctgaaagtcaggatctggaaattcagaaacacagatacggacgtttggggaattttaaagtaaattttatatgtcattttggaaataaattagaaagatatcggaccaatctcaggcgtggacagaattcaattcatcattcaataaagtacaactaaatctctaccaaataacaaaatccagtcataataaaagctcgcttacgaagaaatgtttgactgtagcaaactgctttttattaaacgtacttgacacaacacaaggagatggcagtgtgctttccgactttcagatttttgttgtcccaatgttagttcatctcacagcctgcctggcttttccaccaccaattttatccttgttcttactaaagagtaaatttgtaggcaagtttgattgttatgagataagaataaatgaaatggttagggaaattttcatattttgatcttttctacccagtgacatcatgatgaagatgatgcaaaaaattggtcagatatatatctagtatgaatgtgtgtttgtatttactttttttttgaggcaaagtctcactcttgttgcccaggctggagtgcgcagtggcgtgatctcagctcactgcaacctctgcctcccgggttcaagcgattctcctgcctcagcctcctgagtagctgggactacaggcgcccgccaccacagctggctaatttttgtatttttagtagagatgggatttcaccatgttggccaggctggtcttaaactcctgacctcgtgatccacccccctcgaccccccaaagtactgggattacagggtgagagccaccatgcccagccacatttactcatttaataaggacaaatattgcctagaaactagtttcaaagaggcctgattcattttttatgtaaattgaccaaatattatttcttgcatgaaagctttattaaggaattatgatgtaatttttcatttatctcttctggctagtgtcgaaaggggaattctgagtgttgaaaggggaattcttagagatgtaaaaaaataactgaattacccttaaaaagattgaaaagttaaaaagcaaataaaaagaaaatgaaaatatacttatccatttagcaaatatttaaggacctacgtcagttatgtttctaggcactggaaataaaatgaatattgaaaaagacaggataggttcgtgagacttatgtataatcaatatttaaagagggaatttgggccaggcacagtggctcacccatgtaatccgagcagtttgggaggccaaggcggaaggattgcttgagcttaggagtttgagaccagcttggataacatagtgtgactccatctctacaaaaaagttaaaaattagcagctgggtgcagtagctcatgcctgtgatcccagcactttgggaggcccaggtgggcgcatcatgaggtcaggggttcgagaacagcctgaccaacatggtgaaaccccatctctactaaaaatacaaaaattagctgggcatgatggtgtgtgcctgtaatcccagctactcaggaggctgaggcaggagaatcactggaacctgggaggcggaggttgcattgagccaagatcgctccattgcactccagcctgggtgacagagcgagactctgtctcaaaaaaaaaaaacaaaaaacaaaaaaaatagctggcgtgttggcctgcacttatagtcccagctactcaggaggctgagacaggaggatagcctgagcccaggaggtcaaggtgacagtgagccatgattgttccactgtattccagcctgggtgacagaatgagaccctgtctcaaaaaaaataaataaataaataaaaaagaggggatttggataataaaataacttattgagatggtctaatattgttatgacttcttcttccatttaatcatttatttaggcattatttatcatgagcacatcaacatttgtatctgcccttttcttctttgttcgcttaatgttatcttttccagtttctcagaaggaaaaagaattaaatgaacctcacatgtgatttgaaaacagagatagtatccattccaggcctctgttttattttgctcttcccctctccttgacactttacttttgggcagatgtgcctgaggaagacttagtgtaagatgacacaaggtggaacagagcttagtttgtgagtctgagaagacttagtctaagatgatacaaggtggaacaaagcttagtttgtgagtctgaagcagaatcaggcagtgataagcagtgtgtttcctggaggatgataaactttctatatgatgaccttgttttatcgtggtattagtgagcatcaaaactattcactgacttatattcatatattttctcaagaggaggaaaatactgcatgggttttgcagccagtcttcctgttcagatttactctgcttaagtacttaatttaagagagagagagaggttgacaaaggattccgtaacttctagtcttcaaatgatcaaaactgaggacctggtgaaggtttcaggaaaccacttctttaattgattctctttccatgtaaaatgtatttcaaaggataatagcctacgatttgactccaaagcttcagcgtagaagaggaattcttctggctgaactatatagctaatgctcaattaccttagcttctattgaaccgtattctaaacaccttcctttgtaaccatcaccttgtgcagaagtctgtatttttagcctttaagcagagctcaagtgctgtatttagacatctgacttgaagactaaaatttgctcagtgagcagaacaaatgttcagaaaataacatttcaaggttagagttagtgtcctgaataaaatcccttttcttctttttctccgtattgaatataacataaataatgtaccctgactgacttttaagattaaaaatcagagaatacagtgaacttggaaagggaagagaacataattaaaaattgaaggggcttctgttgaacaattgtttgcctgaaactaagtacacgttttattcttgactcaataggattatggatcttaaaaggatttttaaaactatatagtaaagcgtttagaaaaagggcctgaataagcctgcagctactgtaagaaatattgaaagaaacacacacactcacagaatcatcataatatccttcttagtatgaggaggaaaaaactaaatactgtttattgctagtagttacagtaattgtatttaccaggttttgactgtctacaatgtgttagtcactgtgcaaggccctatatataataaaccttatttaatattcacagcaattctatggaataggtattataaatcccgttttgtaaatgagaaataaagtccagaaagtttaataacattcttaagattatatagttagtaaatggaagtatattgtgaatatttctcaagaaaatctcaaaatggtgcccaagactccctgtccttgagaaataaaaacattttacttcttaggggaaatagatgagagtgatacgttgtgattattattcttaaacaagacaatgcaaggtcccgggacccttttttgaaagggaaatgacatatttgcactgagggaaagtgattatcacttgctgagcatttccttaagaattctgctcacttggattatgtgtaatttggtgaagaatttatccccatgtattccatgaggcaaaaggatgttgcaattgaacttcacagtgcatccataccaatccaccgggggaaaaataataaatgagtctgggtactcccttctcttggccacatggttgatgttgtagtcttcactctatacagccagtcaccttgtgaacagaactagctagagcccaggactatttgattgattaaagattcccacccttaaaattaggactgaaagacatgttagaaattctgaatatgttttaggccctgcatttgaaaggtaataaatagggtatgtgaaactctttgacctttttctggttctcagtgccttgaaatttctatctcaattttgtagatactcaacactctaacccagcaaggggagatatttcatagtggggcatagtaataatataagaagagtgtattagtctgttttcacactgctagaaagaactacttgagactgggcaatttaggaagaaaagaggtttcattgactcacattctgaaggctcaacaggaagcgtgactgggaggcctcaggaaacttacaatcatggtggaaggcaaagaggaaacaggcagcttcttcacatggtggcaggagggagcaaagggggaagtgccacacactttcaaacaaccagatcttctgagaactcactcacaatcaagagaacagcttgggggaagtccacccccataatccaatcacctctcaccaggcccctccaccaatatgtgaggattacaatttgagatgagatttaggtggggacacagagccaaaccatatcaaagagactgagtaaagcaaaggtgaattagagatttattttaaatgtagtggaataccaagtttatgtaaagcagaaagtttaacagtggtatggctattatttggtgaactgattatcattcttttttgcataataggttgtgagtacccgtggcccaatggtatcttaattcttcatttgaaattctaaaggtttgcatttcatttttgttaagcatgttgcattactctaaaacagattttaaaagaaagatactgaaatataattccatatagttactgagtcattgactttttcagaactcttttaggtaatcacccttatttatagatgggaaacattcagctgcagaattaaatgatttgctcaaaaggaaacaggaataaatggcagaatcaaccacctaatactttggatttttggaaagtattaaaaataaacaaatcagaacaacaaagttctccatttctttgtttgtggagtattctcccctctggccccagcaaaagaaaaagttagaaaggagatcctctggaagttaaaccaatgtgtttaaggttaaaccctgcctcatgtcacttgtacaatttacacaacattcatttccttaagtgctaccataattttgtgaatgttaacataaagaagtccaggaggccaccaaattgttcccattggcttttttgtgtagtgtaggataatgaggcaatttttgctttgtctatatatattttgtgtattacttgattttatgatcatatattgtttgtgtgactttacctttaaagtcaatagaattataaatttaatttggtatttacaacacacatatgcacacacatatgtatatattttttcatcaaacattaggcaaatgatggttacatgaaacatgaaactctgggactacttctgtttcacaggttcagatcctgtgtcctgacttttggttgagaaaatataggctcagttaatgtattcagttgtgtgcttttacccaattttccattatctcctatttcatcttccaccaaagtaacttcagacaagaaaagtgtgtttgaagactaccacgggttaactgcctgtattccattataaaatctttgtatatcgtgttagtctttggttttgtggtcaggatcgactataatgaattctggttcttgatttaccaaatgtgagaacttggccgatttatctaatctttgggtaaattagtctccccatgtgtaaattaggaatgagaaaacttaacctttagggttgttgtgagaactaaaagagctccagtttgtccagtgcttggttttatagggactagatacaggtagatttctttcttcttcatttgatttaaatccaacactcactcttactgttgtcccaggtaaaattttaaaaattcattttgctataagtcagacatgattttcagcactctgatttaaaaagtaatgtgatttcttgtggaataactaaaataaggacccaatgacagttgtttccacattaaagttgggtggatttcacctaaagcttctgaattgccagacaagcttcactttatcaaggagaaaaattaaaatccactaaaccaaagtaaaatgaactaaaattccagaagctaaaggacaagtaaaggacacagtcttcacactctgggcttttcttttggtgttctttccattgactgtgggataaaatttgggggaaattgtgagggtgtgaatggcaagtgtatgtttgggttctaagacttgggtcattaataccaagtcataatgtatatttttctatcccctttcttactcagtattgttcattttttagtgttattcagtattttcagtatcatgatttgtagaaatttttataataatgacataattataccataatttcttttactattttccttatattgggaatatacaccatttgcagttattcagtgacactttaaagtagcagtgtgatggacattcatttacataaatcactatccacatccttgattttttttcttttgaaatgattcctagaaatagaatcactcttaaggagtgtgaacgttttaaaagattcttgatatagtgtgacatttttttccctgggaaaggtgtaccaatttacactcctaccagcagtgtttttcacatcatgtgcttgtcattatctattagcatcaatgatatatgaaaatgttaatgtttcataatttacatttacttgcttaccagtgaagttgagtgttatgtcttatgtttactagagaagacaggcacactggaatgctccttcttttcagcaagtacatatttagacactttgtgttccagtggtagtttttctcatttatttgaatatatgtcaataagcaaaatcttggctaaaaataatcaccttagcactaaatttagtcaagtgtcaaaggcattttaaagagactaaatttgggatgcatctcagaaaaacatactgcatgatactatgctaatgagattttctttttatgctgggcaactggtaattttgttgttcaccctgagttccccaacaatgttgaactagcaattttcaaacctgtaaacatttgcttttgtagtcaaaattgaaagatacaattgaaaggaaagatttagttcacaaactgtataatcttctgattctgcagaattgaaatgaataaacttgaacacatatttaagaactcaagctctagtcagcatataacttaagagggaaaaggttgaatttcctttcaaaataagcaccgtgcatgaccatgcttcctaagaaaaaaagaaaaggtaatatctctaaaaattgtatcatcattattttcataccagttaccatggttcaattagtccctctctatccagtctagtggtacatttttctaaattgtgaaaattcaataataattacatatatagtaatatgtatttatataatattatataatatgtaaaataataattatagtttatataaatgtgtgttttaagtggtcttattatgtatgatatttcaaggtgtaagcttatttttcaggatattgtgttttggtacctaggaggatcagctttgaatcatttctagttacatatttctaatttgggggaaaatcagtttttataggaataaaatgtggtccaagtctttagcagagtgaaggataagactgaattataaaaagagaggtttaataaagtattttttaagccttagaggaagttaataaaataattttattgaattccatcatgactcatcttctaatattaattttgtaaataggaaaaaggtaattaaattactaaagcaccttcattttaaaggttaactttattattattgctcataggaaagtttattttttaccacttttagaacactaggtctttttaaattgatgcacaattcatttgggtgctttctatgacacgcagtcagacttgcctccttcctgtgtgggctctgactatctaataaaagagataatgtaatgacttacatatctagaacacaaggtaatgattccattaccaggcatatccctgttctgatttgcagacagtttaatttttacatctgatctttaactagtgcttcagatgaagcagaactgggtatttgaaaggaatttaatttgttttgcccattttaatggtagttttttctgagtgtatttaaagagctttttataactaccatcttccaatttttaaaatggaaatatattttctattgcttatttttttttactgcaaagccttatttgtttattttagaaaaattagaaaatactgcaaagaaaaaagaaaaatgaaaaaataatatattcttagagaattctcattaacatgttggcagatactccagtttattctatataattcctatatacaataggggatcaaagtacttgttacactgaataccatactctgacattacatattttgtaaatgttgttatatgtttttgattgagcaaccagtaatcatgttagcctgaagacaaactttgcatagttcaaagagtgtttgccaactcttttttaaaaaggaggtttcacataaaaatccagatgtccaccttctcttgatagatggggattctgtgctgctggggctcagaatcctggttggccacagttgagagcagatggccacagttggccttagccagccagagcatgcactctgcattcagcgcattcctgccctggtctccttcacatcttgatgtgcctacctgactcccaaagccagctgtttgaagggtagtagtttgtctagggtagtgcttttcaatgaggctgtactggcccctaagggaagactggaaagtgttttctggatgccgcaatgcttggagagcactactggcatttagtggactgcagtcctgttatgtgagaggactggacccggaagttgtgtcctgcattttcaacaatccctttgggtagtcatataggtgaaacacctgtttataattatttgagcctggaaacaaaactggttgcacatataaaaattgctttaattcaattttagtatacgttgaatttcctaagactacagctactgtataatttcaggtaaaattgttctttgctttggaaggtttactgtgcattgttcaccatttggaaaaccatgttgctgacaacaaggtggctcatggtatttgaataaccaacacagtgcagctccatcagtgctcatttgtagcacccttgttcaatacaacaaaaagcaaaattaacactcctttaacattttttatgaataagaaataaatatcagatcttatgagagaatattaattcttctttgtgtgttctttacttttaccatctataatttgccttggcatgttatctagacttcagttactcttattttccttttatcacttgcctgtaagcctgctttattgtttcttattctaatactaaattttagcctaatgtccatgtaaccactcaaccctccagtctttcactttcttactcttcttgaaaaagtactggctgcttattacttctctttaattcatatttacttgttggtagtagggcaggcatcagatgacttcctcaatatgtaagttatgttcatgcctggagcactttatgattaaaaagaatattatgtatagaggttgtttgtataaactatgagctttgtgttaggttagtaaaagcggcattacaaaatacttgtttttaaaagtgaagctttgtgcttgagcagcttaatgctctaggtgaccatcgagaatatacattggtcctaaagaggcttacaggcttctagaaagacattacatagaaataagttatgcctagactgagaggatgatgaaatatgctccaggatttcagagaggggcaagtaggtgtgtttgaatggatgaggaaggcctgtggatgaagccgaggaggtgccaccaaacctagatgcttggggaagctgttaagagttttggagaaggggacaatgaagcaaagttctctccctttctttttcacttccccctcttctttttcttctagaactgtgtcttttcttctttctttcctgaagatgcaaaagccacagatgtaagtgagagggactaaagccagagtcatgactatgaagtattgatttcaggtgtttgttctcaccttaaactcagaccaaatataaaaatatgaccttgggggcttagaattgtgcagtttttgttcttcaagagaaactattggagagatctcagagcaaggcattgcttgtatttcccttcagtgtagtacttagattttcattttcttagatctaattataaaagagacttaggaggtggaaaataaattcaataagtcttcaaagtttttcctttctttattttataagctaagtatcactgcattgggggtatactaagaagggtatcaatgacagaattgctagtttcctcaacctgcctcagcttaccaaatttaactctttttgtgaaactattaccacatgtaaatatattttaaaaattagaatttctttgaagaaacattttcctagccaatcaaaagcaagagctagtgaggcttcaggatgatttggttttcagactttttttttctaatgccacaatccttagatatggtgggaaaggcacttcaaagtgagtactccagatttaattcaaatgcacccatttaagtagctcagaaaattgcatcatctagggttctggagtgacagtgttttatatgttgaaatcttttggagtgggattgaaacagcaaaatcattttatttcattaaaatcggtctcagcctcttctttttcctctcattcaccgcaggcctttccatctaagaaacaattcatagctgcttcttcagaggatgtctaattttccctcattcagagggacacatttggtactttgccctgtgttttaattagtaagcttcagagaaagaaagtcgtcagagccagggcccccagttgtggaagtttctatatccggtaaattggatccattccagggcagaatcatttatcaacaaatgaaacaccagccacttcccacacgtcctctgattgcattaaaaaatcactccccttcctacccaaattgagtatacttagagtatggagctgacaaacattctctttccttctcctcctcctcctcctcattctgttgaattgctggtttctgtagtctattaggcttcttattaatagtaataaaatgttcattcattaactctctcatgcctgcataccagctatagtaactgtctttgcccccaagttatgcagtctttataaagtcgttcagtagcagggcaatgagttgggaaaactgatattgcatctgtagcatcaggtactatttaaccagtgggagggactgataaaattagcaagttgactaaccacttcccttccttgtggctctttaatattataacggatacagaaaagttcagaaggactgagctagtttgcgaaaccacagcacactttggcaaagagggaatgcacaacaaaacgggtaagtttctttattttaatcttttaagagaactgtgaaaaagatagtggggtagatgtttttaagtctgactctgcaaatcgtctttaataacttgtaggctgtggaaagataaacttgtcatgcggagggaagcaaaaggttttccaatcagtaacagtagcaacaacaacaacaaaaattacattgagcaaaaaattcaactctgagaatgcctttattatttcagatagacaagactaaagtattttggggagagggttcttgaattaggaaaaatattgatgaataagttcctgtactctgattttttgaaatttagcccggaattgtcagcaggggcattatctactgaagctgaatgtccgcctagatcctgaaacagcttagtcttctgttgtcttctttgtggttgaaaatgtttgttgcttttaactccttgattatcaaaaatttcaaacacaagcaaaaatagagtgaatagtatagagatttcccatgcatctatcacatagcttcaacagctatgacttcagagcccaggttgtgtaatccacacctctgtggtacactccctccttcaatctagttgaattgcagcattttgaaatatgcctattgtgaacattaaataaaagaggcctaaagtttcctaaaggctcataccagctcagcaatataaagtttagagaaatattattacataaaattgaattatgagtcatagaaagcacaagtgagtttccactggttgttttaccagtgggagcaggagtagaggatagtagatattaagactgtagtctctggagccaaactgtttggggtcaaatttggttctgtcacaatccagtatccttaagaaaatttcttaacctttctgtgtctcagtttcctcacctaaaaatgaatacaatagcactgatctcctgagcatgagggatgatgaaccagtgcatgccaagactcagaaaattgctgggaacatagagtgctcactgtttgttagccctacaactgttggtcaaaattattagagtgatggtagggttgtgatttgtccaagcagaaagccaaaggttgtatctgagcatattgggctgtcttctgaccattgcttttctcctgattattttataatgccaggctaggaaaagtctccattgagatatcttgcttgcttttgcaccctgggaaaactccttgctcttgctttcccccaccagctctgaattaattctctctacaaacaaaagttatctgaggttgtcttgcccaccctctcactttgaggatgagggagtagagattggtctaagctcacagagcaaggagtagatctaatggaaaagaccctgtcatgggcttcatggactcctctaatgtctgtttggaggggcgctgcagttgggtttaggcaacactgttgggccttagaggctgcctcatatctgagctcttatgcatccatctctgatgtagaggtcttccagggctgcaagttgctcagatacttttttcattgctaatgagaatggtgaaattctgaggatggcaacaaatggatggtgaggaccttccctaagctattttttttctatactatagtaatggctgtcatttattgagcatttacaatgcacctggcactgtgctatgtggttttcttatttaatcctccctatatccctatataatacttaatattaatatcttcattttatagaaaaggaaactaaggtgcagagaagctaagctacttacccagctcataagggacagccaggattttgttccaagtctgtctgacttcttagagcgtttgtccacaagaaataggtttgttcaaacatgtgcactcgaaatgcatccgtggttttgctcttaggcttcctgaagatgaaagtcgtcagtattcctataaagcaagctgaatggaaaaccttttctctagtaatagttttcccacagtgtattttcagaatgcctaattacaagctggaaatttgtcataaattttgacaaatacagaggcgggtggggatggtgtggagttaccgctgtaaaaagtaaatattgaactgacaggtaaaaaaaaagaaatgctcttttagtaaattaaccatgcttcagtggtggattttgtttttaaggccatttgtctctcttgagtttttgtagaggagggtgaaatatatctaagtcagtttttgagaacatggagtgctgttgtaaaacaaatgataaacattgatgcgctgcagaaataaaaattggctgaatcttctgggaggtgctgaagagaactgggacatgcacagtcagacattttagaaacctggaattgacttgaagtgctttatcttttacattacgggtacaactgcaaaaatagaactgaatgtgtgaatgaagagagaggttaatttcacaactttggagttttttttcccctccaatagagtaatggtgttttaaatttttttttttcttcactcaaggggacatggtctaaaatttagagctaaaaatgcaaacatcagacataaatgattgacttgccttttatcaggcaatctgatacaatttgcaatcgttcatttttccttcgttggctacagtacttttgtcatcttgacagaatcagccaagctttacctataaaaatattggaagagatttgaaatcatatgatctttttgcagaaaaagaaaaggataaagggaattgcagctgccagtgttggggggagtgaagtgggaagggtcactgttatgtcacattcttagattcttttttttttttattatactttaagtttaagggtacatgtgcacaacgtgcaggtttgttatatatggaacccatcattctcagcaaactatcgcaaggacaaaaaaccaaacaccgcatattctcactgataggtgggaattgaacaatgagaacacatggacacaggaaggggaacatcacacaccgggcattcttagattcttaaacctttgagaaagcagagcagctctttagtactggccactgcaaaccatcttccagaattgttccatcatcttggtttttttctttttctttttgtctctaatgtcttcatctcataagaacatattcacaacctgtaaagcatggtttagggtcggaaatttctgtatttgtctgtcattagagacagattcagagtgccatttagcttgtcagtgtccacttctttgtgcagtaatgtaatttctggtggggttggtcacccacgggattactgcgtactagtgccttcatgtttacagattgttttctatcctgatctttaacatttgtcaatgcattatgtcactgctattattaaatgtaaacatttaataagttttaaaaatcaataaacattagtgcttgatttaaatgcttgatttaattattaacttaataatcaatttaaattttaataataaaatgtattaaaagtcttgaatagataaagcattgttttcccttgagatgaattctgtcttcatttgttcttttgtccatttattcacaattgcttagcatctcctgctggagatccagaaatcaataatcacagtttgtgccctcagaaaattcacaggtttggggtgaaaaagagttgtatgaaataagtgatgctatagttcacaaaatatattctaactacattgtactgtctacattgggagagagggtgtgtgtgtatggataatcccagaccctgggattagagaatcatggttcaaagcccattaccctctggttttgggtatttaactaatgttcttattccgtggtttcttcacctgtaaaatgatactgagctgctaggggtgttgtattaatttaacatgtgatacatgttaagtatttatatagcgtatcctatagtctttgggggatcaaggatagtttctcaaatgaagttaactttaaacaacctgaatggcatagatgcttctagtcacagggaactggatatgacaaaatggaaaatagttttgcctctttgagaaagagagtaaaggtcagcatggctgaaacatgtaaaaagtggggaagttgcttagaggtactggcagaatccagatcgtgctgggcctagtaggtcatgttatgcagctgcatgttgtgcaagtgcaatcagaagtgattgaaaggtttacacggggagttgcatgacctgaataatatttttaaactagttgcagagtggagaatagattcgtgaagagcaagagtagacacatggaaataggttagaaaactatttcaatagcttagtccaaaaatgatggccacttggattaaacagtgtcaggggtgtaggggcagtggacagagtgagaaatactgtataattaataggacttggtaaacaattggatgtcattggggagcatcaattatgatcctatggtgtttagcaactgggtctagtgagacgtcttgtgtgaagatgggcaaattggaaaaagcaggcttggacttctcaatttacatgcttttgaaacattcaagggaagatgtcaagtaggcataagatgtcatgtagatgttaactgaagccatggaaatagatgtgatcactcagagagatgggatgaagtgagaaaagctgagggcccagtacttaaccactggaaattccaaaatttagaagacagaggagaagcagccagtaaaggaggtggataagtcatggtcagagaaaagggaaaacaagaaagttgtagtttttaaggaaaacaaaagaaaatagcatattcaggagaaaggagtgattatccatgtcaaatgctaaggagctaataaataatcaaaaaataccatggaattggtatcatggagctcattgacataaagtaaacaggcagaaaatataatttctttaaaattgcattgcattttaacatactgactaatcagttttactgttgactaattgaataaatatatgaagacaataaaagagacatattattttcccaagtggcagtatatttagaaattatcttacttctatctttacataactgtatggtatacaaggaagcagtaataaactatgctggtctaaacttacttccttggaagtgcaaaagtacttgaaatcagcactttcttcttgtgtattcccaatatcaagattaccaggtaccattgctgagggaaccatttgcgtagaccagtagttctcaaccgggggcagtttggtaccccagagcacatttggcaatgtctagagatatttttgattattacagctggcagcaggtaatgtagggggcagcatctagggggaagaggccagggatgctgctgaatatcctataatgcaccagacaaccccccacaacaaagaattatttggccccaaatgtcaatggctgagaaaccttgacatagactaatgcagacctgctcagtgccttggcaatagtagatcttcactagaatttttctgcaggagagtgggagatcctttactgcctttttttcatggtctaccagtaggtttgtgtagtaagtgatctttgaatttggtttttatcttgaaacttctttgtaaaaaacaacgtgaataaataaaagtattgtgtactcacgtgaattacctctgcagaattttcaatagaatttatttatgtggttaaaaatagaggacagtgctccacccagtgcatgttagacttcttacagcagaactggcttccttatgcaaagttagttcctatgctgaagtgcattttagagaagtttcagtattaaaacatactttaaacatttaatagattaattttctttaaacctgtaaagatctacgtctttaaaaataataaattttattttctcttgattataacataattcatatagctcatatttgtgtgtgtgtgtgtgtgtgtaactataataaactcttagatacctataactaacgcaggatatggaatttaaccattatcaataaaacctcctttgtgaattcccctcttggccaaggagaaacacaattctaaatattttgtttcttgtttccttgtgttaaaattctactacatatgtatgtatccccaaacgaagtatgaaattagtttttaaaatgtctatgcctgtaggatggattggaaaggagagccatggaaaaaataaaacaaactcaatggctatttgagaaatgcagacacatggctttgaggcttggcaccaagcgcgggggcagtggcaccattagaaagaagtagacatttctgtgactgtctgcctctgtggagaaagggggagcctaaggtcaagatgacagtggtttaaacacagtgttagaatggaggttttatgaacagaatcacagaaggaggcaggggacaagaagcacacaggctgagacagactttgtatgcggtgccttctttcaggaagattgaagtgccatgtttattgtctagacttgtacttgccatggaagcaggacatctgagagcttgctctgtctgggcaattcaagatagagacttagagacgtcattgttgagcagtagagctggaggtgaagatttgagaaacttccgtgtaggtacgagttgaagccacatgaaaggaagaaacctggggacaaaaagcttagggaatgcccatagctaatggtggtatttaaaacacattataagcttttgctgtggcttttgcttatttttatttaaaaacttttttatttaaaaaacttttaattaaaaactgttttatgtccacgtataggcttcctcgggctgtctttacaatatatgttatggtaggggattattaggctggcacaaaagtaattgtggtttttgccattaaacggagtggaccaaagaattttgcaccaattctttggtccatgtgtctgcatttctcagatagctgttgagtttgttttatttttctgactgctctccttgccaatccatcctacaggcatagacatttaaaaactcaaatttcataccttgtttggggatacataaatacatagtggaattttaacaacatgttaaatgtttgaatgctacaataacattctaaactaggttagattcttgtgacagtaaataggatgttatggtttggcttggaattcttgtaagacttggcacagtttttagtcctgatccaaaggagtttagtcatcagaagaaccaccagtggcacagtaaatgtcagtgctaggtaaaaatgtgacatcaacaaagtttgtttctagggctgccattctcctttttgttagtttctttggtcctacatttcttcatcttcacaataagaagttggtctggataatgtgtcaaatcattgcaaaaatgttctatgctttttagccttaatgacgttccatcctgcctaaggcctgtgcctgggggatttcactctgccctttcttctctcacaggccatttaaatgttacagctctaaattcgtttttctcagagtcctgctacttactaatgctaatgtgtcaagtctgtattatttccagtaattcacaatacactatgattggcctaatatattcactcccagatggcttcttcactgggggtttcactgcctgaacctaaagtggtgctcaatggtagcatggcagaggtaagctaaacagggtgatattgttattatttattttcacaagtacttttctgatccatatttatctaacctttataaacataacattagaaatgtaagacctacatttttatgttttttttttttttttttattatactttaagttttagggtacatgtgcacattgtgcaggttagttacatatgtgtacatgtgccatgctggtgcgctacacccagtaactcgtcatctagcattaggtatatcttccaatgctatccctccccgctccccaccccaccacagtccccagagtgtgatattccccttcctgtgtccatgtgatctcattgttcaattcccacctatgagtgagaatatgcggtgtttggttttttgttcttatgatagtttactgagaatgatgatttccaatttcatccatgtccctacaaaggacatgaactcatcaattcttacttgagataattttcaaaagtttttactttccagtcaatgaactttctttgtttagcttgtatttgaattgactgttcttaagtcaatttttatgtgacagtgttgctacataggacactcttagtcatatagctatagctgtgagttggtttaaatatcccatataaaaagttataaaaacaaatagtaaagctgttattatgaatttacctataggaaaactgaaattttattaaaagtttcatatcagcattttgtgattttgtaacaacaccgtgaacgaaaacccagtaagtaggagggaaagtgttctgtatttatagttaggattgtatctgttagattcaaaatgatgagttagattttaaacttattttggagcccaactattcttgagtttccaaatgaataaagatatttatataataaaaattcagtttattgttgaaaaatgaattaagatgacagtaaataacctcaggtgtaggactctgcattgtaaagtggtacatttaatgtttatgcaagagtaagatttttttaaaaatttattttaaaaagtgattagcaccttggctgtacaactcttaagatttttttttttttttttgcaacactgcataaaatttgaagtattttttgcttcaaaatttgacctacttagaaaagttctgataattccaacgtaatatattccttgttttgtaagcgcctttgggtaatgtattggagagacaagtaatctcatcaagaagcgtaatggaccctatcacatttcaagatatattttttttcctagcacttctgcttcaaatttagtctgtgtttaatgataccacactttactggcgagggtacttttccagcagtttaactctctttgcatacaaatggtgttttgggtctggctgccattactgatcttttccttgaaatgaggtgacataatttgattttttacagtcaggaaaaaaaggtttagttcaccttgagaggttagagaaagaaaggttatcattgaatgaaatgcatggcttgatgccatttgtaaaacaggttggtgctggctcaagaaggcaggaacaaattctaacttggttgaaaagtatgattggcggaggggtaaaggaaaatctccagaattagtcattcaggggctctgcaatgtagatctgaagcagtgcggagaaaaggctaccaatccaccttcatcttagcaagcaagcactgttcctcttcttgattccagggagctacgtattttagtcaaagatgttaaattttgaaggcttctcaagagactgtcatgacaagcaagatattctttattatctccttttgttaatgaagcagttgaggtcctaagagacattaagtgactttcccaggaactcagataccaccaccctaaaattcaggtcttcctccccttacagcagcctctctctagatcaagcttgtccaacctgtggcctgcgggccatgtgcagcccagggtggctttgaatgcagcccaacacaaatttgtaaactttcctaaaacattatgagatttttttgcaaattttttttttttttttagctcatcggctatcattagtgttagtgcattttatgtgtggcccaagacagttcttccagtccgtggcccagagaagccaaaagattggacgctcctgctctagatatactgacttttccaaggaatgacaggggttaagatccgtttttaattggttccactcctggtggaaggctttcttctatacatgtcaggttttctttgacttatcaataccttcatgaagaaacaatgaagtgaaggacattttaaaagcaggttgtataagccactaaaaaattttgaataatgcctagtctctgcatataagtaaaaaaaaaaagcagtttaacaatatgttaattatatgtagacattatttttatcacaataaaattaagacatactacaagaacagattgacttagtttttcagtttgcaattatcttcccagttaaatataagtaaagatcttaataaatgtaacattaaagttcttgaactatataccacacaccattccacataaacagaccggttatattaaaactagcaaagccgtattttgtctgtgcttgctagaaaataaattttgcatatattctagaagacaaagatgattttgtatatgtaattgacaaaaaatacttctaggaaaaatataattattgtattaaaggttatgaaatggcagttgaaacccctaaagtcatggattctagttaatacagtataataagggagagctcacactattcctcatgaatcatgctgagaaaactcctgtcaaataaagaattattaagttgagttaaagaaattaatttgtttcttcaaaactgaagttaagaaatgcaaacatttttttctctggatgaaaacactgtttttttttcccgcaatgcaattttataaataaaaggtttattgcaaatgtattttgatgaccttattatactcattttgtgtgaaattatttaaaaaataatattccctcaagttaaattgctcaattgaaacttctcgcttctcaatataagcatcagaataatactttaaggtcataatatcagaagctattgactaagtgatttaaagatagaatgtctgtattctcagatggagcaaattaatttaaatatggtagttgaagttgcattttatgatagagcaggacattgttgtcgtgttttttaaccttaacctgaaaataattagaggaaaaagcaatctagatacattatagatttttttttattgcataaagtgatttaatcctctgttttattccagagacttatttaggtttcatttactgtcccactgggatagtagatagcataatactttctttcttattactatctaagtatttaaatgcagaaatggagatgaaaactttgactcctactgcatttgaatgtatgaatttacatatataaaaatgtacaataagcatgtgtatagaaaaaatcagttatattttttgtagctcttgctacagagaccaagagatcaaaataaatctgccctcaaatgagaagtgccagcttcttcgcttcccatttctcccaccagacactcatgtttaataatgagaatgaatgaatgatgcagtggataaaggtctgtcttgttaattagatgttctcagataatgaagtcttaatacacctgtgttttctatattccctctaaatcaccatagaattcaagaaaatggatcttgtataaatcttcagatctatttatttttgtgcatatgcatttgaccaagtaatttatttaaatgatttaaatgttcaatgactctactgcttttgaagtcatatgtgtggttcttaaaaatttaaaatactcaggtgttaagaacagcagccttaccatcagttggtgatttccttaagtgaaaattgaagagtttaagggtgcaagtcatacagcaattaagtagaaaatgtacatgtgattaataataattccagtctacttgtttgtttgcactcttgggtcagtgctagtaatcttacacacttaattgacacttgtgacatatgcccatatgcttagttctctaattgtggttctgaaggggacttacttggcatatgtagtttatatgcatcatctcagtcagaaaatgggaaggaatccagatgatgatacgaagtatgcaatgttatcctttggtgaagacattgttattgtgtatggtgtggctggatatgagggttgaggtgtcaaagaagggcgttagtcttggagccaggaagatctggatttttacataagcatattattagctacctcagtgatatttgcaaactaactttacctttccaagtctcagtttcttcatccataatgccttctttgtgaggtggtagtaaactaaaaggaaaaaatttatgtaaagtttgaacctactttctagaagacgtgaacaaattgactttgccttcatttgtttcagtttcttcatctaaatgtctagtctgtaaggcagtaggaattgtatgatgaagtcattctgtaaagctagaaacaaaccttctagaaggcatagacagtgtctagtctatagtacagtgtttggggcctagggagtgctcagtagtcatttgagtgactttaggcacttaggatactgacagatattaaacaaatattatttctgtgatcttctttttccagagttctttaactggttgaattactagttaacaatagttaatcatctcagttaagtaactttttccttcaggtcttattttgtacatatataatatataatataaagtgttgtttgtcaattgtttttttttatgacttttcctaaaaacatgattttactggatgcagtagcataaagaagccattaaaatattgatagtttttcatagaaagggtagaacaccagttaatataaagattaagtgtatagtaaattcaccccacctgtattatggtcaagtcactagcataaagctattaagttttcagagatggcaaatgggtagttatggaataagactcttttttttttgagacggagtcttgctctgtcgcccaggcaggagtttagtggcgcgatctcggctcactgcaagctccgcctcccgggttcctgcctcagccttccgagtggctgggactacaggcacccaccgccacgcccagccaatttgtgtgtgtgtgtgtgtgtgtgtgtgtgtgtgtgtgtgtgtgtgtgtgtttttagtagagatggggtttcaccgtgttagccaggatggtctcgatatcctgaccttgtgatctgcccacctcgggctcccaaagtgctgggattaaaggcttgaaccaccgcgcccggccggaatgagactcttacatttacgttgaaaagcataggtgctggagtccatggtaagattattagctgactaccaaatttcattccttctttttccatggaaacagtgcctaagcacgtggctggccagctaggcactatgacttccagttcccatttgagataggtgtggccatgtggctgagttcttatgaatagaatgtgagtgatttggcaatttgtgtcacttctggatctgtgctttaagatgttagttaggctccatgttccttccccgttctgctggctggaacctcacatggttttggtccagtgtcaaccttctgctgtagcagtgttctagaaatgtcagggcagcaaggtggaaagaaccttggttgctgaggtcctgccaacctgaagtgttacacaagaaagaaacttctctgttgtttacaacactgtattaattggtttctttgttacagcagcttagtataaaccctgcttgatagagagtcccatagaatttcgttgacctgggctctgcccagcattagcaaagtgttttgaatctccaagccccaggttcctcctgtgttacatggtactattgtgagattatactatataagagtttaaaagttcagcatttaaatataccagggactgtactaagtgccttctatacactgtcatttaatgttcatgactaagttatgaactagaaattatctggattttatggatgggagctttgaggaatgatgagtgtaaattactttcccaaaggtttagagctggtactgatagagccaggtttttaaaaagctcagactaccagacttcagagctcatactctcaagcaataccagtagctcttagcaaagtctttggaaaatattaagcattccataagtgctaatagtattattaattcttagcaagcatcatggagcccctgttataggtaaagtaatgtgggttgtgttttggggaccctcaggctatttagcaggggacacagatgtatagaaaagtcatcagagtacatgtactgcatgaaagttgaaaaaaagtaggttctctttgacaaaaaagtaatagagatcagtgaatctcagaaactagatcacctaccatgcaatcacaaaatatgccatattctacactgttgatattaaattaatatttaaggtccatacatcactttttaatgggggcagagtgcgtaagccatttttacgtattccaagacttaagaatatgtcttgtgatttctctaagagaaattctccagcagatcagaaggatagaaccctcagtggaaaatgtatgaaaatgatccatgctgccctggacgttcacatatgcccccacccccacctctgctgtccccaactagtgaatccttcctaacacatccagatgccatggtccctgattttattggaatagggtaaaaagtttaagaactggaaattctaaattgtgtttctttataggataagaaatcagttttttgctcacacactcttccttcagggcaggaagaccttctctgacccaccaatctgggtagcacctttccctcctggttattctcttttccagaattctgtatatttcctccatagcccactttttataattgtaatgtttgtgtttgtttttactggcacactgtgtatctttttccatcttcactcttgatgataagtgccacaatagcaaaaatcgtataccctccaccaaccagtgcatgtagatatcctaggccggtgcctgacacatagcaggttctcaataaacagtcatcaaatatgaaaatacatgaataatattaggtttgagtaaaagaaaaagaaatattgttagtttccccactttctcgactaattctgaaaaaggaaaatgaaaacatgttctggaatagtttgcttccactgaagctagaaatccacattcacatttgctggtcctttcaccttcttccactgtaccaacccatatgtgtccaaagaaacataactcaaagctaaataaagcatgactccccttttatcatcaggttttctggtctgtaagtcaaccagagaagtagtaatctagaactgtttgaatgacacatagttctgttgtacccttgtagagcacacaaagaaacaaagtttctgatctctgggcaggggtctaatagatgagaagacaagacatatgcatagcacaccatgtaatatagagtgagtaaagagtgcaggcagtaattgcttaagggtttaggaaaggaacttggtacagtggcctgggctgataaggtgaacttggaatgggttggtgaagggaagtacttcccaggttttgagggactaactggaacgaggaaggtaacctgagccaagatgagtgagctagaacaccaagatgtattttagtttgaatttattcccgccctcagcaattcactccccagtcctgagacatggaatgaagtgtaagttgtttatttgggaggagatcccaggaaactccaataggggaaatgaggcagggaatggaaggcagccaaaaaacaatatgttatcaagtaagttggtgtgctaggtaactaaagcttaattctgctggggaactctggaaatctctgtacaacaggcacacagggtgaggagctggggtatttcaataccaactcctgaacatcgttattagttgggggctgctgtgggtaggactcagactatgggtggggatgttaattcctcagcacttctggccactgaaaaatacatccaatcgttacagttagaagtcaatgtctggccagtgtgtactgcagtcgcaaaagcaaggagatatgggtggactgttgatagcatctgctatgatgtgttttcagaagtaaatctgagttttacccatgctccagaaatatgtttacatggttttgaagtagcagcctttgtaggaaagaaaagatgatagtaatctaagtttaattaagactgagtaatataggggtagtttggaattgaccaatagattctgaagccttctacacatacttttggtctctctccaagtggtgctattcgtgctgctggtaattacttttcttcaacgccttttgatccaggcattttcttgcttacgatctttggatggatattcatgctggcaggattaagtcttaactcctcagactttaagatttctacagttatttcaactgtttttcaagcttcatcaatattgctgaatataaattcttcactccaaccagacttatttactcacactcctttttgcttgtgctattttggatttgcgaaacaccccccacttacttaaattctttccattctccatgtctgtttccaaactccctcatgcagccatctcccctggtcatctgagccagcaggctgagatctcacttctctcgtggacctcattccacagttaacattgtgacatgtattctatctattaatgtgaagttaattttttcttatgttattaaatttattgtgtgtttatatcttggcccttcagctacaggagggcagttcttgtgtgtgtgtgtgtgtgtgtgtgtgtgtgtgtgtgtgtgtgtgtgtttgtataggaggaggcaagagtatcttttttaaagccatacctctcaagttcaaatcctggcttcctcatttatgagctttgagtccgtgggcaagtaattgacacctcaacaaccatgaacatttatacctgttaatccatgagtacaaagggagggcacataaatgaaagttctgacgtgtattagaaaggttctgaatatgagaatcatcttgaacacattgaattttgtgaaaataatggtaattgttcaagaccattataaaaaaattcatttcccccaaagttcttgttaccatgtcattttcacaaataaagtgcttgctctttcttagattctaaaactagtttctaacattataaaatcaaaattattgcctggtgccatggctcacgcttgcattcccagcactttgggagtgtgaggcgggcagatcacctgaggtcaggagttgtgggccaggctgaccaacatggtgaaaccctgcctctattaaaaatacaaaaattagccaggtatggtggtacatacatgtagccccagctactcgggaggctgagacaggagaatcccttgagcccaggaggcagaggttgcagtgagccaaaattgtgccgctgcactccagcctgggtgacagagtgagactctgtcccaaattttttttaaattgtaaaattgaaaaaaatcgtaattattattaaagtcatagtaatattttaaaaacaattatcacacattaacaaaacagccgatgtcactaacaccaaaggtcagggtgtggaatatatgcaccaatggttctccatctgactagatatactttccaggaaatgaaaatacttggaagcttttcaaaaagttctagaagaaaaaccatttctgatacctacaaatatacatgtatatgaaagtgttacaaatataaaaatacatgttttcaaactcaaatgtaattttaagaactttgccttaatttatattgccaagtagcttaaacattttaatagtgtcactgactgatgttgattgttaaagacttcatccaatttacgaagttggttttagcaatctatatgaactaggttaattaaaatgtgaaatttgcaaaaccaagcctacgtagaatacttttaaacatcagaagaaaataaatcactgttgtagccttgtttctttcatagttatataaatttgcttaaccatatacaagaaaagaacttttcttttgaggaaaaggtacactcgaactctgatctgtaattatttaagctttgggcacttcatagcctaatcatcatttgctgtaaatataccatactccctttcaaaatgatatttaatctgcatttagtacgtggtattggattttacatttcttaaagatatataaaagttttggtgtactcagtaggtgattgaagatgtgctacttcatggagaaaaatatattaggtgtgtctgacctggaaagaatgttctattaatctttttcttgtgtcagatttataacaaaaagaagtggaaactatattaagcaaggatataagttacatatatatatatgtgtgtacgtgtgtatatatatctgtaggatatgaaaagatgttagccattatattttctcttattcttgctgttctctaatttaaactcaaattctggggattcgtatgagtttttatgggtaaatactaagacaggaagatagggtttgttgaatgatcccttcttcagatccactttatgatgcaggctttacctgtgtgcatagatgtagaaacaggtccagaaacaccagggaacctgaacaaagtcacatggctggtgagaggagaattcgtgtcaactccaattcctttggagaatatatgcaaattatctgcttgtgtttgtggagatctctaagtcaatccatattacccacatttcaatgcataattgtgagtttactgagactttgaccagaagtattgtaaagctgagcttgttctatggcgtttgggaggagttgaaataaatcatttcaaggacaatgaaatgttcagcccaaggtacactcgtccttggtttaaacacccatttcctttaaggactttctaatgagaccttgtggattttccaaaaaatataccgtgccagtggcagcttattcaccttacttacatagttcgaggaactgcttgtttaaatttagatactgtctctgatgaaatgttttgacaaagtaataccagcttgatactatttaaaatattttgacagatgggaaaattgtttcagtctgagttgagcaatactttattgcagtattttgtgagttagaaaaaaaatggtaaaggtagcctcactgttccccaaaataacatccttccattctccctgaggagagaaaggcctctattcagtcatagattacagtatgtgtgctgagtatgttaagaattcacacagtttaaacaagagggaacatttggggactgtttccaaacagggaacatttattgttctataagcaaaccgaacctaaagaactttcgggaacatttgttgtggtagcatgttatcagagccttctcatgccgtgatgagattgttctcaattaataaaactaaatcactagattttaaaactgacttggatgaaaaaaaaagctcaaatttacctacttcaatatctagagttttaaaaaatatgctattataataaaaaatatttaaatatttcacattagttgcaaaggatgaaatccaggtggtccttgtttgtgatattaaacaaatgtgttgaagcaatgtggtagggcagtggtcctcaaagtgtgattcctggaccattagaaatgcaaattctaggctttctggttcagacactggtgcagcccagccatctagatttttaactcgtgttcctgatcattcagatgcacactttagcttgataagtgcccagatagtgtagagactttcaagctatcccaaggcctgccagattggaaagagggaggactgtggtgggggggtggggttggggggaatgatcaggaatggttcccaggcttccccatgtccatttcaactatgggaactttgattttctgttttacgtatcacagagttttatgttgggctctgtgactacacggttttgaaaaacactgggatagatatttctttggaggacgatataccatggcccagaaaatctttagagaataacagcatctctggctgtgttcacatcattttagcaatatgtgtgtcctgaaactgaatttggtcagtaaagtaagagttagcctgtgtgtcagtgacagcctcatgttaaccagtctcctaaggaacacatgtacaaatcagaaatgccagttgtatttttctaattacaatcagaggcataacaaaaaattatgcatacactcacgtttaacttctcctgatactcgcactgtgcacaagttaacatttagagttgggaatatcccaacaatcccttgtccagtgattgaattgtccatgataccaattcaggcctccacctttgatatatacctgcaggtgtgacatagacatcatacagcattgttaacttacagctatagaatcaggggaaagagaagttgacattttctacagatttttatcaacttgtacaaatccattacacacacacacacacacacacacacacacacacacacactctcttactaaattgctgagggccgctaaattcagtgtctttctgaaccatgttatacaaatctactctattatctctttcaaatttctatttctaaaaaaagttatatattattgatggttatttatatagatttttaatatcattaattaaattgtaataagatctttatgttaatgtaactttttgctcacatcaattttatattgatattatttgtttacctctcagttctggagagaggtgatgatgatgatgatgatgatgacaaaaataggttactgtttttataacaaggattctgcagttaacatttagaggtcttacacagtaccaaacagtgttctaagtattttatatttattaatactttttattcacacagcctacttatgacaaaagcctttaaccttttgaacataacccccaatgaaaaaattgagatttggtacatatatacttcctttatgtatatattgtatatgattaggaaaagaaataatgaatcaacttttattatatctaataacttgtgagtttttattcccttccattttattatgtttaatttcagttttaaaagtccagttgagattcagaaaattgatttcattactcacattaatagtcacagcctgcagaataaaaaattgtgctatcagatagataatattattatttatattttacagatgaggaaataggcacagagaggttaggttagttgcccaaatttacataatgagtggcaaatccgcagttcaaacttaggtagtctgtctccaaagccctcgctcatagtactatattctgtcttacctagtcagctccttcatattctactactgtcaaggagggatgaaccaaatggggaatgtttttctcccaaatatggggacaatatagtgacagcctcaaattttctaaatagaaggatttagagatgaaggaatggagactggctgtagactggcgttagagctacttttccatttgaaggcatccttttatttaggatgtgtgtttgttttaggaagtatttgtaaagaggctgatggagattactgtggggggaaatggcttttgccactgaaccaccctcttggcactaccacgggaaatttattttaaacaatctaaagaacagtaggtggaaaagatgtgtacccagattatgtggaccttcctggtgaatgaggagaggacaaagtgattgtagggcctattgtcctgactccttctagggcatacagttagaggtgcaggactgctaccatggctgcatatttttgaacacagacatattctttccctggtgcttttaaatgtgatttaaaaatatgtgtcagatgagcaggcacaaaatgcaaagataggagagccatacagtgaaaaatctatttctccatcttttccttggttgtctctcttttctctctctttcctagaaacaatcactgttgtctctttcttgtgtagccttccagaatgctatgctgtgtgtgtctgtgtgagtatctgtagtaaacattaaaatattactacacattttctgtgccttgaatttattcctcttattttatgtttcagattttgttccacatgtggaagtgccttgtgcctcctttttcactgctacatagtagttcattgtgtgggttttccaaaattaatttaacagatcctctgttagaagacattaggtaatttataatctcttgcaagcctgattattttaaatttaaattacacctagggttctgagtcctctatatggtcttttattcttagcagaagcttcacaactctctgggtcttcagcagggactgataaagatcaaattgttgaattaggtcaggtttgtgtcaggaagttgcttgatctcagttttcttagatggctatttttagcttgtgaacagtaatcatggtaagaaatctttgtatcttgccctagacaatcttctcttggaaaattaaagtggccccctttaaaagatttaagaaatgcaatttgctaacagtttaatgggtttattagggactttgagggtatatttctagaaggagaaatatttttgtttctctgaaagttctagctactttattctccatagcccttaaaaacttttcagatttgtcttcctataattcgtagagatttggaaaattagacataaggcacctgttttcttaaatgcatggttacctattcctttgtcctatcctttcaagacaattctgggaacagtttgttcagctttacgaagaaaacatttcttcatcacctgagttttcggtcacccatgaattctaagaatattttagctgatttcagggaaaaagtattcaatattagtgattgataattatatgaaaaatagaccagtaaagcaatcaagtggaaacttggtagaaatgtatagataagtgacctggtccattctgcatttttctgattcaattatatccacagtaactcagagataacaaaattggtgctatgtagcaaataatctgaagaaaataatgctataaattctttcagaagtgatttcagaatttaatattttcctgtcaggagatttatgacctgacactgagaattattaaggctcagatccaaatacttagttcattttctcttgctcagcatttagtaaagatgtggaacacactagtcagatactggttagtcaagctcggaattcaggatttcatatccttgtcaccatgtgtgaactttggaatatttggattttaatatatgcaaatgcttttataatgtgtgatgtgttaggtgaaaattattgcacacactaacaatttaatttaaaatgctactcttgaatattttataaaccactggaataataacatagccttaatgaatataaaactgtttcttcttcctttgttaaatcatgtgggctgcattctacttaatacactgcctcaatttatccttttgtgctaagattttaagttaaaatagaaaataaacaataaatcaagttggactgcaatcatgttcacttgggaaatttcacttagagacatttgatatatttttggagggatttcagggatctacattggttaagttgaatctgtaatttggttatacataaaattaaagttaatctaagtggacagaatcaatactcttgtgagtttaattagatggccagcttccaagcaagagattattctttttactatcctcctatcctctttccttaggcagcaaaataattcctttgccaaagtatgttggacagttccctggtgacaagttctatagaaactcatagctatgctgttagcaatgtgagacagaagggagggatatgtgggtgaggaggccattgtattctagagatagtaataagcctgccttatctccagatcatagcccagccaaagggatagtgtcccatttgcagaggatctgcagtcactgtttctaaaccaaacctataaaacaggatggtgtttctttcaggctgaaaaatcccaagacagaaaaacaggaaaagtcggggagataaattataaattagactggacttgcagtgtgagaatcctgctattaatagttacgtttgatatgagatgcctggaaatgtggcagtaaattggagtgaggttttatttcaggtaataactttccttttatctctgttggtgcattggcaagaaaatctagaagagttttaggaggactggatgctataaccttcattgttcttatatgttcagtgtcatacgcaggcttttacttattgaagagtaagttatttacagtgttttaagagtgagattttattctagctccgtgaaacaaaacaactgggttgagttgtcatggttgatattacagaaattatttgatgagtagatgcatttttagcaataaatttaaaataggtttagtaatatttaagctacatgattgtatttctaactttgtggctgtcttttaaataaatgaagtttgaaattcgtgttttatatttcagatttttattcttcatgttgcaccatcacaaataaatatgtgttaagtagttaatatgagcaaggaacagtgagaaataaagatcagtaagaaaggttctgtcttcaatggttcgcagcaacgtggttgaaaaaccttggcaagagtacatgaactaaataatattaaccacacacaggttgtgatctgattgtaggtattaggcagagtatcagaacagaatgcatttctgtaatcctcatgttaaagaaaatggattcttttctttttataagactaatgatgactaatataagactaataagaataaaccaacttttattgttctgtttcctataccttattgtaaaattaatatttattgagcacttagtaggggtcaggcattcactgttctgtgtttaccatatgtatgaattcctttagtccttaacatctcatgaggtgggcatgttatgatcgtccctttagaatatataaaggaactgaggcacagcgtggctcattagctgctcaaggtcacagagctcataacttatgaaaccaggctggtaaaacaagctgcaggacttgtgagtcaacactcttaacctctgtgctttatactttctctcatttcactgcatattagttaacacctctctgctgtaagcctaaatagatgtccaatttgcactaggaaaatacaggctttaggctaggatcagagacttgaaatttatttctgtagaaaaggatgagttattttgatgtaagtattcacagcactacataatttaagtgattaaattcatccccctttggtgaggttggggggagtttctaggagaatgacaccctcacctttggatgttgagagatgcatatttatggaagtgtgcatttcctctacctgctcagtctaaactgactttcttcctggacagatccttgtgatgatgacttctgtcacagatcacaagagagccagtcacaaactgggtgtctgcactgaagagagtcctttagagactgagtgtctgatggacctgtgtttgcaattgtctttttctatttatgtgacttcggaaagttactactgagttttatttcttcttctccttaaaatggtaatgataaaagtgaaaatacctagctcatagggtggttgtgagaatgaaatctgaaaacatctataagcaccctagctgcataagagctataccagtttttctcaaaatgttaagtacctgtgaagtcatctggagatctttttaaaatgcagacactgattcattttatttagttgatctagggtgaggcctgagattttgcatttctaacaagctctgaaatgatactgtgctggttcaagggccacactttgagtcacaaggtcctgcacaatatgcatagaagaaatgttcctattaataggagctgttaaagtttgtattaacagaatatttctgttgataactttgcactcagtttggggttgtctgctgaaatatgtacatataatgtataagtattgagaaatatggcatttagaatcttttcattgggaaataatgcattctataatggttttgtgctgcattgtgacaaaaaataaatttggagtcctctttggaataagattccattaaaaattcacccatgttgccaggtacggtggctcatacccataatctccgtacttgggaggccaaggcacatggattgcttgagcccaggagtctgagaccagcctgggcaacatggcgaaaccagatctctccaaaaaaaaaaaaaaaaaaattggctgggtgtcatggcgcacacccagctactcaggtggtgtattctcagctactcaggaagctgaagcaggaggatcgcttgagcccaggagttggaggttgtggcgagccaagattgtgccattgtattccagcctgggtgacagagcaagcctctgtctcaaaaataaaaaataagaaaataaatccagcactttgggaggccgaggcaggcagatcacgaggtcaggagatcgagaccatcctggctaacacagtgaaactctgtgtctactaaaaatacaaaaaaattagttgggaatggtggcgggcgcctgtagtcccagctaataggcaggctgaggcaggagaatggcgtgaacccgggaggcagagcttgcagtgagccgagatggcgccactgcattctagcctgggcgacagagtcagactctgtctcaaaataaataaataaataaataaataaataaataaataaataaataaataaataaatggcgccactgcactccagcctgggtgacagagtgagactctgtctcaaaataaataaataaattaattaaattaaaataaaaattcagccatattaaaagactcatgagtgtagtaatgaatgaaagatgtgattgagtaactttgtatcatatgtttatttctagcagccagattttcttgactaaagctataattagtcatggctctctgattattctaaaaagtgaatttattatcttgagggcgttgctcttaatatattttgaataataaaatgctgaaattaagtatgcttgacttgtgtctgataaatttgaatcttaaaacggacttttgaaaatataggaagaaaaactgtataggaatatcccgtcacttgtaatgttgacaaaaatagtagaacctatgactcacgtatgtatttcccaaacgtgagttgagtaactggctccagttgttactgatggcatgccgtgcttgtgccatatctgtgttctctgataactgctaaatcaactgctgcctaaagtagtgtcaaggcagtgaaaagcctctggccacctgtggaattgtttcgggggatgggactttctactttggggaaaatctgtaaatctatggtgtaaggcaatcctttgtgttttgtttctgttagactacttttgtgttaccaaagtagtctaacagaaatacttagtagtctaacagaaatccgtgttgccaaaagttcttcataaattttattgctctgtcttgcataaatggcctgtatacaggctctttaaaatggttggtaagagtggaaatgggaagagagtcttgccctacttaaactccagaaaatatgataatggttgcctgtaggagctctgactaatcatatattttttgatgacatgtgcttgccatcaaaacagcatcaaagagagaggaaaagaattatatcagagcctggttcatcccagtgtcctggcctcctagggaggtgttagaatgggatggttttttacttgcagctgcaagatacgccagcatctcttggatcagagcccttcgtgaagtaagggagaattacaataggactgtagctcaggccaagggattaatagaaagattaaattttgtatgttttaattcaatacaaaaatgctacataaacatctgcctttttaaaaaatatgaaatcctttccatcttggtgatcagcttgatcagcaaccacacctcacacttactgttttcaataacaaatggaatgcagatggcatttgtttcaacgataactacagacagcaataactaatgaataacttcagtgatacctggagtcacctgtggagatggtgaaaatatttagaactgacaattcctactgcattcatggaaaaagaagtaaagtggagtggggcctcagcatctggatttttaaactgttctattgttgatttgaatcaattcatcatgaattagcaagttgctagtaagtagcattaactactgatgatgatcaattcttttcttgagagacgaaggcagtaaactattacagagaaggtctgtgctttggcttcaaagagacctgggttcatactttgggtctgtcacagaattatgtgaaatacctcttttcctctgtttctttatgtgataaggggggataatactccctatatcatagggtggtggaggttaaatgtaaaaacataacgactagtatagtgcttagtacattacagacttttgctcctcaaagtctcgccctgggatcagcagtatttgtatcacagcagatagatccaagaaatgcagtatctcaggcccattccagacctcctcagtcagaatctgcatttccgggggattcctctgtaacctgtagtgtgacaagcactgatacaaacaaacgttaaatgtttgttagcgtagtagcatttaccgtaattgttgattgcttttacagttctgagctgataatcttaaaaacgccatgatggttgaaacaaaaacacttcgtggtatttattttctggtattttctttttattcatactaactagagtagtttctgttgctggtgaagatttgtttggggttcagtaaaactttcaaaatcgcctttcagatcttaagtatcttttagttatctccttctttttgtgtttatgcatttaaacataaactataaagccaaaatgcagtttaaaattaggcacaatgtatctacaaataaaagctcatctagcaaccaataaaatggaaacttgcagattcccagccagattttaaaaatcagatcaaatatttggaaactatgttatttgttgacgcctataaatttaaaaataagtcaaacaaatctgctattcttgcaaagcctaaattttatgagttccccatcattattggaatgagaaattgccattgtaaactctgtgctaaatttactttcttttttgacttttaaaactcaccaatatattgcttgtaatttagctctgacaaaaacataaaaaaggctaaatttaagaggcacttctgttgtgttcctcaaaaaaatttttagccatccaacttatgtatttgtcatctacagctaggcttaaatattattgaaattattgaaggcttttgaaagtttctttgcagttgtttaaaataacagctttgccattaatggcaggcaatcacaacattcatccagtattttgattttttttttcttggagcacaaactgagtgagaaaagtaattttctttttcacatatagaatctattttagttactctagcaggtttttgttgttgttgatgaccaattttcaggtccaaatgttaaccttaacaattcacaaggggtggtgggaactaaagattttttttcactctctagtccaacttacttcagcacctgctagtcactataggcagcctgacttttaacaggctcatcagcaaatccgtggatgaaatgtcttgaggacattcaaccacactgaggggcccagtgatcatcaaggatgcttgcagtagcagcctattaacttccttttatctgcttatgagattaatttgggttgatcagatacttgattgtactgtatttttctcccttcctgtactctgtggttgatttctcattaaatccagtggtgacacctccacaaggcttcgaaatctgtctttaacttccagctaatggaggagcttgctgtgaatagtacaagctcttatttttcaggacagtaataatgactgagggaataaaatcctttgtaccggctctcctgtccaaccttgaaagatgtgttgctgcaggatcggtggctcttcagagtatcccttattgtcaatcacgttaactaatcaccagcagaggactcttgaatttggcaaacttgggatttactctttaaaagtgctgttagctcatggaacttgaaggacctgtcattctttctgctgactcattttttattccttcattgtgctctggtatatgaggaggaagggatctctattttggtagatataattatgtcctttagtgaatttctgagtgagcagataagtctgacatttcctcccactttgtttctctccttggacaccccccaccccagttgtcacaatagtgttgtggaaagagcactgggccgggggtagaccctatttgcttggcccctgctctgcctgtggccagctgtgtgacctcaagcagtcccataaactttttaggagaactttccaattgtccactttccagcacatttatctaagtcatggtttagaggaagagagaagagagagataattaaggaaataactagtattgagaataaaaatatttgtcttaggttgaacatatgcaatcgccatttttgtaggctacgtattttcatagaacttgaccaaataggttcctctatccacacctcaaggcctaaggactctaacatatgtaaggcaagttctatagatgtgtcagaaatttccctactcaagtcagatctggcttgagtccacctagtggaggagatggaaattgttcttagtatttacaactactttttctatctcttcccttacatattattctctctcctccctggttaactccagaccttcagaaccttcatactctttccatcctatccattcatcattagttcatctaccttattcatctccctacttgtttcacatgtgtttttaatacttaccatattccatgtaccacacaagagaaaggaaaaaggtgagctagagaatggtcataaactcaataacaggccattctaaataggtgatatgcctttatgttgctgaagatactccattttaaccacagaatcattttatatgctttttaaaaaaatgtttgtgttattgtggaattacaggaataagaaaattacatgggaaagtggtttagttcagaaattgtacatattggtgaggtttggaaagactgttcctttatatactgtgcctttttgaagaaggttcaaattcctgtctgattttaggtagcacatgaataattgccttattagcttttcttctctttcctgaactaagccaagttccaatcaaattgtatagtgtgccccagatgagacgcgccctggtgcacaatagaaccatataaatgttgttatccacttcttttaaattggagagctgtaacttttttgtagctttgaatatttcatttagaatttatataaaaagtagggcagaaatcgaaatatttctgctttccattatgtattcgcctcatttttagagagatatttaacatttcaaactagttaaatttattttactcttctttgaggtgagaatgcctttgagatttctagtggaataaatgtaaagctcccatgtcactcggccttctcaggtcctttctctcttatttgaaccatctcctgacaataacatttagaacaatatcatctacatgtaaagcctgtattaaagtaatcccttcttcactatcgatttagcagcattaaacactgttcatctgtaaagctggggcacaatcagaaaattattttttctagtcccatactttaggatatgaatgtgagcatcacaatttgaattacttggcctgtttctttttcataatcacaaactttgggcataagagaaagatttttggatgttgagaaagggatattgagtgtaactgtcatggttctaagctatcacagagtaactaatttttgtggattaccatatcagatatcacagaatccattttacctccaagagtatagttagatacatctttgatttgtcagtgagaataactttcaaggcttacttaatgggaacgtatcattttgatataccgcgtcccttatcttctacttagcaagagattattatttccatattgaaaggatctaattctatagacagacgcagaatgttttttgtttgtttccacctctacagtatgctggtgaggatcatgctgattgccgattggcaggggcatccaaggtggttttcttgttaggtgcacaggagaagaaagcagacagtcatggataatagtaagccgacattcgagaacaggattgaaggcaaagtgtggggtcactgtaggagagagaaaaataacagttagtttcaagatgaagaaagaagcaagaataatgtccccttgggagaaaaatacctccaataagcatatgggaaatgagaaaggattcatgaggggaaaggaggattctgggaagggctgggaagttggcttggggaagaaaaggtgcctggtttagagaagggtgtcaggatggagaaagtatgacagggaaaagaactccattactaaagggtggatgccattttaaataatgtcaacctcaaggatggttggcccacttctggaatgaatagcatcaaaggtttatgtgttatttatcctttcttaaggcctcctcatgttagaaagtagcaaacctactcttctagatgctcaggcccataaccttggagttatctttgaacccgttcagtctcccagactccatatccactgatttccagttctttcttattggctctactagggaaaatatatctagacccacgactatttctcaccacctccattgctacctccctggtccaaagctctattctctctgtcagattattacagtagcctctgacttgttggcccagttcttggcttgggcctttgtttccatatagactattctcaacactttagtggagagtcacacctctcaaagggatacacacctcacccacagtgaaagctccagtcctcactatctctcatgaagcccaaagtcagggcttctcacctgggggcacattagaatcctcaggggatttttatagacatgctgatgtctaggctttaacaaatttgaatccctggaagtggagcctagaggcattgtatcttttaaaagctcccatgtcctaagttttggggatcaacaatgaataagacctagttccaagtcttaagcttttgacacctgaccagggacacccaccctggtaactgtaatagtctttggtgagtaccaagaagaacaaattgctggggaatctcaggaaaagtcaggtgtcttagtctgtttgggctgctgtaacaaaaacaccatagaccacttgactttaacaacatacagttattctcacagttgtggagcttgggaagtcaaagatcaaggtgctgacagattcagagcctaggaaggacctgcttcctggcttatggttgttttgttttttttttttttcactttgtcctcatatgactgaaggggtgagggagttctatgggatcttttttataagagcactaacctcattcataagtctcagctctcattacccaatcagcttccaaaagccccacgtccaaatacaatcacactggggatgaagcttcaacatatgaatgctgggggcacatagacattcaatctatatctccaaaactacacaaagtggaggggagtcaaagaagtggcatttttctggactttgaaggatgaggaaggctttccctgagagaggagagaaagtgcagtcaagatgacctcatttattatggctacaaaatgctagtaggaaccatgctgatgtgattatagaagaagctttcaaattaggcaaaccccggttcaatttcttggcaaattacttcacctcttagtgtctcaattttcctgtctctgaaatggagataatcatagtaccagtctcatagggatgtaagaattatcaactgtctttggcatattgtaggtacttcataatgttaactttctacaatagctaattaggcatttctctcaaagaaaagtaaaggaaatagcttttaaatggcttacggtttttcttgggtgctgtatacccttgctactcacaatgtggtcctcacaccagcacgggcagcagttggcagaaattgcaatgcctcactcagggcccattgcggaactactgaacagaatctgcattctaataagatttatcccccagatgatttgtgtgcacattaaatttgagaagcattattgtagagcataaaaaggtgagcaagaaatagctcttgcctttgtggtgcttagaggtccctttaataactttagcatttacagaaataattataatgcagggtataatgtgataaatgacatgagacgtcctcaccaaatactaaaatacagcagattgttttaagctccagttgaaaatagtataaagttccttttctctctaataaggtatgaaagttcttaaagttataataagcccccttccctttctgccatccttcaattgctgtaaaccatagagcttattgaatatctaagcagagagctacatctgtttatgcacattgggaacaattgaccaacaagtacgagttgaatccgttgcctgaaataaaaggcacaagaagtactagaagttaataaaaaaagacccaatagttttgtctatgagatgaagtagactatctagagaaagatcaaggttaagataagcatgtgaatataaatattagtttccttaatttttgatgctcagcgcttttcaaaagaaaaccctattttttaaatataacagcaatgaataaaacaaaaagaagtcttcaatttccccagttgacattatgatcaaaatatcaatttaataattatcctccttttaataggactgatttcatcttgtcaagtttaccattacaagttactagaacagccagagtaaagcaatttgagttccatatagtcaccacaatgtaattattatttttgaaattaattttgccgttttctttttgtttaagaaatgaggtcttactgtgttgcccaggctggtatcaaactccagtgatcaagtggtcctcctacctcagcctcccaaacaggtgggattacagacacacaaaattttcaagtttggggatatttaacttcagttcgtggtaaaaatcacatggtctagtgtaatctaagcaaaaaaaaataataaaataagtgtttctgtcactggctgtaaataatggtacagtcatgtgatagaccatatatatgattataatatcatgtttttaaagtaccttttctatgtttaaatacataaatacttatacctgtgtaacagttgcctccagtattcagaacagtaacatgctctacaggtctgtagcctaggaacaataggctataccagatagccaagttataccatctaggtttgtgtaagtgcactctgtgatgtccacatgaagatattgcctgacaatccatttcttagaatgtatctctgttgttaagccacacatcactgtatttaaccaaagtgaacacattctgctgggttttgttcttgatacacgtgtgtaaaattatcacttttcaggtgatacattagaccaatgatattctgacacagcagaaatgaaattattcatagcaaattacatttaatattttctgtttttaataaatgtaaagatctgttattgtcttatttcaagtttcatttttgctggcaaaaggttttggcctttactttcaagaacttaacttaaagtgaaattccctacattcttcaaataaggtatgcttgaataaaagcatctaaaagaaagtgtttttttataaatgacaacatacttaggaatttttacaatttgtttggggcaaaaattgtttgaaagaagtagatgttggataacacatattcagaaatatttatattattttcttggttattttatgctattggagtagatgcttcacttctctataggaattaccaattctcaattcctcttcaccacttatatatttttgattttgtcccaaatagccaaacatgctgccataacttctgagctcagaatgaaggatctgattaggaaaagcaacatgttaacagtgtacatgctccatctataactgtgatgaatgtatactttggatttatcatcacttttaaattattgagatttttaaaaactctattagtgctagctaagacttgtttactgcatgggctatgttgttttggtgcacatctatctttgtaagctatttctttctagaagctatttctttctaccttttgtacagggtagaaactttgcagaaatccgaggtcttcagagttagaattcaggggagaactgatgatgggtagtctattgatgggttaagtcctgaaggttattcaggtaaacatgaacctttcccctgaataccttattttctgtcatttcatcattatgattttggatgcctcattacatctgtaaaagcaattaagagttgaaggaattctttttttatagttcctgtctgctgatgacccattaatgtccatatagatatattataaaatatttataaatgaatacttacattgatttttatttgagctggttttacatttgacttattatttattggactatttaatttagtaaggaaacacctctttttcatttttaattagtgcatggaaggcttataagattaaaaatagttgtgtttagggaaataagcttatttcttatgatgagcagttacctactatagattatatttaatctggtaactaaaatattattattttttagtttacatatcagaacctagatataatggccagaagatgtaatgctataatatagttaatttgcagtaataatcacattttcagtaaatatttgttagaactatatgaaattgctgataattgatcatttctgacctacagatatgacagctgcatagattcaacctactatgaaaagccaaaacatggaatattacactaattaaacggttacacaacagaacatggaatgtgcgacacttcatcttgggatgcaaatttttgtgctaaaaaaaactgagaaaaacaaaaagaaaaacatgtatttctgaggaacttgtttttatatctggcataaatgagaaaaagctaattaaaactattaattatcagaaaattgaagataaagttgaagagcctataccaaccaaagttgaataaatggcaaaatataatatagatgagttactctgaaataattttttatttcctactatctaacttaccaaacttcctgattttaattacataacaattttttggttattttaatattcatttggtacttatttccttttttattgttatagtattagatgaaatcataacatcaatttgctcctttgtaaaagaggatgttgagttagaagtgttctaaggtggctttcagcaataggctgccataccaattggaaaaatctagcatggtataaaagaatatttaagcagtaattatgactggaaaacatcagagtggaaatgaagtatggctgagaaacctttttgcttttagctttttttggagttcattacaataaaatgaaattatagaaacttaacccatgagtatttttctctttgaactttagttcctattgaaattggagaggaaactacacagtaatctaagggtgatcacaggagatgtcagctgccttccagggctttttgcaacgtggaattgcctttactcgtttattgaagagtgcccgttatgtgttggggctggactcacagtttctagggtgtagatcttagccatggagatccagacacttacggggttaggatattgggagtagtgctcttatgcagggacaggcttgcattaaccaaactcaccagatattagtgtataaccaaaatgcaaatttattggtttacaataagaattctttgcactaagtaatttagaatacacacgtaaacccactctgtgctaactaactgaaagtcactttatagggaaaatcaaattataattagaagatcatgtaatttttatcctcattttgtgaatatggtgttcacatttactgattgcagatattgaaccatcctttcatgtttgggataaatcccacttgatcatggtgaggtgtccttttaatgtgcttttgaattcagtttgctagtattttgttgaggactttttgcatctatgttcatcaggaatattggcctgtagtttatttatttattattcttgtagtgtccttgtccggctctggtatcatggtaatgatggccttgtaaaattagtttggaagtatttcctcctcttcaattttttaatatagtttgagaaggattggtattaggtcttctttaaatgtttggtagaatttgtcagtgaagtcattaggtcctggacttttctttgataggaaatattttattactgaatcagtctccttactcattattgatctgttcagattttctttttcttcctggttcagtcttggtaggttccatgtttgtagttcatttgtttcttctaggttatcctacttgttggtatataatagtttataatagtctcttctgatcctttgtatttttgtggtatcagttgtaacatctcctttttcatttctgattttgtttgggtcttctttttttctttgttagtgtagctaaagttttgttcatttttatcaaagggtacaaaattttagagtggaggaatcagttttaatgtatgtattttatatttcaaaattattggagaatagatttttaacgttctcaccacaaaatatggtaagttggtgagttgataggtatgttaattaacttgatgcatctttctacaatgtataacataaatcaaaataacatattgtactccataaatatacaattattatttgtcagttaaaataaatatgtaaaaattatacttagaaggccactttggtaagtgtcggcttaagagtgaatggaataattgtcgattagtaaacaaaagaaatgtcatctctccaaaaaaaaaaaaaacagtgaatggaatgaactgtataattcaatgtttgatgatactggtctctgatattctgtgctctctgattcacaaaagtgatgtgcctgtcaggggatcagattgctcaagaacatgggccagagtataattcctgttgatggcacttggatccagattatgtcttttgaagccttctgtttctttcctccatttcacattacactctccttgctgccttttatgcattttatgtaggcttactaacccagctctctagcttagtgcctggcccccagaagtactgaagaaatgtttaactaccgtttagctagccacaacattcttactagttttgctttgggaatagtgtatattttacttctaaggtactttgggtctattttattgctgcattctaaggcttgtgtgtatgtgtgtgtgtgtgtgtgtgtgttccgtgtgtgagaataatgggaaggtatgatacccacctctcataccttgatgctttgggaaaataaaaattttctgattatattattttgcagatgttctagttatacttatcaatcttttctgcttgccaaatgaagatttagattgtgaagattcttttcagagacataggttcaaaactaaatgaaacccagggcatctgtaattcttcacactttagtgaagctctgtgataatagtgagtagatgtgtggtgtggggacacttggggtggtatttcagacacttagatatttgccggaaatctgaaacttgttagttcacatttagttttcactaaatggattatatttttctcctaaaactgctattccactattaaaattaatggacatacaagataccttgtctgtaaatagaacagatatttttaatattttgtcacagtcccccaaagcattagtctgtaatgttgactaatgggttgaaaagatattaacttcagaaaaaccaaagagaattaatctcttagaatacttctgaaaccaccaacttctgtttttgattttatatttctatacctcaggagggaaaaaaaaaacaaccaaaaactatttcccctctactccctccctgttttctaaaaataagtcacttttggtttgttaccttataacacatgccaaaatttatcccagagtgaatttttgtagccaacttagaaccccaaaatagaaactgctgacagttccttaaatacagtaacactggcaggtgccttggtaataaattcacaagcttagaatctacaaaacaataaagttatgcaaattggagcatgtaggaagaataatctgaaacaaatggcagaacagtaagtttagcattgtggcatcctggttttactaacacaaggcaaataaccctgaggagaatcagggaaattttagatcaaggaggattacacagacatacagtaatacatgaatacaatttgagttgaccaattaataactggtttctctgttatcacaaccataaacagagatgggaaactgatcataggttttgcatttgataggtacaactatcaagaggtaaatggaaaataacaagacacctaacttgaagtgatcacatgtgcagagcctcttagcttttgttttaattgttccttcagcatcattcccatcagtcatattcagattagttgtttaattttagccaatcaggcatgtaatacatttgtgaatttcatttattttaaatgtctttgcctttgcctaattatcttttacttttgttattaatctctgatatggcataatgaaaaatcgtgttttttaatgaaaagaaaagatgtgttcagttaacatattttcaggaaatacatattttcagttaaaattagaatagctctaataatatcagacaaaaatgtagctgaggaatatagcactaccttttattagttgtgtagtaaaatgtaactttttgaccctgtagtatcgcttgcagaatgtaacagaaatgtttaacttttcttgtttttgttttcatcaacctcaagttactcccaaagaagttcaaaatgtatcccagaacttaaagtataataaaaaaattttaaaaaaagaagtacaaaatgtctattgtgtacacaggaaaaatatattagaataatgattatcttaagtatactacctaccttattcgaggtgatgaagtagtggactgctacaagtttgttggagagagggactagaactgtccttttaaatgctatattctatatcatagcatttttgtctggcacttggtagatcctcaatagagattgcttgaaataataaacaatatcacctccaaactcaggttcacaaaatttgagttcagtggcacagtggtgatcacatgtgcggagcctcttaggaaaaggaggcctagagaagtattgagttagatgctcaggttccagagccaggactggaacacagatactggacttctgtcaagcacaatatacttttcatggcctttgcccgtcattcagatgtttaaatttgcttaaaacagtgccatctattttctttggagttcgaataaaagttctttctaacagagtgagtaattcacacacagatacttaataatttccctgattattttttcatttagagattttcaaactaacaaccaaaatattctggtagaaataaggtaaggttgagaagtaaatattataaactggtctgtttagccagagttcccctaagagccttcctcattccacctcaaagaccattttttagtttttccaagtgtctgtgaattgtggctgtgcatgcgcacatgtgtgtgtgtgtgtgtgtgtgtgtgtgtgtgagagagagagagagagagatttttactttaaaaaattctcatcacttaagcttgactgttgcttttcttcttgcatgtagcttttctaaccaaataaattaaaaatacttaaaattgagtatattccgtaattggtccaataaaagaggggatgcattggaagggagctatggcacagggattaaaaaaaatgttttgcacctggctcctctatattaggtgtggaatggcagtcaagccgttgagctgctgtggatttcaattaatgcatttctaaaatactttccagaaattcaagatggtgattatttaaatagttgaaaaatactacatctcaatttggcctatctttttgtgttgaagatagaggatgtaatcttttttcatgttcagtagactgtgagctaatagttttgttaggggctgagaaatcaacatacaccttacggcactggagaagcagaaacctggcttaatttcagaagtgcaggaatctttgacagaaatattctactgtgaggaaataaatttacacaaggatcccttctcagagtatttactaaagtctgaaaagccttaatttattttatgccaaaatttatgtttatgtcatgccaaatatagttgctgatattgttaggtattaatttgtgtgccaaaagatactctttatactgtattctctgatcacaatgtaataaagcagaaattagtaagaaaaaacagtaatacaaaataaacaacgatttggaaggaacaagccattaaaaactactgagtcagaggcagtttttaaacagagctcaactagagatagaaatagagaatgttaaaacagtctttaccattggatggggtgaagttggagagaggaaatggggagatttaggccaaagaatacaaaatagcacatgtgttggattactaattaagagatctcatgtacaacatgaggattaaagttaataaaattgtacagtattagggatttttgttaagtagattttagctgctcttgtcacacacaaatagtaactatgtgagatgatagctatgttcatctgcttcactatatagccattttactatctctctatatcccatgtcatcaggatataaacctcaaatacacaccatgaaatgtgtttttaaaacacttgcaatcataggttatttagaaaatagtaacaccattaagggaataaacaaaatggtgcaccttatgaggtgcagccaaagctgttctcatggcaaatatattagtattaaataatttcactatgaaacaacaaacaacaacaaaaaaccccagcaaatcatttaggtattttttaaggtaaaatttaaacataatctagcaatgttaaggagaatgaggtatgataaaatataaagttaaagaatcagtaaaaagtggagtttatatatgcaagagctggttcttaaaaataataatgacaaatgtctgaaaatatagctaaaaatgttaagtacagttattttaaaaatgagtaaagaagtttaaatgaaatataaattataataaaaatagaaattataagctaacacactgtgaaacttggtggcaggaaaaaagtcaatgactacttataatttcagagtagaaaaatacagattttgaaaagggaaaaactggagaaatatcatttgaggattacttctcaaaatgtttttaccagttagattttcaaattttcaagagataaattcttatttaatgaatagaagttgctagaaagtattccaatgactgtttttgaaggtctcatactcctgaatctaaaacctgacagaatatcatatcacaaaaaatctacagaccaataatttttatgactttataggcaaaagtgtaagtataaagtagcaaattaaatttagcaatattttaaaataataattcacctgaatcaggaatggcttagagtcaggaattcattaataatcacagaactagatcaaaagaaaaaacatctcaccagagatggataaaaagctattcctgcaggaaaatattaataaactagaaataatataatccttattatgtaagaaaatgtatctcaatctatttcataatttgtcaaatgccagaggcattcttgttacaatcagggcatgttttatattaaagattattggtgatggtcactttttcaaaaatcacgtaacttttccagtgcattaataaaaaacatacgtttatatccattatttccagaaactccactcaaatagtaataagaatttaaattatgaatgcacaggaaaaagaataggaacaaagataattgtaaagaaggaatgttagcaaattttaggaatatatgaagagggtggaggagttagcaccacagaggaagttcaggttcgatgtctataaggagagtgacattgagaagcaagctattttgctctctgaaactctaatgggtccagagattacaggcggggatgaggttaagggctgagtacataatggtaggttaaaaatgtgtgtaaataacaaatcaccagatcacttctctcccctctttggctcactaccctgcacacttaggagacaacttttctttttgtccggcagggttttagaagttgattattagaagaaattaatccatagattttgagactttcagacacctgaaatatgggaagctgggagtgagggattgaaaagggattaagagaaagtcttcatattgaaagtgagaattgtcaacttacttcccacctgcccaccatctttcagaagattttccaaccctaaggagataaataaaaccttgaaaataggaagaagtgaaaaaatggaaattggaagaaatacatgtaatgcagggcacaggagaaaaattaaaacaatttagcaatagctgcagagagataaaaatactgatctttatgccaccaacaatcttaggtcctaatcttgtggcttcttcagcaggtaggacggtgacccagagatcccatctcatggttcctttttgattgctcattgccatgttccaaggtttcatcaggcccacaatggtcttgatgtacatggattttcttcttatcttagtgcaagtctgggaaggctattagctgtttttcattgctttaacttgcaagagtctattggagcctgggagagtaaaagggcaagaattagataactttaattttagacatctctaacgagtctgaaaagattaatggggaaagtagatttattctcaggtaaagggtgggggtaaatgctgagctactgtttatccttctaagaatgtttagaatctctttctcatagaaggaagtaaagaaaaaggcaggattattagccctgctatacctggggtggtaccaaaccatcaccttcactggctgtcagcagaactgatgagtgaagaaaggatcatggctgatgcaatggtggggaagtgattttgtatggaaggccaatccataaataatggcaagtgtaagacatgaactagtatatttcaagaagtacttcagtcacacagacattttgtagtttgtctttttatttattttattgctcatgatgtaacattgatgatgtaaatgatataattataaaatatttagtttagagcaatgcttttacattttctcttaagaaaattaagaatttaccttctctagtcagaatggctgagatcaaatttttactcaaatgcttgctagatatcaggtcttggacaagtattttaacctcttgtgcctcagtttttccatttacaagatagaaattaatagcacatagcatatcttgtatcaggtcaaacagatgttattgttaatgttgttgttattattataagcattttggcctagcctcattttaaatccttcatgagatgttgcccagatctggttatccatgtgctatatcctaacctctctctttgtgtcccatgttttcacattcaaccactgacccaaatgcagtccacatacataagcagagttaagcaaacaaggctctgtggaatgaattctgtaatgagaagactgttgatttatactgtcctctctgctgtaaataacatcttcattttaacatatgtacttttcactatgaatatatgtaaaattgtctctatattttaaagaataaaactgatagaaatttggctgcaatcctagccatttgggtgagatttaattattattgctagtttaatctcatgctacatatttcaaaaagtcactctccaagttcaggatatttattataatacttcattatgctaatttcatgttttataagatgacaagctattgtcatgatttattccttgtctatattcttttgaggaagccaattgaacgttaagttcttatggatgtatttctttaaaaagtggtagtgtcataccatgtactgtcattatttaaaactgtgacattctgacagtgtgtcagaaaaaaatggtggctgtgtgaaatttacatgcctaagtttgtaactaaaactaattttgtcaggatatattttataattaccaatttaaagaagcgtataattaaagtaaaatgagctctgcttgtgcctagaaacataatttttaatgcttttgttagattttcttcaattgaattataatatatttaatttatatcagaaacagtgatagagtaagattatttttcaaaaaattgcagtcatttggagaaattcatgaacaacttactatattaattattttcacattaatttagtgacttttaaaagaggaacagcaaatcaaccaactttcaaatgctcccccttcttatacttctgtattttatttatagcagaggaaaacctttcttcctttcttcctgtcagctgtgcagtagcagttctactgaaattggataaagaatctccaaaatatgctttagcactttgagttagcctctgttcaataatttgagtaagatgattatttttctagctaaatcaactacatggtttcatgatataggtctaaaaagcagcttatttttttaacattcctgtataacactttgaaaacatccctcagtaaggggaatttatttttacagagtaactttgtagacatgtaatgaatgttttttacatttggattctaatgttataataatgtgcatttttagttcctgatctcatcttccttgcaagggcacttgctgactccggccagcctgatcatctggtaacagcgtaagacttgcagcgtgtgtatgtgctgaacttcattaccattgagtagaaatatttagtcgccatattaaaaaggtttcattattgaatgtatttgaagtggcccgcttaggaaatgattgggcatgtgccactacattcaaaaaagatggtgcatatttttaaaaccagctatctttctgaaaattgaaggagatgggtaaataacatctatttttgtataaaaattaaataactgtgaatgatggataaatcgcttaacttctttggacttcagttttctcatctgtaaaataaatgtaacattatccttctctggtgagttcaaatagttttaaaaatgagataatgagataatcaatgtgaaaatgctttgaaaagtatagagcactgtgcaactttaaggcattactatttttcactattgttttgatatttaaatctacaacagggttaagtacctttttcctggtaaacaggaatggaaaaataaaattattgtctttaagataattcacatttcagaagtagaaatagaatgtgcacaggctatgaagatacagggtaagttatatataatcaattgaatatgcagtaacaactcaccatgttggcaatgttgcagtgggtggtaaagtaccattgctattcaaagaaatatctgaacagaggaagagaaatgacaacgatgttgcagtgataatgacaacaatacggatataatctctattgaggcacaggtttttgtctctttttccttaatgttttcttagatccaaggattaggctcaaggtacgtagcaggtacttaataaatatttggcagtattactgagtgaatatcacttactttgacataaacaaaaagtttacacctattttcatgtcatcaagaatgcatttagtatttcctacttctactgaaaagtcatgtagtttttgttatttattctattaatatggcatcttttatttattgattttcagatgataaatcaatcttgcattattgggataaatcctacttggtcaaggtatataatgctttttatatagtgttgtattctatttaaataacattggtctataattttcttttcttgtaatgtgtccctcagattttggtatcagggtaattctgatcccatataataaattgagaaagagtccttagtctttaatttttatggaagtttacagagaattggcattattattatttttttaaatcctcggtagaattcaacagtcaactccatctgggcctagagcttttcctgtggaaggattttaaattatgaaaccaaatcctttaataaatatcgtgctattcatgctacctatttcttcttgaatttggtagtttgtgttttccaaggaatttgtccatttcatgtaagttttcaaatgtataggcataaagttgttggtaatattctcttattatgctttgagtatatgtagaatctgtagtgacgtcattatttccattcctaatattggtaattagtatcttgcctttttttttctccatgatcagtcaggctacaagtttgtcagtattctggatcttctaaaataatcagcttttgatttcattgattttctctattgtttttctactttctattttactgatttccactctgatcttcattattgcctttcttcaacttcctttgggtttcatgtgcttctctttttctagtttcgtaaagtggaagctgaagcaattggcttaagatctttcttcttttctactataggcacttaatgctataaattttcccctaagttctattttagcagcaatctgcagattttgatatgttttcattttcattgtttaaaatatttttaaaaaattaaaaaagaatgtactatgtgaagtaatagatacgataatttgcatagtagcttcattgtgtatatgtagttcaaaactttatattgtacaccttacagttatacactaaaacataaaaataacatatttcctattttttaattcttttatctgtagattatttagaaatgctgtatttattttccacatattttaagattttaacatatatgtttctgtaagtgatttctaatttattctactggggattaaaaacataacttctatgacattaattcttttaaatttcttgagatgtgttattgcacacaatgtggtctataagaccacatttataggtaaatattcaatatgcatttgaaaagaatgtgtattatgctgttgagttttctacaagtgctaatgaggtcaagtatgttgatagtggtatttaagtcttgcatattcttactgattttctgtctatgttttctatcagttattgagaaaatagtattgagatttcctactataattgtggatttgtctgtttttccttgccattctgttaatttttgcttcatgtgtttggaaccttttttattaggtgcataaacatttaggattgctatatcctcttgataaattggcccctttaccattatgaaatgatatttatctccaataatattctttgctttgcaaactatatgtcttaaactttcttttgattagtgttagcatagtatatcttttccactccattcacttttaacctatttgagtcatatttataatgagtaccttgaaggctgcatataattggatttttaatccaatctggtaatctccacctttaaattggaatgtttagaccatatacctttagtgtgattattgatatggttaggtttaaatctactattttgctactcatttcctacttgttctgtccgttctttgttccctttttacttttgtacctttttatgggttgattattttgaaaatgattccattgtatctccttttattggcttattgtctacaactcttagttttgttattttagttgttacttcaggatttatagtatacatctttaaattgtaatctatcttcaagtgatattatagcatttcatgtatatcacgggaattttaccaaaagtgtgtttccatttctccctcctattgtgctgtcattgtcatagattttactttatattagttataaatcccatgctgaatttttatgagttttgtttaaacattcaagtatctttagatatttaaataattaaaaatgtttattttttcatatggttaccttctcctgtgccttttattctttgtataaatcaattttcccatttggcatcagtttccttctgcttgaaggacttccttaaacatttgttgaagtccaagtctgctggtgatgaattctttcagtttttgtatgtttgaagaagtcttttccattttctgtaagatattttggctgggtatagaatcccaagttgacttttttttttcttttagtattttgaaaatgttggctccactatcttcttggttacaatgtttctgacataaaatatctgccatccttatcttttttcttttgtacttaaagtgtgtgttttcccccctgactacttttaagattttcccctacctccatgactcttttggagaaatttgatgataatgtgccttggagtagttttattcatgttttgtgtgtgtgtgtgtgtgtttgtgtgtgcacacacacatgtgcctggtggttgttgagctttttgattctgtggatttatattttccatcaaaatttgaaaatttttttgccagtatttcttcaaattatcttctactctttgggggcttcaaatatatgtaacttaaaatgctcccacatgttgacaattctctcttcttttttaaaaaatttaattctcttttttctgagtgtttcatattttggtagtttctgttgctgtatcttcaggtatgctaatctttttttcctgcgatatctaattggctgttagtctcatccaaagtgttttttatctgacaggttatagtttcatctctagaacttctattttgttctttctaatgtcttttatgccactacttagttttttggacataggggatacagtgacacaactgtttcaatgtgtttttttctattttctcttcaattaattctagggtttctatcagtttttggcctattttgattgattaatttttccttatttggggttatattttcctgctaatttgcatacctggtaattttttattatatgtgaaataatgcaaattttactttcttgggtcttgaaaaattttttgtacttctataaatattcttcagctttatctaaggacagttatttgaaaacagttttatccttttggttccagtcaggcatgactagagtaatgctgtctagggctattacttctcactactcggggaagcctcttcagtttactgtactcagtgtcccgtgatcaaagaggctttcctctcatttctagctttttgtgaccataaagaactattacctttaattctttaggcttattctttccctagcctcatttaatttccttacacacatgtacaggtcagtaccctgctgatttttcaagggaagaacttctgtataggcctggaattctctgtgttgtttggtgcttccctctcctctctgattcttcctcctgtgaacgctttggtgttgtcagactttcagctctgtttcttccactctgtgagtttcctcacttattcttcggtttctgctcactgccccatcactggaaaatctttcaaggcattaaactggaacaatatttggtctcaccttgaaaatttcacatctcacagggattactctcctttgttgcctcatgtccagtgtcttaaaatgtttgcttcaaatattttgtccatttttaattatttcaggtgggatagtaaatctggttcattatgccatcttgacaggaaatggagtttctgactcatagtaatttttatattacaagaaaaatgttttaaatgcttactttttcactttttattaagaaggctaattacctctctgcctcaattccctcatctaaaaattagaattatagttgtgcctactttcggagtggctgataaattttactgatgtaatggtataaatcactgaatagacacattgcaaacacccaataaattacttattttatcactattttatattacaaatcacatgaaacagtctttcatttgtaaatgctgtctgtccacttatattgaattcaatttctatttctattaaacaagctgaatatttgcgttatgtgcaagcaaagagtgaagtggatctactgaatgagagagaagaatcatacatcttgaaagacaggtggtaactgtgaatatagttagttgggtaaaatttcttgggagaaattgtattaaggacacttacatggtgctcaaaatgttcctctgagagtgaaattccctatccggagaaaagattcccagtaacaatttgccaagtcatttatttatgacttggatcctctcggtaccctcctgtataaaatctcctgtcaaggaagacacacatttatttccatctttctcagtaaaagttgggctgttaaaccagcagcatgggattttaacatatctctatggtatcttactcatcagttttttttaggcatgtgtcactaaaactacccactggaacacatttcaccgttccctaaggtgaaatgtagaagctacttaacagtaaatactttatgtcttatgaacttttggcaaggaaggtaattagtaacttggtatttaaaatgtccaaggaaatttatgttatataaattcttaacacagttataacatatttgacagagtttaatggaaacaatattaggcatatttcaaatcatcatagaattcagattatctacagaaaatgttgcctagtgtatggtgtgttcagctctgctgtgtctctacagaatattgagaaagggaagaaggagcgattttttaaactcaaaattaaaacagaaatttaagcatatttttatattaaagaatactttgcttaatgtacatttttaaaaacagcaaaatataaaacatagaaataaatttctaccttggatctaactagagagctcttttgccttctctacttttcttggattcagtaaaaataacaaccatttccgcatagattttatgggtactgaactgcattttctcaagaaaacattattttcttagtaaattcgcctttatatatgtatttacttctaacaaaaagaatcatagtattgttttatcaaaaagtaagcatagatgatatttattttaggatacccactaaagtaatacatagcctagtctagtctagtatagttcagaaatagtttagtaaacccttatttttccaataacccaactgtattgggtcaggaccaagtcatatctgccttctttacaatttcttctgtgttgagcaattcaatagaaatatcactttttagggtcttaatgagtaattgtcttgggggagtggcctttgacagaaaatattcagtttcttagcacatgtaatgtgaaaaattagggtatttcagattataagtaaaagctggaaatgtcttttcaaaaattatttttgttttgcaaatgctatgactagtgtcttgaacccagtagatgaaaatatctaataagatatcagaggtattatttgttgattatgtactatgtggtaggaactagatcaagcactttacggatattatttcaatgacttcttccaacaagcttataaggtattattatcctcatttcacagataaggaaactgaggttgaatggttaagaatattggccaagtagcacagaaagaattctaataatattgtctgatttcacatatagattatgttagtgactgtttcatagcacttatgtttacaaatggcttccagaaattgttcaggtagtattcgtacttaaatagtaaatcaaattaatctaccattctattggtcttaaaatcatttttctttgcatcccaaattaccattgtaaagttttcagggaagatagaatccacatattttcagcctttgttttggcagaaaaaaataggagttaaaaatttgcaatttgttcaaagtgcaaatatgctgtggcattttggcattattccaagggcacagatttaacttggaattttggtggctgttactgggaatgtactgtttatcaaattcagtgttaactgcacagttgaagattttctagcaaaactttctctttttaacactgaaaaaaattcaccaaattctaaggattgataagtaaaatccataaggagctgcagtctttaatgaacaaatcttctattaaaaagtaatcagtcaggtcattccacagagagcttgcataatcgggatttggatgatcttgggctctctactaaaagctcacggcctcacatcttaatggaaataagagaagatgaagtttatagcccttcacttatgtaatgagtgaaataaccagcaagcaaacacctgtcagatggtagtaggtgctcctgagaggtatgacaggtaataatttaatcagatgcattggtaattctatgacctgaaagggatattgtgtttccaaagcccagaattttctttcttctagataatgctgtgtccttgtgtacaaaatgacttaaaatgaaacattagaatgtagaatatattttagcctaaaatgttctttagttcttcattgctttcaggaatttctccctcctttgtgcttctaaattgttaatccatgcagatcatactaagcattatttcctttcatatattagaacaaatatctgattaagaggttattgacattaggaatcacaattctcctagccaaccacacagcgggattcaaagcttgttcatttaatgaattgttgtttagtgaaagtacatgattgtgttctcataagacactttgttccctttattattcaacagaagacaaaaaaaaaaaaaaaactacaaaatttcaaggacaattttttgcccttttagcttattatgctccctggaacatacatagaaagaggtgcatttgtttctcacaggtggatgagaattcattttatcttcttgagccaaggccctgaagaatctgattttcaccttttatttgactgggtgactgattctcttttctttacaagttggtgctgcctataccttcattcagcattttttttccccttttacctgtatttttgggattttactccccctgctggcctctggcatgcattagagttgactcttttccaacgactcctgtttctgtctgtttctcttcaaggagccgcatgtatagtacatttatgttccaaacacagcagaaacgacatgagtttaaaggtaggtattttaagttttcaggaactcatttttctcaattttttctagagagactaaagtagaccaatgctaatttagaaaatatagaaacaacattctgaatttttgaatgctaaatgtaattggtttaattacagatcattttgctaaagaaaagttatgttatggcccataatgaagaaagtttctttctccttcctaggatagcagtaattgtgctgcaaaaaacccaaaatgtttctattttaaaaatgtcttatgaattataaaacctttgaaattgatggcttgatgttgcagataaattgaactagatttcaaagtacagttaacttgacagtgctttgaaacaagggtcactcattgtcattacatctttatgactatttttatgagagaatttggataatttaactctcaaaaattgtcacatgctgttttagcttttgtagttttgcttttgttagatgtcacaaccgctattaacacaacttgcattttttcctttcatttatgttgaactaaaagatatatgtgaatattttctgggaattatttaccttagattgaagaggagagttgcagtttttacattgttcttttgctgtcattaaaagaaaaaaaatcatctgaccaggaaatagtatttttagtaaatatactctcagaatcttctccttcccatctgaaaataagatgtttttgctttttgataaggtaatggtcaatgggatcgaaagacacttttttcttccacaattacaatagacactggtatggtttattgatgattctcatcagttatatttcaccaaaatctcatagcaacaggagaaaatttcccattgtttggttgggagccagaagctgagagtgcaggtcatttttcttcatctgaggaaagtggaatagccaatccaccactttgttttctaggtctaaaatgatctgttcagtctttcctaattcatgggtgtggcattcataggagaggctggcggcacaaaggaaataagacatctatgcatcaatttctttatattgtaccatgggatgggggttttaaaagttgttcatatttgttttctgcaccatactgaatgaatatttcacagtaactctttttagaacacaatacttggtgaaaaataaaattcaccgtattaatgtaacattttccaatcctagttaccagcactgcaaagtacacaccactcaacaattgctagaatatgtagctatgtgtatttttaaagcatattataaattttcccactcttagcagaaagtgaaggaaaatgagcacttcattagcaacactcttagttgtgcagccaagaaataaaacatgaagtaaggtttctagatactatgggaaccccattatgactccctggggaggcttaggggaggatgtttttcataatgagtccatgcagaaagttttaatactagaacatccttacttagacatttgcttagatttctaccactaatgggaaaacaaaactaacaaaaacaacaactcccatgtaaattgtgtttattcctattcagttaaacaaagggatcttagaccaagttgataaactgcaacatgttcttatttattttattttatcttacgttattttattttattttttagacagagtctcagtctgttgcccaagctggaatgcaatctcggctcactgtaacctctgcctcccagatttaagtgattctcctgcttcaggctcccgagtagctggactacaaggtgtatgccaccacgcccggctaattttttgtatttttagtagagatggggttctcaaactcctgacctcagatgatccacccacctcggcctccccaagtgctgggataacaggcacgagccactgcacctggccggcagtatgtttttaatctgtatctcagtgccctctgtttttacaaagtagatgataagtattgagttttgaaatagataaagggttgacagtcatagattcttgcttttaattttaagagagaagtaggtagcaaattttggagttgaaagacggatcatgcagtaactagcaactgtttctcaaaattccctcatcattaggatctcttgaattgctggtttaaaatatcagtttctaggctgctccacaaaatattttgggtcctgcagttggacatgaaaagcacaagcaccccaggtaattcttatgatcaggagaatttgggaaacatttatctgatttaattaattatagaggcaatgtcagcgattaagaggtaagatatggagtatagattcgtatgttcatttaggaaatgcttagctatcaacacttattgagcatttatactatggaccagatttgagcacacttactacatgtgtgatttttgaacttgtcttttaccctttctgaatctcagtttctcatttaaaaaatgaggataataccttactcatggatttttgggaaggttcaattagatatgccccaagaaatgcttaatttttctgaaaaataccactgtttttaggcatctattatactgtaggggtcataatttaattatttctattaggtatttttactatacaccaagatttcattatgcaatcacacatctgttgttctgagctgtggttcttactggcatcttttggagatgtatttagaggtaaagaatcctttaacaacttttaggatccaaaatctcctaacacaaactttctccttctgccttctctttagcccttttaaaattggtgtatttcctacttaaactcacatatttcaacttcttgcaacactattaaaattacagctactatttgttaagcacttactgtaatccaggcacagtcctggatgctgcttgtattatttaatcttcacagtagtagtgcagtttaggtattatgactatttaaatggagtctgagaacacagaactcagtaattgagacagcatcttataggtatgatgctgtgaagaacagaaattattttaatacctgtatatctgtcttcaagcccaagttctgtccactataagctattcccataactttaatacagtcattttcccaatatgagaacatgaatttctcccattggcttcctaatggttttctgtcactcagagtaaaattcagcttctttacttactaaggcctacaaagcactgcaccgtatgtctttcatgttctaaggcttttgcatttgttggtccctgtgcttgaaactgtcttgccttaggtaagctgtgcacctctccctgacctcattagagatgtctttccagatgacctcccatacttgagaacatctacacacacacacacacacacacacacacacacacacacacacacacacacacacagatattgcccttcctccttgctggcttattttttctctatagcagtgatcaacagctaacatcttaacatctaatatagttttctttattttttctttctcccagtataatgttagtgcctgagaatggtagcttaatgttatctgctttatccccactgcctagcacatagcagggatgcaataaatatttgattctcaaacattgaattgggggacatatctgatattctttatgttagtaattttataattttcacagcattagaacttcatatgtgatatcttggtggttaccctaatattgtctttgttaagtatacttttctaaacaaagttcctgacaaaaaaaaaaatgtggtgttgtgttttacttttcacgccaacaggaatagcactatgcagaaaaaatatgtctttctatgtagaatatttagaataaaaggtttttggaaagatcccttactcaaataatgaagtggctattcaatattaatacttagtatatttcagttgttctttgctttggaaattagggctttggaacatatgtgagaattaggtattacttcagtattaggaggtcttctacttgctgacagaatacttcgtttgtgccagttctggccatcattcattattattaatagtagtatataagcatggtaatgctaattcaataggttttccaggttttttctccctcttgttattatcttttattttgaagtttgcctttatttcaagttgtatttgtgggtattcagaattattgtacctgtgtataactcagtggttcaaaagtcattagtctttaataaattagaatttattttaaaaattcaagatctgaaaacatcatttcattgactctcaagtaatgttaatgccaagttttgaaaagcaatttttctttttggaggcagtaattttgagtaattggattccatgaaaaaaatggattcaggagctaattgtgtaccaggtttactggcatttgtgcaaaacaacatttagcaactgtcagtgacaatactcatctaatttctctttatcaccagctggtcaatcacgtatcttcatcaatacaagtattttaatttcctctttcaggtatcctctttgtgtgttttcttccttctcactctcccttctctccttattttaagctactttagaaaatagtaatactttactgatgtgtaagatgcaaatcactttggaagtgagaaggtggatatttatacatttgttctatgacggggtttctaagtctgtcccactgggaatggttagtacattccatagctgtaagggaaaaatccacttttcccagaaataaaggtcaagagacatggaacaactcttttattatttgctttcaaaacagagggaatatgatttatgtcgaatataagcttatgtcatagctgtgcaggtgctgccgtgaagctgtgacccctgtctaatccccataacgacactgggcattgaccacatttgctttgtagttactgagctgctttcccaggggccttctagtttctgaacccagccgctgggtagctggtcgacccgtgcttggtgcaagaacattgttttgtaagtgcaacctgaaatacattttataacccctgcctaagttaaatgactgtaggtctgtgacggagcctctgtgattgaatcaaagtctcctcttaactcctttttttccttcatgaatttagtagtcggctgtaaatagttttttctgctttattttttattgcgttaaacataatcacaatgatttatttcaaaaacactaaacagttgcttgatatttacaagataaaatgtaatactgactttaatacatcattgcctgatttacttatataatttttatttatcgttgtaagatagttaacatttttccatgttgcttcaatatttttccccttaaagattaatgacttggtaaaatttgcagtaatcacacaaaaaatttgttttccaatttcattctgtcttccaacattttgatctcccagagttttaatattttttaagtttcctatgtgttatgaattgtaaaataaaacaaaaatcccccaaaacaaaaaaagacagctatattaaaagtatcaactttattttaaatcttattaatgctttttataatgggagggaagatatatatatttaaatgaccatgtaaagcaaagtgaggaagttaggaaccaggacgctgaagctaaactgaagttgaatctcagctctatcatgtcccagctctgtgattttgttaatctctcaaaatctgcctcatctgtaaaaaaaggtgaatgatagtaaaactatctgttgcatagctgttgtgattattaaatgagttagcatttgcaaagccctacataaatatttgctgtgtagataatgtttaattttgtcaagaacttttaaaagatgtgttttgagtcattcatacaggcacacacacaggttattacaattttatcaagaaattattagccttgtcttaaatctcaaaaaatttgaattgacggtgaatatgtggaaagtgacaatatacaaggttatccactattggaaggtgtgtgtggaacagaacagaactagatcacatagctgtggagaacaaaagctcaagaagaaaaaaattcaaaatgagtttatatttttctcacaataactgtgggcacccttcaagcttcagttaagtgatgacaacataattagacagtaaaatattctgtttctgaactgttctttgtgtgaccttcagttatctctgaggatcctcaggtttcttaaggtttccttaggctgtctgtttaatctgatttttctgaaaaatgtacatgaataaataggccctccaaccaaaaatattaatatttaacatttagccaaagaggtagcaaatattattttcaaacaaaatgaagtaagatagaagagctgagacaatataatattctgcttagagggaaacagtaggttgccactgatttttagtcctgtgttttgaaaactatttgagatagaaggactaaaattgcaatgaagattactgcaacacagttacttggtcctcctatcattaattgattaaaggtaattgccagggagtcacctctggagggcagtgcagtcttatatttgttgcaggagctccaggtacctttaaattttccagaagttcatttcaaagattcttggccttgtgagatgtgagtcattccccgttttaaatactcaaagggaacgtaaaggtgaaaacaaactctttttcgttatgatggttagcatgctagattcagggaaaatgacgggaaataggacttaccatatagagttagtgaatctcggtgtgcaaataaggagctggctgatgtttgtttttttccccccttttccccactttggttcagatacttgtgaacctccatttcatgatccttgtttttgtctctgtcttactctaaaatacaaatctgtatcttctaagaaaatcttttaacagcctcaccatatagggtgttgcagaaggtcagctcggcggccagcaaaatatcttccagtaccttaacaaatcagcaaaatattttgagaaatgctttacttttatgaacaaataccctgctagttattggatttgtcatagcatctaaggtttctctcataaccatactgaccttcatgtgctattgtattacaaaaccaactctttatgtaatcaaacctaaggaagaatgcttaattagctatacatgaccctgtgttatgatacaggcatacaaaagttattttcttcagcactatctagctattgtacaaagaaacttctttataaagtaagacatgggatatttgatgtctcaggagtaaagtaatattgggatttttttttttcctctgcaagctgtttgagagctttcagcagggggataccgtatttaaaggtagcctaagatctcataactccatgtgtcacaaaaactgtgtaggttatgaaagacttttctcgtgagcaaaacaactgtgctttttagctctaaatcatgacatagtcttgttataccacaaagaattaaagaatgttaagtaaatgactttcttccctccctctgtgcctctgaggatagttattaatgccgattcttgctgctgagtgatcctgaagctactgtggcaacctttttattccctgagtgcaaatgaatcctctatgaggtaattgaaggaaattgatgacattatttgctgtatcttgggtatcaacagcatataaatgaaaaacacagcagaatgcctggcctgtgttaccacattgacctacacatttggatctgaaagatctcgagctattttctgcctaagcagactttgcacctttgtgttttatagtgaagtagcaggtacacaactttttaaaatcatgaactcctagcattggattaccaccacctggtgtaagggataggttttatagaaacacaaagagcatggacttattcttttcatttttgttcttctttgccaattttaatgttatcttcacaatctgaacagtgtgacctgtttcaccttcttttattttgaatgttagtgtatgcacattctaagccaagggtggctttaccctttaagttaaattaaaccatttgggacttagcaaattctgggttgtatgttttaaggtgaaaaaaaagcactaaaaagaaaatttaaaagaaattttatcatcatatagggtgtggatgaatgattcaaatagaaaacctattttaaatcagccctactgaatgaactatactaaaaggacatttatttacctagttagggaaaaaagtcactttaaatatggtctctagttacttttcttcccatttattacatttgccacttcattgtgaccttactatgaccttgtagtttatgggctaaaggtaaccattatgcaataatgaaaatatgcaggccagtctttaccaccttgaaaaaattggtttcttatattttgtttaaattaacacactttgctatttataaagctctgctctacggtgcttgaaagaggagagaagaattaatcgcaactaatgtgcagatttaggcttttagagactgtgtttagtggaggtgagtcagcaggccttgttatattaattatagtggtttgattctctactggttttgattcacagagatatgcgctgtacgtaagaattaaagcatcaattgcttaggagaaaaaggaacttaaaaatcaaaccattaatacctatctttgctttcttcttttgtctaatttgttttattttagttatccaggcccagatttcctccactttccctttgccttgatcccaaaacctgacctctgtgaaaaaggcaattcatcaattggatgtggtgagggaaatgcccttcagaaggatctaaaacaggcaatacaaaaagctttagacagtcaacacatcggggcacgtaagctctgatgtgacttgttatctctgagaccagtgtttgcattcttcctggtttgttccttaggcttggaaatgcactgaaaccacagctggtcttgaagagccatagaggatgtgatacaaggaatgataaattaataattacagatcctcaatctgcttattgtcagtcattttttctaccaccagttacaaatccagtctttattctcaaacagaagtgatgataattatccttggtaaaataactttcacataatgttgattgcagacagtcaccaagggctatgctccaagtacacttctcaccatttttatacatgaaataaaaactcttattatctccacttgtccatgaggaaaccaatgtacagagaaattaagtacccttctcagggttacacagaaattcaagagctggatttttaccacaaaggatggtttagagcctctggtcttaaccttccaagagtctgggttcttgggaatcttcattttcaacataggctctttatactaccagaactagcatgttcttcagatattcaaaacggagacttttaataagttcattattaaagaagtgaataatttaggattaaaaaaattctgttaaaaatgggttgctcataattaatgaaggcagatatttaaaccatgaatcctttataaaaccttgggatgtgaaagcttattttgaaatggactgttggactgcatgctaaaagtatacccagagtgaattttcagagacattagagacaaatttaacatcaccctcaaatctgtggaaggttaaatatacagagtgtgagacattgagaattaggcatttacaggtacttttccccagagtttggtttggtgagggatttaacccccatttcgtgacactgatcaaggcaggacattttgaaggaaaagcactacaaaaaggaggaattgccttgtcatgttatgaagcatttaattctaaacttctctgttttaaaaacaaaagaggcctatctatagataaacaaagtagactcgtgatttccaagggctggggcaggaatgggtgggtattagccataaactggctagagggatcttactgcaagcgattgaaatgttccaaaattggattatagtgatcattgtacaatctggtttaaatgaactttgaaatcattgaattgtaccctttaaatgaccaaatttatggtatctaaatataccttagtaaagtcatttttaaaaatgcatgtaaaaaaactaaaaaagaaaaaaaggaagatccagaattgggtcttcagacagaatcattatttgcatcaaattcagaatttcccgtacatgatattaatttacttctctaatttgaagtatgacactaaatgtaacacgttaggtcatacatttggcaaagacaaattcttcctgcctgtactttttcctttcagtttttaataggtggcgccattattctttgtagcctctagagggcagcacataggtttttttttttttttttttttttttttaaagacaacaaacttgtaactcccaagcatcaagaatgcccagttgtttcagatgaactctccaattttagttcatcctgacgacctcacagtggaggaccttcctatagtgactcctgcgaatgaatcctcccttccttcctgttagttgctccctttcacctctggctatttaatgtccttgaaagatctttcagctctctctacaggggaacataggagtaatttcagttgaaactttcacaacctttttcctttagagagcttgatttttaggtaaagacaatagtcagttaatgaataaaaccggtatttgcacatgggggagggttgatgcccaggagattgtcataagaattcctgacacaagttcttcagatcgcatcggaagaatccggctatgccaaaagataaatgtagagttctcctcaatgtatgaataactagggatgcaggatttaaaatctataagaatttttaaagttgtaagacataagcatcctggtgtgttttttgattgttgttcttttcatttaattatttattattagtttatgtacagtagaagccaacaaataagggttggaaaggtaaattaactagcattaaggtatatactgaaagtcattttaagaaatgccttacctcttctcatccccacgattaatggcattttccctatgatcattgaattttaaaaatacctggaaatttataccattctaggatcttatagaatcttataggatttattggagttgattttagtgtaggagcctgaaacagttttaggtccccctcactatgtcttattgttacttcgtttctgacattcttcctatatatccaatctaatatatatgtgaaaaagggtagacatcaatcagtattaagaaacaatgagaaatgcctgaacagacctttaagctgtgatttaaaaaaatcgtatttgggtgatcctagcagttaaattgactttttctttccttctgtcgtctctgttctccttttttttcctcagtaaactttgattgcttgctaattgtgtgctaggccttgtttggttgtttattgagagaaagaaataaaggagaagggagagaacacaaacacaatttctgcccttgtggaattatagccagtataggagacagacaaaacagtatataaacaaaaaataacaatacataattacagattgaaatcaattctaagaaaaaaaaggtcagtaagtatatataacctttggggccaactttaggctagagagttaggaaagaatttctgaggaggtgaacttaggtggccctaccacataaaggattgggcaaagggttatccaggcagaggaacagagtatgagaaggccctgagtcaggaaggagcatggcttgttgcagaaactgaactagtgtctcagtgtttcactgtgaatcaagaagtaagctaggatgtggcttggggaggtaactggccaggactgaaagatctttgtgaggagcttggatttgtttctaggttgagtgatgcctccagagggcaaaagaaaaacagcaacattatctgattttgcttttgataggattattctggtttctctatggagattggattggagaggggctcatatgaatgtggcagaagtttagaaggtgtagctgggtgtggtggtgggcacctgtaatcccagctactcgggaggctgacgcaggagcatcacttgaaccccggaggcagaggttgcagtgagctgagatggtgccatgcattccagcctgggcaacagagagatactccatctcaaaaacaaagcaaaacaaaacaacaacaaagaagtttagaaggtggttgtgatctagacaaaaatgctcttgcaactgagtttcacctgcaatttaggaatgggaagtaatgtgttgagtccactgatgttgggagcacaaacacttatgtaggaggtagaagaaacagttttttttcctataaagttataaatagcttttagcttattaggtgtggctatgttgagacagtagttaatgattagtgggatatttaaaagtgattttggaaacatgaatatcttgtgatttttattttatgcaaactggcattgattttaaaagctgaggcaatttaagcaacttcgaatgagtgttttctctctgagggttggaatttggaaaaaattgaaatatgggagcagatgagaacatgaagaacttgataagtatacctacatatcctttgatatcattgttaggaacttatcttttaatcgaatgcatggtgccataggttattccttctctatatcacttagtacttaagaacacaaaactagacattagtagaatttacagatacacatttgattcctggctttaccacttactctagctataactttagacacctgtcccctcactgatatttctgaactggaaaattgaggtataataaccacgttagaagaatgtggtgaggattatgtgaaaaaatttatgcaaagtacctgtcacatagtcagtagtattcaattaataccagattaggtgatttgccatgatttgcccaaggacaacagctaataaatcgtaggactaatatttcaacccagaaggccttatgctaaaacctgcactgttcatcactgcccagtacttctttcttaaattggggcagtgaggccgggcacagtggctcacgcctgtaatcccagcactttgggaggctgagacaggcagattacatgatgtcaggagttcaatatcggcccagacaacatggcaaaaccccatctctactagaaatacaaaaggtagccgggcgtggtggtgcacacccagcaacttgggaggctgaggcaggagaatcacttgaacctgggaggcagaggttgcagtgagccaatatcgcaccattgcactccagcccgggcaacggagtgagactctgtctaaaataaaataaaataaattaaatagtaaattgtggcagtgaagggacaaggagggaaggatatttgctgttgtcccaaactatcttcttacttcttttcttccactaacctgcttttcctcaactctcattcacattttctaaaacttgagaatgaaaaattcaaaattgcataaaagtagagcaaatagtacaatgaacttgcatgtaactgtagtccccagcacctgctttgtgtctccagggacccagcaaggttgctttggtgattttttttgttgagatggaatctcattctgtcacccaggctggagtgcagtggcacactctcagctcactgtaacctctgcctcatgagttcaagcaattctcctgcctcagcctcccgagtagctgggaccacaggcacgcaccaccgtgcccagctaacttttgtatttttagtagagacagggtttcaccatgttgggcagggtagtcttgaactcctgacctcaggtgatccgcccacctcggcctcccaaagtgctgagaatacaggtgtgagccaccgtgcctggccacttcggtgattttctaaccacactgaagggcattttcttaaccctcattttcctctgcagttagggctcctgctgacaccaccttctgctctgccttagcattgccacaggacacggttacctcaccttccaccctccgattctcctctctaaacccctcacttcttgctcttctgctcttcttgttctagattgttttcagaaagtttttatggtttcttggactcaactataattgtaattaagagattaatctccagtcctaacctcttatcctatgtatattcctacattttcaattacttttaaacatttatggcaaaactcatatctgccaccaagtggatggacttcctttgtgccatcatttttctagtttacataagtgaaatgttcaagtttttcctctgtactgtcgtactccttcagtcatttagacccaatgtcctttggtaatatttttcagtatcttctccttattttattttcctttttctagaaacatgcatcaaccttatgacttgttatcctcattttaatcttttcccctacactttctgaacatctctttagccataaatttccagaggcctctccatttgctgtggaaaaaaaggagaatttaagaattaccgtttcaagtgcttttcctctcactgttactttaataaattcttttcatctttcaaggtccacttcaatctcatctcctttttgaagatttccatattctttcctcaaagagtaatatattcctttcatttagttactacagcactcttggcaccactcatttcaaaattattatgtagtacattgctgacaattttttttatttgtcttgttataccagtaaaaatgtttactttccaagagttgacatttttttatacttacttactttcagtgtctagagcatttgtttatacataatagttgaatgattgattttcatactagacaaataatgatcaatgggtaaattaattagcagtaagttatatacctgaaaattatttaaagaaatggcagaataattacccttgtctgggatcagttttgtaacatgccacagttaaggggcaaattttcagttcattaagcttcttccaaaagagcctagtttcagaatggaatggtgtttctcctcttctgagaattataagaaagtgctttagctagcaaattttttttttcctcccaggtggttctttgtctacataccatccaactatgaacaataatgtattttatagactatactaagatattgaaagttggagagatgtattcctttgtctgatcaaacctagcaaggagaaaaactgggttttcttctcctaaaatattaaattccaaaaattacaggtactcattaaaaatctcaaacaatacataagtaagtgaaagtaaatggtgatgaaagcctcttatccacccacacctctctcctgaagttacctagaccactgctttcagttcatttcaaacatctaatctattgcatgtcgatttatttgggtagtattcactgccttccctaccccttctttaccactgcacctcaagaagacctgaaaacctttaaattgaaatttaattatttcaatttaaacattcttattctgtatatttggtaaataattatattcacttatattacaccagggaaaccaaaggaaacattcatttctctttctttagaaacattttaactgactcaataggcataaaattttactgagggttagatttctgttgaatatatggttaattctacttctgtttaaggaaaagaccttaactttaattcatagagcaatgctgttgcaaatgtgtaattttccaaattgtccatagtccacaaaacactttaatgtattatttcgtttattgcaaggagagagagaaaaaaaaaaacattctggcataaagccaactaattactgatacactcaggagactcaccgtcagtacatgatatgctattttcctccaagtgttccttatttcttcccttctctccttgccagctccccgcccttctggaatttcttggttcaaggacaagtgctgactcagcatgggccaccttcttaggctaacttactgctttccctgctcctaaggagtcaccagagggggagcaaatggagcaccagcacattctccaattctcctaggtgtcgtagctctcctcactgattatgaattgtttctgggagaacagaatgagctgttaggctgcaaatgatctaacctttcatacttgaccatgtagactttccgcatttattccagtcctcatttccaaatttcactaacagaattgcagagatcgtaggattctattgtcacagaatagaaatctgtgatgcttatgtgttgcaaacctaatttctctatatatttgtgttagaggaaagttatatttttctattatctttgtagaagaactttggtttttaacaatcatggtaacttaaaaacaagtttcttggtaacttagatgatccagtcattaaaatcatgatatagattctaaatattggggaatttggagatttatgattcttaaaggcattataaaaaataaataggtatatggtatacagttctaaatagcttggaattatgagtgtaaatgttaagtgtactagcagtgatttctctttaaaaaataagcaaaaattgaccctggattgatgaaattttttttaacccttattcatgttgtaggaaattttatagacagacattgtaaaagagtgaatggattgctattgaaagataatctgatatcaacttaacttgctggtgactttaaatttcatatactggctttcatgctacatttatatcttagcaataagtattcatgagtctcatatttgaaggtagagaatcttgaatagtaaagagttctggtttacgtctttaaaggtcagaaatatgcactgttatatctagtttgtatatttcctctagtaaaaatctatgcctgactgaaagtgctgaatttatggtagaacaaaagagacttatcccacccagattgattcaaatacctggagataccagtttcagacatgtgttgatacagcttattaaaatagtaaactcactaataagcatttttgtattttggattgattaaagaatgtttatgtcaagaaaagcatattttgaaagtaattacaaccattagttataattaattcggtttatcttttttaaggaaggctaggatttaataaggtgggttttcctaaagcctttaatccatggcttttattttcaccacggtagattttccatataatttccctccttactttttcttaatgtcagatgaggtatatatatcttttgtaacttcctggtgtctgatcttagatacttctaaagctgattgtgaggattaatggacagggattctatccagtaattgtgggttttagaagaaacatactcatcctagagaaagaactggcacacatttgcccatttttgtagaatttggcctagattcgcaaagaaaaaaataaattttggagacttctgatggttcattttcttaagaaagaaagaaaatgttgttattattatttgcatttggtactgtgctatgtaaataaatcagtggcatctaagttagacttgattttgaagtgctgttattgattcactaagaaccactaagtttctccatctgcttcctatttacaaaatggagatgttttctgtttctaatttgcccctcagaagtgcagtgttataaggattaattagagaaagccaatgggctgaacagtgaggaagacataaatagagacaaacggggacattaccaggtgcctcctctttttgttcatggttgatcttcaatctcaatttttttatacaaagggcatctcattgtattatttggtccaatgacttgcattgaaaggatactgactgccccagaattcatttgcttttcttagtgaaatgccttaacattaatatttttcagggtctaacttttcctaaagattttcaggtcccagaatttcattctgaatggttgggctttatcagattatttttcaatagcaagccattcactcttttacaatgtctatctataaaatttcccacaatagttcataatcctcttttcagcagccttttctccttctttatcacttcttttgtccacttattttcaggatgcaaagttggcgtcactgacttgctcatggcttcttgaacatctgtgtgaggcaggattgctgaagatcccaggcttttgagttaaactgcctggggctgaatccctgttctaatctggctgtgcagtgttagtaatggtacctccatttaaccatctttaaagcgaaaaatttctcatggattcctgtgaggattaagataatataaggtctgcggcaccggcatatgataaatgctcaaaatagtactattacttgtattaacattagaaataaacatttaggcacaaggaaggaaaaaataagcaatcaggaggaagaaaaagagcagtcagaaaatggtgagaattagcatggggtgtgttttgaaagtaaagaagaagagacagtcattcgaaaatagagaattttctatacctttgctactcagaatggctcctggaccagcagcatgggcaccctggaagctttccagaaattcagaatctcaggcccccaaagccccaggaatctaaatctgcattttaacaaaatccccaggagattcattttaaagcttgagaaggcctggtctacaacctaacatgcagcagagttgacagatgagattaagactaaacaaaccttcgaattttcctgctagacctttagtggagaaaacagggaggaatgaataggtggcaaataaaagagagaaatcaggtattgataattctttcaggaagctcaaaaattaatcagggtgaaaaaacgttagataatacctttaaaatgtagcagaatcgaagggaaatttatttttatgaacaagaaaaagttgagtctgtgtgcaggtggagctgaagtgtcacacagggtaaaagattgaaaagtaatgaatacatgaagacatggatagctaagagatggggcaaagagtgtttgaaaaacattgacagctggtaagtttcagaaaaacaccttcatagactagtgcaaagatggaaagagtgaggtcaataagagagaagatatgtaattaggtgtcttcagggctgtttgctgggagtaagtagggcaggaatgttattggtagctgatgttttgatagggttagaaccactttggtgagtgagatagaactagagttgtaaataaattttagatctagtgtgaactctgataggtcggagctgcatggaatattgtgttgagaaggcttctgaggccaacataatattaacagataagagctatgtatgtcatgagcagttcctggcattataattagggagacatagtagtgtatgctctgcacattcaccatccctggtataaaggatctcctggccttgtatgaaattattgagtagaaataaagaactataacatgaaagtgtgatgaatcatttttgcagtattttgtcttctttctccaataatccttagcctaggaatagaaaatacagacaagggactaacgagcagtaataagcttatttttgaaaggcttgacttttatagtctttatgacttttttttttaataaaaaagcaaataaagcctacatttgaacaattttatgttttaaaaagtgtgggctcttgtatagaacagactatggaatttgaacatcacatctactactttttagctatgcctttgggcaaattatagttaagcattttctagaatgaaaaactcagttttctgagtttaatattagtagtaataataactaatagtaatttccaaatagagttgaagagaagattaaatgaatgtaacatcatgcctgatgaattcttctgctggttacttttatcctttagtgttgttttcagttgtttttttttttctgtcaatttcttctctattaaaaattgttttctgtcaccacgcaaagcaaccaggaatcatagattatggttgaaaaatcaaatggcaggctatttgaaaaatatttatttcaaaattttatttgaaaaaattccccactgctataatttaatgcttattcctaatctccttaatttccgttgctttatgtattatatagagataaggtggagggaaactgatcatgggtgatgataactgcagaactgctgtaagcaaggcttgttcagaaactgacaaatctattacaaagtgactcatggaagtggaggttctgtcacaaacagggtcagttattacttggcagtattctgtgtgctttagaagaaaataatgggctgacatagcatagaactttgggaataaaagtttctggatcatggcagttggcccaggacaccagacctagaatttgcaccggtagaatttgtctgccccaaagtaactggcaataatgccaatcaagacttgtgcctactcttccatgggttctggtccttcagtcacatttggccaggaaccttcttggctgatgaacttttatatggatacactataaaagagcacagctgagagccaaggagtgggatgcattaattccataaccacattttttctttatccttcaaaaaatttgagaatatatgacactgacagatgacatttttttggcagtgctgttaggtctttgctacaaggcagttctccatctttgtagttgcagagttataacttggtttctaaaagaaatcctcatagctattcacctggctcatatttcattctcagcttgaaattcaaatgtattgactctcctatttttatgtaaagtgatgcgtttagttagattgtcacatcttctatatattgtgtacttaatcagtttagtaagaaaaaaatctatagaaaatgctttggatgaagtatgcctattaaaatctcctacatttggctagttttattaacatgcaattcttaatatgtagcattcactacctttctatataactagtttctcattctcttcccatctgtatgagattttttcattttctttcagaatatacatcaaaataatgcttttgtttctttttcacaagtaatagatgttcatatcagaataatgaaaaggcacagataagtaaatagaagaaatacaatcatatttaattccatcattccaagaaagccattgttaattccagtgcattctaaggggttgcaaactcagatgcatagagaaggccagttgatatgataaatgtacaaatcaagctggatgggagccatgggactagtccttgcaagcatgtgggcctggggtcccctgttcttcctatttttcaggagaagaagggtatcagatttttatataacacatctgatattgaaatttgaacgtgataaaaattggtaaagactctgtagaaaccaaacagaataggtatgcacaccttttgctttgttccttttgtatatataaactataatgttagaaattacaatggtgtttgcatttcttcatttttaactgcactttaatatttcttccttgaataaatgacatttgcttatctcatttcctcttgataggcatttacattgttttaggctttgctattatggcaatcattttctgaacatgcttgtgcatgttttctggtacatgtatgggtataaggtatattggaagtggaattgctgagctaagtcatagggtgggtacatgttcaactgtgtaagataattccaagttattttggaagatgtttgaaaccaatgtatatgcccatcagcagcctatgaaggctgctagtgtttcccatgtttcccaacacttgtatgtttagattttttcatttttgtcgtttggagaatgttcgtgtgatcatttgcactttcctgattagcatgaggttgagtatcttttgaaacttattgatttgatacttattcaacatagtgtttcgacttatgggaaatgcttgctttgtctactttcttttgaattgtttctatcttttgttgacttatggaagtcattgtaataatttgatactaatcccgtgtcaattttattaccaatatcttttcccagattgcatatcatcctttcacttccttttagtgtcattgataaatggaagctttctttttgatggattcaaactttttttttaactaaacagttaatactttttaatgtcttgtttgaaatttcctatgaaaggtcataaagatatcctcccatattttattctaagatgaaagtgatctatcactttaccttttaatccatctgggatttttttgtgtttggtatgaggtgcagatccagtttcatttttgttttccatatggttagccaagtatccctgactaaccggtgatcggcagtgccactattgccatatatcaaatttcttatatatcaaacatgctgtttctgtttctgaactctgtttggttccattgctgagacctttgcttctcatgtacactatgtttatagagcaaaacatattgttttgctaaaccgtgctttattttctgggaaaaaaaacccccaaggtttatattaattttatgaaaaaatggctgtcagtttattttataccttttcccatctgcccctttatgctgattataaggattaaccctttccattatctaagctttatgatgatccacttgagtaatattggaaaagaaggaacaacatgtccaggtttcagacacatgctcagtgaggcaaaatggaatacagaaattcctacctaagtagtagccaagtcaaagagagaaatgcctctctgtggtgcccctgagaaggaacaggggttgtaactgatgaactcactatgtaggccacagcctgatgcttgaatatattgctgataaaaatccttataaatatctagatagtgattgtaaattaaacttgtattccatctgctattagtttaaaatctactaaacccatttttcagcctgtgaaaaatataccacctggccaagtgctttcacattatttatgtatggggcatttagggttttcttatatcttttttccttttgctctacttcaggatcttttatatgtttaaagtgaaaagtatttccacatatctctatttaaaataatttagtagatccttctatgtctatttttttgaattagaaatgcaattctggattgttgtaaatgaattatttgagtctgttttgtctcaatgtaacagcagaatagtggaattcgtatggaaataattgttttacacttaaaaaattcttttagtgacctcaaattcaagaaaaaagaaattaactgtatcattattttctatagtggtatttaaaatattgtaataacatgcttaccatgttctctgaaagtgaaccaagagagttatattgcagatctattctctgttttttctcctctgtttctttaccttttctttttcctttttttctttctcctcccttttttcttctcttttaaatatttgtaaattaatgtccttacctggaaatcctgggaatattttatcttgagcttgatatctgggctttatttaatgactcctttagtggaatttctaactataaatgaaatacattttccctaaatgctgtggactttgcagtacaggaggccgattaggtcaagatatctactattgtttttctatatgtcagaaacagtgtttcaaggttcagcaagtcatgaaaagtgtttcaaggtccatcaaggagagactcagagggatgattgaggaggtgtgcgctcactgtgtctgtccctgccatcatctccaaatgggattgtttgcatccgtgtaactgctgctctgaggggaaataaagtttatagagaatctttaaattattccagtgtaggaaaaaattgtaaggtcaactttctcatcacctgccaatgcaataatttttttttgtaggttgaaagcatattcaagaagagtttttttaaaaagatgtttaagacttacttttccagttctttttttgtaactacaaacagaacttgtcagtagaggtaatgatacagaaagggaaagaagtatgaattttaaatgaatggagcgcaggctattaagaaagtaaatttattcgtgcaaaccattgtgcatgtattctataggttattccagccccaactgggttaccttctccctgtactcactagcaatccagtcagtgtggttctagttagaatcccataaatctgtaacagaattaattgcatatccttccaagctagcagtgaaaggagtaacattggccaggattttgatgttttgccatattctaaaatcaacatgatggtatacgacattgctgaaaacattaatttagagggtggctggaaattgctgaaaatattgaactctagctagtgaacccaaacattctcctttttttctacttctagatcagagaagtccatgtagttaaaacttcactcttaatttaattctctacctcaagtatatatgcataaaaccatatttctttgtttagcaagctgaacactgctttttataatattagtctgtaaatcataagtgtgaggcaattggatcattgtgctctgtaaggagcatattccacaatagccagtttattttatttgacttttatctagcccttgctagcaatatactggattctgtttgatgcattttgcataagggttctatttggtccataatggtttgtgtaatgaactatttgttctcttctagatgacagccagttgcttaaaacctataatgagatgtcaggtgaattgcactgattggcattgatggatggacttgttgaaatattgcagagtttccgtaggggcgtagaggaaaatggctgtttagaggtttgggtctcctaagcactgaaactgtcatcacataaacagaaccacttctgcaggtctgaggtgtcatcgtgcattttctggctaatctatccattcatctcaatagtccagaactcgcgcatcatgtcactctttgcctttgttctgcactttgatctttcagaatgtctgtcagaagaaaagtgtttatattgaattatgtgtggaaaggggtaggctgcatacttcagaatcttggcatgaaatttgctaaacaaaccttgccagttgctccgcagcaataatcgaagtatggatttcaatttaacgatatgtaggtgcacacttttccccttcaaaaacaactttaatgtggatgtttgggtgtaggagattttattttgttttgtttttcctgtagaaagtatgtagcacctttattgttaactgttaaaattaatgttaagaaggaagataaatgaatttttcaaaatcaacttttttccactaaaattctggttaaatgcattaactaaatgtatgccttggctgaaatatctttttgtgtgtatattttatctcactgattctaacattctagtataagatagtctattttggtatccattatatctattataatacatgtattagaacacattaggaattccacagcaaaagcaaaagcaaacaaaaataggaactaattacattgaaaagtactatacagacacaatagcagaaacaatgggtgaattattagtttctgcattctgtcacagctatccattctcttttctcatacctttttaatatgtttgaaataaaaaataattatgagatcaaggtttttttccttcatagttgtctaaaatgattaaggacatcaatttccactgatatgatgctgtgggcaagaaaatgtataatggttcaattccccaggttaacttgccttgcagtgggcaaaaacagacttcagagatcttttgacattggtcatatgtctttcctcagtctggagatggaagttttggtgctcttaactgctatatcctgggcttctcgaggtaatgacagatcttatgctaacttagggaccctttggattaaaattgaatagtaacctgcaatgacatggatgatctttgaatcaataactttcttactacaaatgaagcattcatggaagctgaatgagctcagctaacccagtaaggtaactcacattcaacaaactgatttggtctttgacaaggctcaagtgtgagtagttctgaaagtttcccaggtgattccaatgtgcaagccaagttcaaagccactgagctaggcagattgaacagaatcattgcaactgtatgaatatgaagctttccaggcagaatgaaatacatggacactcatgagaatctagagctagctggtctaccaagggcttctcaaacctgcaaaccaagccctgctgatctaccaagagcttctcaaacctccaaaccaggacaggcatggcaggaagagggttgaaccacagcagagagctggtgagacaaggtagtctgttttccaggactgtattttcccttaagtgaagaccacgtcagatgttaaatgaagactatgaccctttaaaggctttggcttgcttagtatagacacttcttcccactcctagtgtcattcttgaatggtttaaaatatgttgatagaagagtaagaggggcagagctgttattattttctgcaaatttttaaacatgagaacatcacgacagtgtccctaggattataagctaggcccagacctagtctagtctgtgatctaccagggttgacagaaaaaagctttttgactagctgaacagcttctggcagacttggttgtgtttgatggcatttatggtgatgtcagtgatgccatggtagtgactggctgttacagattgtaaaaaggacaaggcatttggtacaggcaaacagaggtattaaccatataacagatttctctattcataacaatggttacttttaataaactggaaattgcatgtttagtcatttgtctgatacttgttcagacttggagtcaaaagacttgagttttttagcctcattttgtaattttaataattatttttactattcactatattctaactttttactagtatcaataaattaatatctcccccattatttttacaagtacttaggttaaatatctaattatagagtgcttttcatatttttaaaaatatcaactgtcaaccacaaaaagaactggagtcacaagtataagtctactgtaagtatactgctatgtatttgtagtaatttctagctgagcactaacgagtaagaaaaggtggtgtagtaagaaaaggtgggtgggtatgtttcttcatttatttcaagttatagtttatgtaaagttcatatggttttagaacatttttattgaggacctctggtatatgttaccttaaaaaaaaggatagcttaagtatccttcatttattcatctgtaaaacaggggataataatagtgactgcatatgggattattacaatacaaaaagatgtatatttggagggtcttagcaatgacagtgaaaactattttgttgagctttgtgtccaagtaattcagacatcctgatgaactttctttttgtttgaatattgaaaacatttttctactttaatgggatttcataataggttagagattccatgccaggaattgaggtgtaaatgccacatttgcaatgctacttcccttgaaatccaggtgaaactaaagaagctttgaaggaaacatgacaaaacttaaactcttcaggtaacccttcttttctaatcattgacattttttaggttgctttgatattttgttttggaaaaaaatgataatatattttttctggcatttaagtcatgctaacttttaaagagaaacagtagacttatacttgtgactccagttttttttgtggttgacatttgatatttttagaaatagaaaagcactctataattagatatttaatctaagtacttctaaaaataatgggggagatattaatttattgatactgtaaaaaatgttacaatatggtgaatataaaaattattgaaatcacaaaatggagttaaaatgtcactagttccctctcggatgtgtttcttttacattgaaaaaatgcttattcactaaatcatactatgcatatatatcataaaaatatagcttaaccgtatcatatatactagatatatgtagtacatgcataaatctagtgtgtatgtatgtgtgtatatatatatatatatatacacacacacatatataggtacagtttagaagttatatatatatgtagtgtaggtgtaggtgtgtgtatatatagttttgaatgtatacacacaaatacacagatgcgttgttgactgggataggttctgataaatacatggttaggtgatttcctcattgtgtgaacatcttagagagcacttacaacacaagcctagagagtatagcctactacacacctaggctatatggtatagtctgttgctcctaggctacaaacctgtacagcatgttactgtatggcatacttcaggcaattgtaaaacaatggtaagtatttctgtatctaggcatagaaaaggtaatgcatttggctacaacattaaaatggctacaacatcactaggttataggaatttttcagctccataaaaatcttatgggaccactgtatatgtgttcagtcattgactgaaacattgttatgctgggtgtctccagacctcttaaagtctttatatatataaaatatataaagtctatatatttagatcctctgctgttggcagcataatatacagtcatgtgctgcataacaatgtttgggtcaatgacagatggtatgtacaacagtggtcccataagattataatggagctgaaaagttcctattgcctggtgctattaagctgtcctaatgtcatagtgtaaagcattcctcacgtgttttttggtgatggtggtgtaaacaagcctaatctgccagttgcataaaagcctagcacatatagttatgtacaacacatatcacttgataataattatgttactggtttatgtatttactatactattaatcattattttaaaatgtggttatgtaaacaaagttaattgtaaacagcctcaggctggtccttcagaaggagatgatagcttcatgcatgttactacataaaattgtttgggataataaataagataacttggctgggtgaggcggctcacgcctggaatcccagcactttgggaggctgaggcaggcggattacctcagttcaggagtttgagaccagcctgaccaacatggtgaaaccccatctctactaaaaatacaaaaattagctgggcatggtggcacatgcttgtaatcccagtactcaggaggctgaggcaggagaattgcttgaacccgggaggtggaggttgcagtgagccgagatcacgccactgcgctccagcctgggcgacggagctagactccatctcaaaacaacaacaacaacaaaaaaaaaacaaaagagaatttatataatgcggttggtatatggtaggcccttactaagttgtcctttccttttctccttagctaggacaccacatatgtggtgcagatggtaccctgcacactggcacttcgctgaggggtgaatgggtgctgcagtccagtgtgctctcatttttagtaagcctaaagccccagtgtggagctgcattcacactagcctgggttagtggtggccctgcccctagggctctgaggttgagaatcagaagttcatccaggactgaatcctagctggccctaaccagctgcaaggtcctgggtatgccacctcacagcttggtatccatgcctcatctagaggaaatgcattaggatctgtccctaatgctaattcagatgtcatttttttcaaagatgaaatgaaatcatgtttgtgaagaaataattataaaatgaatgtattgtacaatttccattgtaatagtttttatatgcagaataggcaagatcattaaaacatgattattgaccttgagtgttatcgtttagttaggtgggtggttttaaagaaggagccaagagatctttgtgacccttctgagccagagggcagtttggtaatggggaggaggtataagaaatgaggccctggagggagtaagagatacacggaaggccactgtgaaaggcaatgattagagcatgacactgatgttgcttgggccatgaaagaagagaagtgggtactctgctcaattaaaaaaattatcaaaataaattcaatctagaagtagagataatttctcttctaaataagatttgaaatgtgtacatttgtaatagttctatttccaggacataaatattattttaaaatgtgactaaacttgccctgatgccataattttgatttcatagaatgagtacatacttcctcatgcttcatatgcagaatgctttgatttatcagctttggtatattaggacttctggcactctaagttgatgcatatttccattttaatgttaaattactgaattaattattgtatatttctgttgcttcgggtgcctggcagtcatgaaataattcttacaccatattgatgcagacttctggttaataaccataaaactaacatgagcctcccttccttttgcttaaattgagaaagagctatcagagatgctgaagctaaggtccagttaataataacctggaaactatagattaacactgtatctctagcctagaacttctactttatggtcactttaattcatcaataatcatatgcctgtttgctttaaaaaaccatcagtgtcttcatcagcttaggctgctgtaatagactgctgggtgctataccatccagtttatggtattttattatagcagcgtaacttaggtgctataccatccagtttatgttattttattatggcaacctaagctgatgaagacattaatggttttttaaagggaacaagcatatgattattgatgaattaaagagactgtaaagtagtccttggctagagatacagtgttgacagtgctgatatagcaccagtttctgttcttatagcaacagaaattgatttctcacagttatggaggctggaagtccaagatcagagtgccagcatggttgagttctggtgggagcctgcttcctgattcatagacagttaccttttcacatggtggatgggtgatggaactctcaggggtctcttttataagggcaccaatcccatacataagggtagagccatggatgattgggtaggacccaatcacctaccaaaggcccacctcctaataccatcacattggaggttagaattttaacgtattcagtatatagtgtttggttttctagaggtttcctttaaaaatgagcataagttttatgtacaaaatgttgtcaatatttttctagtcagtagtatttattaaccatattaactactgatttaggaagatttcttctttttttccttttaagaatgagaaataaactcgttatccatatatgcgcatgacacttgatatgttgaagctaaaataaagacaataatttcaatgtaagttttaaaatcttctaaccaaagtgaatgtagcaaatgtgtttaatatgatttgaaatttaaatagcagcctccagagttcaggtgtactttattctttcagtaaattgggtggactatggattcatattgagcagttgttctgatttatcttgcctgtgatttcttctccaaagataataatgtaataatgattcattaaggatctcgttacatttaagcattaaaaaaatctgcagttatccatacaaagataagaattttatttttattatttttccttttgttctccagatttaaagtagacatttggtcctgtagatagagtagggaacaagaaaatggtttaattttacatcttaagaaatacttaactttcattccagaagacttaaaggaggtctcagattccccagtagatgcaagaaaatgagtaaacctagaaacttggaaatagatggtgttttaaataattagttagcaaaatgaagtgctcgaagggttttgaggcagcaaaaacaagaggcataactaaattaggtgccattttccagtgaccccatactgatagcactgactgaatgattgagtgcagacttaggaaaatataagagattcgagtaatcagcaggtgacaagtcaaaggagtttcaattgtacaaatgtcaaaactattagaaactttcttttagtacaaacaaataccacagttaaatttctgagagagtaattaatttagtatgtgtttgtttatatccgtgtatgtattatattaaaaagtttatttttaataaattatataaaaaactttatgtgtatacttagaaactacatttattttgttttactacactgctaatcatattacagtatagctttttcataataatgccagataaaaatatctgagaatggattaaattcacattaagaatagttaggagagaaaggagcctaaccacagaaagtcaaattttagtaatctaatttttatgtggatgtttactagagcaaagtgaaattatatatacatatacatataaatatatgcacacatgcctaactgtagatatatatttatgcacatatgtttatatgcatataaatatgtttatgtatatgcatagtctctgttttggagtaaacatacgcattttataaatgcatagcccataccaaaacaaaacaaaacaaaatgccttcacttcaatatgtctacacaattgaagcgatagagcatatagcaaagggagcttgtttttatttaaatgacatctgtattgtttttagtagaactaaatatggaaagccttcccttaattcagttttatctaatgttgtaattggttatctgatttatgggcacatcagttttacttagatacctgccaaaataaaaccaaagtttgctttttagaagatttatacctaaaaaaatcattattcttactacacatgaggctctatgtttgtagttgaaatgcagctattgacatttataactttataactcataaataacttctctgttttaaaatacttttgaaaatctaccgctcaaaaatctgattctgtgaataatagaaaatgcacttaagagaatgaatacaaactacattatttttagtatgtcatcaggttatattgattcttagataagtatagattaaaatcgtaaccacattatccaacattagtggtcactgtttagttgctagaagttctgtcagtagagaaaacaattaagtttgctaatgtagcaagtaggcctgaaatccatgtataccagacaaacaacagctttgtcttgctatgagaaatctgtttgtattgtgagcatcttttcagggaaatcaatactagttttttcttgaatccttgaatgcattgcactattctgtctctaaatggcctcctgtcctatgaaagaaattgaactgagttagggtaaggaattggttagtgtgccagttgtgtctttttgaactcacacacaaacaatttaaaagtctagtttcacaaacagttcttaaattttaagattaaccttaagtatgcaatccttttctgtcttagtttcagaacctgtcacaagggcactgaatttttcccccagtatttgttcttctgttttactgggaggattgttgtctgacttcattgtgtagtttttctgaggcttgcggtacattattggcaaataattataaggtctctatttcttgaccctcacatgtgattcttaaacagatctaaggtatcttatttccacatagatgctgcagatttcctaaaggatcagttagaacttcctggaacacccttggatttgggtcttgcagctggctcttactcaagaaaacctccactaagtcagggcagaatcgctcctgttgctccccacctggagtagaatgaatggagtaacacattttagtttttctctaaaaccaattgagttcttaaagactctgatctctaagtaaaatgagacatttaattatgctagtgaatacaaatgtatcaaattttactttaaaaggcagaggctctctcaaattagattttataaaaattgtttgcagaaggcctgaaacaaagtgacacaataagattaaaatcaaataatgggttaacgtatatcttaattgatatatagtaaatagggaaaattatataacaacttatagaatataagacaaaaaagcattacatgagaaaaaaggactttttaaaataatttaaagaaacatccatggtgaaaacacagttgttgtagtttatgtaccaaacaccaaagcaaagagtgtcaaattaaattgtattgattaaatcgtatattgcagtttggttattaagactggcagaaagagaccaaagcattacttgttataagtttgccataaaatttttcaagggtatttggtgaaacagaagagagtcatctgtatagagaggaaggatgcagcaattgactgtatggcttctcctttggccctcacgctgttgcccttgactctcctggcacaggtatggtctagcgatggtcttcactgagctgaaagggaggccaaatacttgcaaaattggaatccatttacacattggtgtccgtcaccaaacacaccaaacatcaataagcttctcttagaggttttttgtttgtttttaaacaagtgcataattttcaaagctgctttctcatctaggaggaaagagaagttctggggctccccaaacatctttacctccagcactctggagcttaagaaagctatctcttcatatttataaagcaaaacttttggggaaaaacaaaagattagggccaggtgctgtggctcatgcctgtaatcccagcactttggcactttgggaggacgaggcagacagatcgcttgaggccaggaattcaagaccagccaggccaacatggagaaaccccatgtttactaaaattacaaaaattagtccggtgtggtggtgcatgcctatagtcctgcactactggggagaccaaggcacaagaattgcctaaacccaggaggcagcggttgcaatgagctgagatcatgccactgcactccagcctgggtgacagagcaagactctgtctcaaaaaaaaaaaaaaaaaaaaaaggaaaagaaaaaaaagaaaaataaaataaaataaagataaaagattaattgtgttagaaacacaattttattctgggtctttgaccacatagtttgggaagaatttggaagatataattaacatggttgaataaatttctctaactagaaagagcatagtttatattatctgaccaccaagcagtaaagtataaattaatatcaaagctttacgtaagaaaatcacgggagatttaaaagaaaaatcaactttctaaattttgggatcaaaaggaaataaaaactaatcactgacaagaaaatagtggcaatgatgggataaaatatcataatgtatggcataggacaaaactataattaatagacaaattttaggccattttttattaagtaagaaaaagtgagaatagactattcattcagtactcaaatttagataaataatgctgctgaaataatatgaagaaaataaaaataacttaaataataaaatattaattagagacaactttaacagagtagacaaataggttgaagagtatattttaggaaaatacatgctgacaagagagttcttatttcagggtttggcagtatatttaacgttacaaaatattttagcttcttactttttttgttgttgcttgtttcctatttttcgcctcaggtatatggactcttggatagtccatgcatgaaagactttaatgccagttcatctctgaggttaaatacaaatgtgtgtgtgagtaacatttttctaaacgtagtaataatgtttttctaatgtgaatatgagagtctcaaagtagtctggaactccctcataaaaaaatccagttattgtttccactcaaacagtaaatcatcttggtagaccaaaggagaaaacctacgtggtatttttcctttaggaaatatccaaaatatgttctatatctattccatatcttaaaaaaaaagataagacaaaataaaacaagaaacaaaaatagttatagaaagtgctttcttaatagtaacaagtgattcccaagccagattgaaatatcaattatatatgtaatagaaaactactacatttttagtaaaaaataagggaaaagttgccacctccaccatggtattctggaagttctaatgaatgtattgtgtcaggaagaaaacctttgagatataattcttagaaatatgaagggaatattgccattgtttttgcaagattttatttcaaggaacagggtcgttcattaagtattgagtatctgccatatggcagttacttttctaagccctggagatcaaactgtgcacaggacaggcaaggcctgcgcccatggagtgtattatttagagtgactgtgtagagaaagacaataaggaaacaaatgaacaagaaaatttcagatagcagtctaataatttcagatacgatgtcattgtctacctaaaagtcaaaatgtgtttgcagaaaaattattagaaatgacatgaaggaatagtaagctgaggatgtaaaatacatataaaagtaataattttaaagtaattatttggaaacagttatagacaaatatctccattcatgatagcaacaaaaaacataaaatatactgaaacttaaggaagtatagaacatgaaatatatatctgtatatgtgtatgagtgtgtatgtatatgtatataaatgtgcaaatacaaatatacacacacacatattttctttttaatttggaaaatccgtgactaaatggggcaacttaaatttctgggtagaaagatgcattgtggtaaagatgtcatgtcttttcatacttttaaaataaatgtactgttataaattaattctaacaagtttttaaggaaacttgtaaagagaaaatgacattcatctgaaatgaacattaaagaaccaccatacataatttgattaagaagagaaataaagtcacccagcctacaagatattaaaatgcatatcataaagctgcaatagaaatgaactagaaaacccagaaatcgatgtgctcgtgcagggatggcacatttgtggcacagttaccttctttccccatattgttaccatggtagacattcactagtaattgatgttgtcacatttccctgctgggcctggacgtgatctcagaactagatgaacactattaggctatcaaagttggcacgtggattaaaacattttggcaccctgttcaggtatatgataaaactggcatttaagttagtaaagaaatgaagggttatttcagaaatgattctgggaaaaactggctctttggagaaaaaaatagtcctttacttcacattatatactgaaataaattccagatggatcacaggattgaatgtaaaaaaagaaagcaggaaaaagcttgaagataatatagatatgcatctaacattaaagaaagcttttttagcatgaaagaaaaggaagaaatcaatacaagaaagaactgatgaccccgtctctactaaaaaaaaaaaaatacaaaaaattagccggcgtggtggcgggcgtctgcagtcccagctacacggaaggctgaggcaggagaatggcgtgaacccgggaggcggagcttgcagtgagccgagattgcaccactgcactccagcctgggtgacagagcgagactctgactccgtctcaaaaaaaaaaaaaaagaaagaactgatgaaattactacaacattttaaatttctttgtcttaaatgtactagttacaaaacatactgggtatgttttacaatgttttgtaaaatattatttggaagtacacataggccaggcatggtggctcatgcctgtaatcccagccatttgggaggccaaggtgggaggatcacttgaccttaacagttaaagatgaatctaggcaacataggaagatctcatctctacaaagaataaaatagttttccaggtgtggtggtgtgtgcctgtggtcccaggtacttgggaggctgaggtgggaggattgcttgaacccaggaggagaatgtggtgacccgtcactgtgccgctgcacttcaacctgagggacagagggagatcctatctcaagaaaaaaaaaatgcgtacactcaaaacatatacatatgtactagaaggattaaattgaataatgctaaaatatttatagtcattttttaaagattgagatattacaggttattttattgtattttttactttctatattatttaattctgaaagggagtgcctgtcaaaattatgaagggaaacattggaaactaatatttttcaatatcaaatattcaatattttttccttagcttatttttgaattcccttaacagcttattgaaatacataatggcgttctgcttttaaacatcagtaagttgagattcagggagagcaagtaaatactccaaaatcactgatgcagaaagcagcagggttgtgactggaaaccagtagttgagttatcccataagccattagccagcatgttatggatctctgccctgcttgatgtcaggattggggagaaaaaagaaaaaaaaaaaaaggttaagttcaagtccaggcctgatctttcatcagcagaagggggtttattttattctactttctgtgtctgctcctcattccatcccagtagctcctattcagtccttcaaggaggtgattagatagacacatttctcctgtgaaggatgttaggcttttgagacaaaacatcacagttggatgtaaagtgagacctttctgtttctatttaccttttgcaaatgtgagactctgcctgagataatccttcaatccttcttttcctggcccaccaatgtgtaaagcttggattcaagttggtgtggatgccaaaagtgttaactttgaaaaagaaaagatttatttccttattatagacattcgagaacccttaattctatgtgtgataggcaccttactgcaaaaagaggcaaagtgatggaatcaaataaacacattacagctccagataagaaataagcacttctcaaatgcaggaatgttttaagactgttaatgatactagataggtgtatgttcaataacgttcttctcacagtatgtgtgcttctaaaatcatatcattttcctttgggataataacaccataagaaatgaataaagttgccttagtatgctagtgaatgtagccagttttcaattttggtctgggatatgttaacccactaaagtaaatctgagtgtattttggaaagatacatcactatatcactatagatacattgtattgttttctggtctgtggtagggtctttcccttcctcttctgttgacaggagagtattatttgagaacatctaatcagatataacaattttcaaattgactaaaataagggccatagtcatacttacgatattgttcttctggaactattcgctaatagccatttctcataaattggctttagaatatacctctaaacaacatgatagtgaccactttattgcaaaacaaacccaatgcactgaatctttttatttttaaatacattttataatattgaggtcattacaggcattctctaagagctggaagaaaaaatttcctagcataggacctgctcagtatgttatagagtggacgatatttaatttcactgagctcctttccttcttcccagtttgcttgtcaaaaaaaaaactcacattccatatacccaaaactacctttcaagctgcttttaatgtttaacgcactctttgtttctgcaaagatttagcatttagtatttagatgattatacttattcattttctatttcttctgatcattgtgcttttgatttcctgatatatctgtctaccccatttctctctggtgaaagccattcaggctcagcttaactcatcaatgaagctctccccgatccccaactctgaactcccatagattgcttgtttgcacctctgacaccatgtaccttgtatagatcttttcataagttaactttctggcagccccataatgtgcaccctgggcacctgcatcatatatgtgcagttttctcacttctttatggttttcatttccttgagtaattccttactcctcacctcacttggtttgtattttctatcaactccagttttagacctttaaatgaggtcttattttcattgaacttgcatagaaaatcttattttgtaatgttattttgcaatggcctctctaagacaagccttgtggcccccctatgcatgttacttaataccttttgaagccaaaacaacctgaggccacaccctaacttgaaacccaggtcacgctcgccttgaaccttcccacttaccagtggaggggaattaaacacttacaagaacatcgcatgtaacattacactctatgaggtggtcccccagtcccttttgtgcagcctagttagagtaatcaaagcaactcatcacgattaaaccatagctggaaaagagactgttctattgctatagtttcaagcaatctattcccactcgtattcagtcctcagagaaaagaagattacacactgccttcttttgtcatttcagctcttttactgaattccactaatggaatttagtctggtctcttgggatacaccacatggccaaattcattctctgcttttgacagaaatatctaccatggattctctcccttcagctctctcttaccattttcttcacctcccgcaatgtggcagctcatcagtgtttttatgtctttgtaaccctcttgggtctggcctttcatgaagattgccagtctcagatctgcctagttctgctgatagataaggaatatggagcttccatttctgaggataaaagaagattcgaagaggaagagtatctcctgctcaaagagggcttgtctctctttgctttaaaaagctcccatttttataagttgaatcttttctatgtttcagcatgggctggatcaaggggggaatctaccctgccacagctttctgtccatcactattcttgttctatttatgtgtagattttcagccaatataatatgttggtacccagtgaggagttttgcatataaaaagggctcaattaaatgctggattcataatcctgcccatttaaaaaaagtcccacattttattctcttttgctattatagaatctgagtacaattaaagctttctccaaattgcctgtgttgtatttctcagtcagaagcttgcaaagaatattttaaacagttgtcgtgtgggcttttcccgaaatgccatgtcactccaaaagtgatactctgctattttgactactcatagaaaatgaggaaggaggtaggctgaacagagagaaattccaactgaagtagtactcctagccaagccagtggtatagcaccattgctcatctttagaattttagaaataactaaggcagtatgtacttttaaaaaccttttatttcagtggcaaaataaatgattaaataataatatcagttggtatagggataagcgaataaaacatctcatttcttgatattttttatatgaattccaatagtgtgatgtggttatagtctttgttggggactgtgtttgtgacagtaaagcaataaattttattatgtcattatgtgaaaaacatcttaacattttttgtgtgtcttaaagtaggttacagaggacaaaataatctgtggagagaaaaaaaaaagaaaaaagctttccattcacgttagattgcagtaacccagtgatttcttgtactttaaataatttctgaaattttagttttaaattctagtaagaatatttttaaattatacataggatctatgtgggcccatcttatccaggagagagtttatttcacatattcatgtaggcttgttttacaaaaacgacgtaaatgttatgactaaaaaacaccctgctatatttgtacgtgtggctaagataatcaaataagaccattcccaagttgtccctagagtattttatttatgttcccagtacccctgccatgactccctgagaggttctcccttgacactgatcctccttgagcacatctgaagtagctggtagggaaggtgtccacagtgagggctgtgtagctttcagagcccccatcccttccatgtaagtctgaagccccaatattgttttgtgcagcctgtgaggatagaggagaagggaaggaggaagtatttttgagaactagtttcacagtgcttttttgaaattttaatcagagagtttgcttttttaaaccatagacttgtagtttcttagtactttagttccctcagaaatttaacaggttctgatatattgcttctagtcagttccgtgaccaggaaacacatgaaaagttgttctaaatgtagttcctaactctgctctttttctttctttccatgccccgtgcttctttctctactcagtggtggccaccttgagtccatctgaaacaacagactgggggaattggtggggtggctttattcttagctacaatactatttttgttacagaactaagtcttttgtgaattgggaattttaatggaattttgtttttcaaagcttttatatttatttttgctctttgggaatcagatgcagtgtaatttttcagctcttcaaagtatcaaatttcttgacactctcattccttttcatttctagttaatttttgtctgaactaacctttttcttgtcgtaccttgcagtcagtggcaaaaatcaacaatatataagaacatcatggcctcttgaaccctcttgttcgctgaagctgcagtttcactaggcaattggattgcctttcgaatagctgtaggctttagttttactgaatgttttttcattggtatgagttgccagtattccagcttgttttgtctgtttttttgctacctgattttggccactaagctaatacttaagtgttgagcctttgttacagtcccaattcatttcaagttgtcaattcactttctctgttaagctaggctaggagtagtagcacagagaccacaaaataatcagtggataatcacaataatattttatttctcattcacgtaagagtcctggagttataggcatttaggacagcacagcagctctcctgtattcttcagggccctgtagtgatggtagcttcgaaatcagcacatggcttccagtgttgctcaggatgtctgcatcccaggcactagaagggaaacagcatctggacgagtgctcatggtcattctgtaaaggctagatctgaaatggcacttgttacttctactcacattctgttggagacaaggttgtcactttacctaactgcaagggaggctgggttgtatatggtaggaggagagaaacattagtggctggcttgtggtctctgccacaagatgatgggaaggaatttatgtatgtcaagtatatgcataagcaaaaagaaaatgtttaccttaaagacagttggacttaatgattagatgataagggaccaaaatatggaaaaggaactgtgaactaatcattaatatcatgtgatactctgaaagagataactattttgattttctaaaaatgcagcaaaggcaaagaggggttaataaaagttggcttctgggattgtatactttagagagtgtgtgacttcctgaggatacagttttatatttattttggcattttgtgaacatgactaacatgttctccatacgcatcaattagtgtagttgttctgaaaaaataagatatttttagatctcagttgtgtttgaccctagagaaagacaacacacacacacacacacacacacacacacacacacacacacacacacgtcgtagagaagggaagtaatgggggatgaggcaaggggtgagaactgaacatttatttgttcaaaggtttgaccgtgattttcttggcttttgttaggaagaatatagctagatttaaaagtaattctcggataatgactagacacaattcagtagtgtttgcatggctcttggcaactgatcactccctggaatacactgagagagctggagagggggtttcagtgcctgctcttaggtttttcagaattatggctgagatcccagtaggtcagcaaggtctgtctctcacagcaaccattggttcctagaaacccttagggtttacttatgttcttgaatgtttggttttattcttagttcctgtttttccttcctgtcacatcctagaccaggccactttgcatgtcattcttgagttctgtagtagtttggtacaggctactcctctctttccacttcagtatattctgtgtccggctttttcctgctcataaaaccttaaattactgtacgttgttcaaaggatatatttcagtctgtgcctagacaaagcctagtccagcagccagaagtcttcagttctggccccagttttgccactaactagctgcatggccaaggagaagtgacttatgagaatatatctgtccccagcttctctgtgaaacaataagcattctaaggaagattagaaaacattgtgtttgggctgggcatggtggctcacgcctgtaatcccaacagtttgggaggccaaggcaggcagatcacttgaggtgagtagttcaagaccatcctggctaacatgatgagatcctgtctctactaaaaatacaaaaattagccaggcatggtggcacacacctgtagtcccagctactagggagactgaggtgggagagttgcttgaacccgggaagtggaagttgcaatgagccaagattgtgccattgcactccagcctgggcaatagagtgagactccatctcaaagaacaaagttcagccaggcgcggtggctcatgcctgtaatcctagcactttgggaggctgaggtgagcagatcacctgaggtcaggagttcgggaccagcctggccaacatggtgaaaccccgtctctactaaaaatacaaaaattatccgggcatggtggcacgtgcctgtaattccagctatgtgggaggctgaggcaggagaatcactggaacccggaaggcagaggctgcagtgagccgctatcgtgccactgcattccagcctgagcgatggagcgagacgccatcccccccccaaaaaaaaaagaaagtaaaaaagaagagagaacattgtgtcctacatccttttcttggccatctgaagttgtatagtgatatattttagatgtttcgggaaatcctgtcacaaagtgacctgtttacctgcattaaaccttgcatagccttcaccaattggccagcaaaaccttttgttcacataacatattaacattccacctccacacaaatagtgttacccagaagacacacttagaaataatgaactatgttgaggatactagagagcttctgaaaatgtctccactttttcatctttatcacctattaagaatggcagctttgaagtaagatgcctggatataaacccctcacttagtacacagacaattttgggcaagttacttaatctttttgctctctggtttcttcttctgtcaaatgagggcaatagaagtttttaccatggggttatttacaggattccatgagttcacacaggcctagtgctcacagcagagcctggtatgtagtaagcattgcccattatcaataggcactttgcctatctcctccatggtgcctttcactttcccacactttacttttacttgtatctttcccttatgtaaaatgacctcctcatcctcataatttaactagcaatttctttaatgaggtgagcaagacacagtgaaaagagagaagttttgagtcacacagatttgtattctcattctagaatgaccatttacaagttgtattacctgagtgagttactcagcctatcttgaccttagattccctggcaatctgggattattataatatgatccacaagtgtgctgtgaaccttcaggtacatgattatacattctctttctatctctgtctctgtcactctctctctctctctgtctctctctctctctctctctctctcacacacacacacacacacacacacacacacacacactgtctatatctaatctctgtctctctagatagatggatagatagatggatagatagatagatagatagatagatagatagatagatagacagatattcttaatgggtgatgctaatgatgttaaaatccgttactggtaaatataggtatttggtaaatgcaaacgtgatattcttataattattataattattagcttaaatcctgttctcactctggcaccttttctgacatctgcaatccaactaatgcaattttccagagaatggtaagagattgacctctgtgtattgcgcatccagatcaatttattattgatattgttagtattttaccttgtcatcaacaaagtatttgagttatacttttatttttccagaggacatgatatttcattcttcacatgggaggggtcactcagatatgatttagactagaaagaaccagcgagggctaagggaagcagctgaatatacttttcctctcaccctgtttatttgctggacttgacattcagagttaacagttcactaaaaaggtgtgaatgtaggtctggccatgactggcaaaaaaaaaaaaaaaaaaaaaaaaggaaatactaataaaatagacaaaatttcaccaagatttttaaagaaaataattaagtgtggagggatgtatgaacattattagaaatgggaatgggcagaacagtgattcacttgtgatattaaaatcttaagtaaatacaaaaaaattgctgatgattttaaaaatttagataaaatggattttttttttttaaaaaaacataaattggctcaagatgaaatagaaaatctgaggaacaataatcactaaagaaattaatttaggctaagaagaagagtgaattaaaccagtaaagtttataagaagtatcctggacaagagaagaaacataaaattggtcaaaattagaattaggaaaaatgtattttggaggagagataatcttgaccagataggatcagggaggttcttttcaagatggattagacctggatagtaaaggagtagagggaacagaggagatttgcagcaaatgcagcaaaatggtcacctgttttaaatcaggcatgcttctcctactatttttgttacttttctagatatttgaaatatttctaggtttaaaattaagtttttaaaaggatggatgaggtgaggcagggagggggaggcatgtagaactgtgaacagaaagactcatctggagtcgatttttgtttagaagtgcaggaggaaagtgagctaaaattaaagccacagaattttagagtattatgggaacctcccatttcccattcctgctaccctgacagagctgcttttaataccctagatgctgaaagcttaggaagctttttgattttttgtgttttgtgttttgttttatttgttttgagtgaaatcattttggccttccttttcttggttatgggaaattgtttcagtgaaaatttcctacaggctgcttaaaagccacgcacggaacaatgggccttgtggcaagtgaattgcgtgtggggaagtacttagagtttaatgtgagttatttttatttccattcatagacatgtctcagtgaagttcaaattatcccttggacaatagaaggcagtctgttaatttaaagctagacttttttggttccataaagccaaatttaggattgatttcaaaagctaaataaacaacagtctacctccctattaaaagtgagtgtgtcaggtttctgtgtaccttagtctttaaataatgtccacttagcatttctacaaggggccttaaatatttagaaagaggctatcctttacaattataccttgtttgttaaagggacactcaaaggttggggctgtcttaatcttattactaaaattctgtaggtgtcacatttattttaacaaattaaaatagaggctggaaaagttagggttattgcaggtggtgtgattggaaatattaagagggagcatcgtctagaatccttagagatattgctcagcatcattttcctacaatgccataaaatattattcttaaaaattgtcagaggaaacaaatgttacacttcctaggagtgcttctgaattttgactcttaaacagaatcccctgtggagttcttaaaaagtacacatattgggaccctgttttggaaattctgattcagtggtccaaggggactgggcctgggtgtgtatgcatgtgtgttatgtgtggttttgtgtgtgtgtgtatctgtgtgtggaaagtttcacaagttattttaaagtatatcttgaggatcaagggctagtacaatagactacatttcatttctgttgaaattcattatttaagaactgtactctggagatttaccatgtcaggctgtaacaaggctattgctttcaagatggcaaggtaaagtcttagccgaactgttgtatggaggagcgtgtcatttctgataccaaaggacactatgcaggccaatcagcaacacaattacctatgtatttattaaatagtttcatattttagtttgaaatttttcatttaacataatttaacaaaataagacaaaacttccactgagttaaatacacaagtattcagacatttaatagtattctgactcaatatgatggtcaatgtgatttaccaaaaaatttcagtaaaaatgataatatcgtaattttacaaggtggatttaaattgatacttgcactgtttgactttctaccaaaataggagtacctggtaaaatgctgtggtgtatggagacagttatgagaaactggagggaggatgatagttgaggtaagttcaggctttgagtcacggttcttccaccagctgtgtgacctggcaaatagtttaaccttaaaatagggctaatttttagcaacttcacacattatctcacttaatactcaacttgactaggtaattttgagtatttaatgagataatgtgtgaaaatgcaacataaaaattaaagcagtataattaattgtttggagtggactccctttgcacttcttctctattggaattaatgcatgtatgggactatcatgtggtaattttgtgcatatagattgtggaattgcagaataaatgaattatggcagacattttcacatttatatttttagtgacctaaggcttcaaaaaaaaaaaaaaaaactagatacctccccactcttatgggaaggagagaattctttgttagagtattctcaagtttgattattttttcctgagattggatttctttgatattatttatgatcacaacaaagatacattttatgtatcggaaacttgacattgccaagacatattagactttttaaacatgttacctttttaaacactcaaccactgttctcccaaggccgttaccttatttcagagaaagcctaaagcctttaattttacctcaaaaagttttgatctgtagaatttcatgttgataccattaacatttgatgccatttttctatgtgagaaaaatttaggaggtagctaccttcttttgaaagcctatatattggcctagtagttgattctgttttaaattatgttttgataaattataatattttgaaattacactttttattctattaggaaggatgtagggacaagccagtctttttatatggtttctagctgagtagattgtcctgccaatgactctcaaagtgtcattcccttcccttcccttcccttcccttcccttcccttcccttcccttcccttgccttcccttccttctttccttgtttccttctttcctttcttctacaaatatttaccgagggacattgtgtgccaggtactataataggcactggcactgggagtagatgtgaataagaaacacaaactccccactcatacagaatttacattttagtgaggaatatggacaataaataggctaaaaaacttataagatgattacagaaatgaaaagaactacgcaggtattggcaggatgctgtagaagggtggagggatagtatagatgagctcatctgattgcattcagcacaggatatatagttagtttattaatattcccaatagcttggaagcaaagaggagttgatattcccccctccccaccttctccgtatattctcctctctaacttgattttccattttaggctgctcttgattttttacttgaattagattctatcctggaaattgttttaagggatagaggtcaaggtgttaatttttacccttgattgtcactgttaagagacaatgcccctaagtttcacactcctttacgcagaccaggcttaaaaattccaggtttctaatcagcggtgataattgtgtttagccaatatattaaagactgctaaatatttggaattttacatgggaaaaatacttcagttagcatgtttatcccacaagttctcctgattccttgttgccgattttgatgggtgaatttacttgggtcaaaggttgtcattgtgttgtaaaacacatttttgttttttttggtttacttgtttgtttgttcatttctttttgacttacaatgtaataccttctctcccaataccgattgctccccacccttgccccagaattcagtcttctgagtgagagaaatccactctatgttggaaaaaaaaagatcatcgtcgactcctatctttaggcagatacaaaagggtattgagagaatagatttagggtgcatgagaataggtgattaagggatataatggatgtgaatggaaatagaaggcacacagcttttaaatgggtgaagatgtgtggacgagagaatacgggggcagaagggagtggtccttgtatattagtggtcatatagtttttgtttttcaaagaaaggaaattgacattgacatattagcactaagttacctaagaactttgttggtaaaaatccactgtattttcaactcagaatgcactgagaggcatcaaatgcttttttattacagaaagaaaaacatgtcacaaaatcttgaaggggcaatctgaaatcaaagctcttcattaaggcaaatcagcatagggattattccctaggcaaatttttgggagatggatcgtacactttattcactgttttaggaaaatgtaatcacccctacctcctgagaaaacatttagcttcccatcctcccagtgttagtgggtgtctttgagaatgcaaaattcttttaatgttaactaaaccagacatcattcagaaatgcaatctgctttttaaaattcatgtaatatatggaaaaattaaaatataagtgatttttaaacattctgccatatggaaatacattctctatgacatcccttctccattgcctgataacaaaaagccagttgtagtgaaatttacatcagagtttgaaagacagaaattccacattcctgagtgttattgaccctattggtagtattaaatcagtcaggagggccagagaaggggctggcctgtggtgtcattttaacaatgtcacaaagtagcagcctcccaaaccaggtattgtctgtgtatttcatcctaagaagcgggagctggcaagatcctgaccctcattgattcagccacatcatcttacagatgagggatctgaaacccactgaggttcggagatttgtccaaggtttaaatacccaacctgaaattccaagtttattctaaagtaaatttgtattacagggtgttatgatccatttctaaacccgaatcctagaagtcatcccttgtagcttctacttatgagtattttccacaactgcttcaaagggctgtccttcttcaactaacagtatttcaaaataagcaaaaactatttaaagcacaactcagaaaaacatagactagcatgatttaataatgaacaatatcagtttttcaattgattccatatttttctcagattttaactgatgtctttgtattttccatgtagaaaagaaggtatgcttaatgtgaacattgtgaaacaaaataagattttgttcttgggaaacccttttacttcaaatttcagaaagtaaagcactgccttagagttgagtttgtttatttttgttttgtttttgtttctttttgtcttttatagcttacaacatttgcctttttttttaacctggaaacattgtgatggactttatagttccttagattggacaagtggaaagatacaggattgtgcgtatgagcctttgctcaacccagtgcttgagctgtgttagcccattgaattctttaagatatatttcagtcataattttacatttaaatatggttaaactaagtttagccaattctgatgcatttttaaaaagaatgtgctgttgagctaagactctatatgctgtattttagccccaagcagatttttatgacaaagtaataaacccctggaaacatgtttataatggaaaatgcaacttgaccttaactagaggaacccaaatgcaccttacaaaaaggctcattttttttttgaaacatacgaaatccctttctcccagaggtggtgtcacaggagaaaggtgtataataatagttgtatttaccataaatacctaacatattttatgatgatttgattgtattaaaaaatttcaccttatagattttaataaagctgcctatgggcaaagttattgcagttggatttcttttcctttgcccactgctctgtgtggaaagaagcaagcaacccttataaaaggctttagtttttagtacctggttaataaaaaataatttcctctcctttggacttgttcatgaagctgaaaaatgactctgcaggtcagtggtgtgtggcaaagctaatttctataagctttttatcaggtggtactgagtaaaacaatatgggaaactgaaaaacccacccttctgtaccagatttacaagggtgagggttatccccagtgtcacaaaaagaaaaaaaatgacactttttcttcccaatttctggtacagtaacgaaaaattctgtgttataaaaggtacgaaaggaagaactaaattgtatggaggtgttcagctaaatttagattttaaaattcggacacaaatggcactcattgtttaaagcacagtaaaactcaactttcatttgttgttttgtcgacaagggaatctcatagtaataggctaaatgaggcaaggcacatcatagcaaccaggaaagtgattgtcattcaaataaatatgcaaggcttcttttccccaagcatcacattttctcagaggagtactaggaagacattctaatcaagagaactggagctgcttcccttgaggttcagcagagtgtttggtgtgtgctttgcagagcatgatagagaaatatcacatccctcctgtctctccaagatattcacaggccacattccaggaaagaagctggagcagggctgcataaggctcccaggcacctgtgtagctggcaaatctgctcccagcaagcttgaagtcacattcttttctttagtttttcaggctggggaacagcgaggatgcacagcagcaatgtatgcttaggaggtcacagaacccttctttactgtccttgtgtcagggtacctagggccttcttacactggcctattcgcatcagagcccaaaggaaaagtcagaaaccacaggaatttggagaggttatgggtgagtctttcttttatgatttctattttagcagctagcatggagacttgtagctgacaacattagatggaagaagtaccatgctactttggagtcatgtcttagatgaaggtaaagagagaaaaataattataaggactttggaagatacagactgttttcccttatttagtttagtttaataaaggtaaaagcatgcgatgtgtaggtgtgagagaggttttggattgtaagggtagaaatacgtaaaatttccaacataactgctgttcaacagctgtatcaatgatttggagagtgattgacagggaagaggacatgttttactacaatactgaagtggaagacagagatcaagatgggtgtggtctcagacaagcatgttgctgtagaaactgggggttggcagtattccctcccaccagatgacttcttggtttcactgtgaagttggacatggggtcatccattgagaggatagccgggaggtatgaatgggaacttgaaaagactggatgaggaaggtggacagtttctggaatgggagcagatgctgaaaagtggcacttagaaaagttgagaaccctgcatcaatttatacatgcaattatgtgagtcaaatagaggaggatgaagatgaattaggactctactggataggagaggcagaggaacaagaaagtagatgtacgatgaaagccatgaatcctgaggcccagaaaaggaggaacagactacagtgacattccccttcaaaaactggagattgaatcctgcaaaccacgtctgcattttgtgaaacttactttcctcttaggttttctttaatggattgaggcctgagtgtttagattgagctatcagaagctaaataaacagtagtgtaatttgcataagctagtctcagatgccttagttgtggtataaaaacgcttgggaaactcatctaaatttaatcttttgtaggctgtttatgggctttctggagaaaataagtcttcctactttttgttcagctttcattacttttaatcattttggtcatggcatgtcaaaggttttctctttgaaaagtgcttttagttggtatttttaatgaagtgttatccacttaaagtgtgatataattgtgatattacagctagcagggaacaaaacagcttgatagtcacttccagggctccttgagaaaaacttatactcaaggaaaggtcagctcctctctactctgtatacatcttttgggctcacttttgcacagctgctttgcatgattctatggctgtttgcctcatttgaagatgcagttgggaagaggagcaaagagtggctatgctggtggttggggtggccatattctgcaaaacaccgcattcttctgggagctttgcactttgcatgataagacttaatctgtccctttcaatcataaagtggcagagctagggtatactgtggtgatcatcatggtggtgatcatggtattcatgatggagaataacctcaatgcctcagcagaactggataggtaattttctcttgttataattgtgctcaacaacctgcattggtttttgcctcagttacatcatgtatagagtaaacttaaatgcatgagctttcaaaaaaacccatgctctagtcctagcctcgtttttatttttcttccatattctgctacgtacagctctcttggccagagttactactcatagttcacaatctggtgttacctgcctctggtatttttttatacaggcagtttctctggccctctttccattttcttctatcaaaattatactcattctgagaaacacaattcgaatataacttttgttgatattctcaatctgttgttccctttttcagctcccactggcctttatttgcacactgctttgtggcacttctcatatccacttcctgatttatgactgtttttatacttgtttcattcttttctcaataatctattttgtaaatgccttcagtacctttttgagaaaggaaacaactaatatttgttaggcactgatcttgagttaaacaccatggttgacttggagggggtggatacaatgaaaaataagacttatatccctgttcttcagttctcaaggatcttgtagtctaaccagaagtaggacgggttaacagatatatcaatataatataataggcataaaaatacagtaagctcaaattgttctggaaaacagagtaagctgtctatcctgggatggagagctcaacaaaggcctcctaaaggaatgaaatgaagtaaatcttaaagactgagtaggaatctttaagccagaaaaggaggaggttctgatctgaggaaagagcctgtgcaaaggcatgagacagtgtgggggatagagaagccattaacttctcactatcaatgtagtataaagtaaaagactgagtgaggtgggtggtgagctgggagtgtaaaacagggaccagttcatggagggttttgattgccaagctaaggagctggacttttatcatgaatgtatcggagtgccctcagaaggtttcaggcaagtgagaggcatgataagatttctgggttggagaactcactctggtagcagtgtgaataatgaacatagaggtgagagactggttcatatgtggtattgctgatggttgggatgaattttgtatgtaaaacagttgaatgaaaggttgctttcaggcacttctttactggctaggcacctcttttaagaacagactcaataaaaagccatatacattatattacccttcagagaaaattttgggtggcatagcaaatctaaaaaaaatccacaggaaatctgatgttctaaacagagcgattatataaaacgctggctgtggcttaagcaaacgcaatcacagaattgcctagctgtgagtcagagtcggcttgatcctgaaaagtcccttgcttgatagtaaattagtggcttagggaaatatgtttacatttcatttcatattgtacatctgattgcatgttttgagaattggatataaaatatctttatttacagatttggagctgggaattatattgactgtgtgtacatacagacttaaatttcccagttaagtgtataaatacagtgaggtatatacttacatagcaagataatgctaatttgccattttatctcaaatagaaacatatccaagatataataatggaattcagtgactcttacggtaaagtcatcattactatagaatggcatactaggtcttatgatttgatcaatactaatttattgggggaaggcagaacaggtttaactatttttaactatttctttccatgtacttccatatttctttctatcataaaatcgaaacacgctgttgcacttgttattttcctgggtcttttttctatattcaaaaatacacctgctgtgtatttggttgtagcatcagagtctagcacagtgcctagtcctagtaatttctccatgtatatttgtgagaatgaaatggcaaaatgaataatgagtaaatgaaaataaataaatgcataaacaaatacgtaaatgaaccctaggtaggcttggctcactcataaacatttattgagtagctactatgtccaaggttctgatctggtacaccatggtgagcaaggcaaaaacagttcttgccttttgagttcttgctttatagatcaagacatatgttaatcaaatagttatagaagaaaatatgtaattaagacatattgtaaacattgggaaagaaaagtagaacttgctatgagtctatttaatggagagacttaatctaccctgggtagggcagggtaaataagcttctgtgaagcagtagtctgcaagctcagacctgaatgagttagcattagttccatgaagaggggcgagaccttgtaggcagcagaagagtcttttagagctctcgaggaggctaggaatgcggcatgttggagaaactgacaggccaatgcagaaaagaaaaggggagttgaccttaatcagaaatcaataaggatgaggcaatacgtatcttcaaatttcttctttgaccacatgtacttgtcatataaaaatacaaatataatgtcgtgtaatgcaatgatgttatattcatatttaatatctagttagtccaccaaaaggtatctattgattgacaagttgaaagccagcaaaaatgtaagaggcatcctgtctttaagaggtatataacatacataggcaggacaaatgtaatgttttttttaaagggaaaaataataaatcatgtaaacgatttatcctgaatgaaagagcaatgtcacattagaagaaggagaatgagaataggttgtatattggagaattatgctaggattacgctagactgtaagttctacagggtaagggctgtgtctaacttgtttccagtgcttagtgcctaggcaggtatataatataattactaatgttgaattgattttacttcactttgtattcttgaaattagggtttcttatactattaatagttaagcttagaaacacaaaatacagtaaatcttcacttaatcattgataggtcttggaaactgcaactttaagagaaacgttgtataacaaaatcagttttaccataggctaattgatataaacaatagttaagtttctacagtatatttatggtcacaaaaatcaccaaacttctaaatacttctaatattaactattgaaataaatgtaagctatatgtagaaatgtataaaaagaaagattaataaaaagaagtacgattattgtttatctgattattctacttcagggttgtgggtgtccagagctcaccccagcagctcagggaaccagccctgggcaggacgccatcccattgcagggtgcactcacacacaccctcgcacttacttagatggggactatgtggacacaccaattcaccgaacatgtgcaactttgggctgtgggagcaaacaggaggacccagagaaagcccgcgcagataaagggagcatgcgcaaactccatatagatagtggcccccggcagggaattgatttttttcttcatcaaagttataacaaaataacattatttgaggacatgctgtacatagacagcttcatttggaaatgaaaacctagtaaactttccctagctctcccttaaaacagagctgcttcagactagttttacattcctgtttttacctaaacatgcacaaatataactccaatttctaagtattttttgccatatttaattctgcttattgattcctgttctagattgcttttcagtgtctctccacacattttctccccataatcatccccctatcttactcacttttccttccccaagtgaaaatacagcacagccagtatagaagcatctgtaacccacagtgaagtgggaatagccattttggttcctttcctcctggtattgagcaacttttgttcatcaaatctgaaaaacaatatccagcttacctgggcatccttcttagaaaggtaatggagattggggcataagaagaaagaaaatatcttttgaatgtgcaggattttcaagagagaaaaaaaaaatatgctagggaaagaaattaaggcagaactgatagtgttagaaaaggtacacttgaattttttgttttaaaatagttcaagttcagataataatttgccatcttcaactttagcacttgaactaaaataccgctttagcactttaacctgtagcataaaaacaatttaacaaaacaactttggcagattctgcttagttgcctgtggtttctagctgggtttcctgcaattgcctggcagttcctctctgttctgaccagatttctgggtaactggcctcccttcccctctgggattcatgaatcctgtctaccaggagttatcacacaaacagttagttttagaccaatcattggttgtaaatatatgttttaaatataaaagcaatattgtacaattatgttacctacagtttttagaataatgaaaacattcttaaaaatactgataattcagctagtataacatgaacaagtgtatcattttggtttataaattatttaatcgattcaaaataatatgacttttccataattgtaagtagagttaacacaaaacattgtcctactttctcatccaaacatttttataagacaagtattaggttggtgtaaaagtaattgcagttttttgcaattacttttaatggcaaaaactgaaattatgtttgtaccaacccaatcaatatttccctttttttctttttctttctttttttttatttttttcttttgagatggagtctcgctctgtcgcccgggctggagtgcaagtggtgcgatctcagctcactgcaagctccgcctcccgggtttacgccattttcctgcctcagcctcccgagtagctgggactacaggtgcctgccaccatgcccggctaattttttgtatttttagtagagacggggtttcaccgtgttaggatggtctcaatctcctgacctcgtgatccacccgccttggccttccaaagtgctgggattacaggtgtgagctgccatgcccggccttcccctttttttctaaaatacttttacgtataacttttttggatgcctaattttggtctagtaactacaccatattgtatgaaacatctctcttatgattagagttttaggttctttcatctttgttttttttctctctttttctagttattaaaaataatatagtgatgaaggactctctttatacacataaagatgtattgcttaaaattacttatgtgagataggttcccagaaataatcagatatatcttcttagataaaataaacaacttggttacatgcctggaaaataataatagaaatatataaacaatatgtctataagcaattaaaggtgtatcaatatgtatagacccagcttaggtattctttcttactgaaatctcctgatctcactatatgtatttctttctttctaaacttccgaagtctaaggtctggtccttttttctttcactccagatcttatttatctctcagtctgttggagaggattccactttcctaatcttcatgttttgttcacctatttattgagttctttgctctatatctagaaaaactcctgaatgctatccgatgattcctttcttggacccaagagtcatttgttcaaaatgttatttgaacatctctgcagtaagtatagttgttcatcagggacaaataatgttgcacattaaaatcttgtctccttatgtattgtgttctaatgtctcaagctactgtaacaaatctcaaagtggggtgacacgtttaggcaaacaaagagcctaaaaacgtatgaacagccaatagaaacaggaaattcaaagtcaatgtgcagccttctgtgattcatcagttcaccaggtaagatcttggataaaaaaaaaaatcatcccattgttcacacagtctctagcagaatgtgggtaggcacttaataacattacaatgcagtttgaattcttgaaaccctgcaaagcatttatgagttaaatgttagagcactaggatgcaccattcgatagaacaatagtaaaactggcagaactgtttttcatatgtcaattaagactgcactccggagaccattaaggaaaaggatgctgctattccccgcagttaaaggaaatctattgtgtttcctttggtctagatatataagttctgcagaaaatgtctttcagtaggttaggatctgctaagatttgatcctaaattatttttcagatagagataataaaatcataagaagaaacactttggattctaatggagtgagtttgagttctggccatattcaattgtgtgtcgatggacaaattaacctcatacttacatcgtacttacgtcgtggaattattgaggggattaaatgagatgatgtatgtataatgcttagcattatacttggcgcaaagttggtactcaataagtgttaatacttattagtatgatgattttgttaatttgatgacaaaaggggatgaattgtgttaaaatcagcaaatattgaagaaccaacctaaaggtttttcctcactagattatcagctacatgaaggcaagtatgtgttgtcttttaaaaaattattgtttctacaatacataattcttgagttatagaaggcactcaatgaaggaagagaatgaatgaatgaatgaacaaattcctaacttgtgtctgtctcttggcctttgagtatataggtattttcacagccataggaaaatcagatgctataataataattctactagctttctgacataaatcttttaatttccttcttaggaggctagttcacataaataaaacactagaaaaggaaaatagctcttcctggttctgtaagttcaaaaaataaccaatttcttaatatggcagtaattccttgtatgactagctgggctgggactgagaccaaggaccttgacactaatgggccgtttatgaaatttacatagcctgaagtcatcctatcggaatgtccttagtaaccatcaccattgttacagaaaagaattgggaggctttttctttcttgcaatgatttctttagtttttttatgttgtgggtcctatggttgagatcatggtttgggtatttacataagagcaaacagtcctagaagtatgtaataatttctaatgcagctccttggtaaaaagaatgcaacaaatgacacagatctacagcacaacattagaaaaggcgcagattaaatttgaaacaagagcaacctagtgcaaataaaacccttcaggtagcagctttttggagataatcaaatccgtttttagacttccacattttcctaactttatgccctccataaggatgtgatttctgatatgcgtttgtgtgcttttacttgttggtgacttttgaaagaagtcagccctggaatgtagttgccttgcaaaaaaattcaagggaatattttgtaggttttgctgtctatgccttggaagcaaacaaattatggtacaggactggaactttacctacttgttaattggcaggttaaacttttatgagtttctggtaccctggcgatacatgactattaaaatttgcaggtggttcaaggggagagagatgtaagttcctgtgctagtaatatatcataaaagtgtgtatttcatgtgcctgttgtgaaaatggagactttaatactctttcacagtataagctgattaaggaatctttatggatctcattaacgatgggcctttttttcacagaaagtgaaaagtgtaatgcttatagacaagcatagaagaaaataattagcttggtagtgcctctttgagactgagtttagagcaccctctgcattcccttcccaaccctcagaaactgcccttgtctcagaaattgcttctaccacatgaaatactgtaaatctgtcattttatttttactttcaaaagaccgtgtttgcttaattttacttacatttaatagatggtatgtttcctttttcgagtccatgttttcattaggaaatacaaagacatatactgtggctagtgatgtgattccacataatgaactaaattttggaaaaagtgataaggggattgtagttctttggaaactctattttcttatattttacatgtaatcttaggatggaaagctcctcaaatattggctaaattaaacatttgcccgaaaatcttagaagtagatctttgtatccaggagcatagcttgttttagcatagagaaatagtgatatgaattagctttaactaagaaaagggtagtaaagtgaacaatagaaagtattcgttttattttaaatttttagtccataatttttctttacccatttttttttggagaatttctgtctgtttctcttagtatcatcataatcttaatatagcacttttggaacactagattgtgatttagtttcttcactctcttggtaaatatataatgtagtttgaaggtacttcatccattggcacttgttgaaaaattcattctttagaaatggttattttctaaattggtttaacctatggtcagggtgatggagcagcaagggaggtgggactgcatggggccaggggatggagagacttagggacaagatgagtgtgtcatggagaagctgaggaccacaggaaggcattggcaatggacataatgaagaaagaagtaatgctggatgaacaatcctgttgggcttttagctctgacatcagtcataaaaattttgtctcccaaattggttgccaagaacctatagttctttgtttcaacaaagaatgttttctgagcgtgacaattgtgtgcatataattgtatatgataataagtatatatacacacactatttacatgttatatacatacatacactgataatgtactatattttaataaagacttgaatgacctttatggcttttgttaaattagctttgtttttaaaatctcattttaaaatgtgagacagtagtacatacagtagagttgacaggaatgtatttccttatttttaaaggatatattgtgtcaggaaagaagaatcatcaactcttttgacccagtgagatttaagaaggtgggaatagagacttttataaaagtttctgcctaaatatttttttaaattgtgtatgtactccaaatgatattcttatcaagtcttatgattaatatagctttacaaataattcaccattttaatgagggttgtgagaagcaagctcaatgttataggaaagaagtaaaaaaaatagccttatagaattataatcgtcaaggaagtatttgggaatcaaagcctagttttggaaatcatttcttgccaagtgaaaaggtgctaagcttctcagcaagaagtcatttgtagcacaggcttgtctgtcagtgtttgggaggtgctaataagcaaataagcccagagttccagcctgagtatttggtacatccatggagtgctggtgggtatcttaccttagggaaagctgcaagtcagtccacaagatttactggagacctactttctatatatagatagtccccgatgtttgatggtttgacgtaagatttttttgactttacggtggtacaaaagtaatacaccttcagcagaaatcaaactgcaaatacacaatcattctgtgtttcatttttagtacagtattcaataaattacatgaaatattagacttcttttctttttttgagatggagtcttgctctgtcactcaggctggagtgcagtggcgtgattttggctcactgcagcctccgcctactgggttcaagcgatcctcctgcctcagcctcgcatgtagctggggctacaggtgtacaccatcacacctggctaatttttttgtatttttagtagaggtggggtttcaccatgttagccaagatggtcttgatctcctgacctcgtgatctgcctgccttggcctcccaaagtgctgggattacaggcgtaagccactgtgcccagctagctttttaaaaaatagtctttgtgttagatgattttgcccaaatgtaggctaatgtaagttttctgaagaaatttaaggtagactaggcaaagctatgatgttcacagtaggtttggtgtactaaatgtaatttcaacttgcttttttttttttttttttttttttatcagacagggtctcactctgttgcctaggctggagtgcagtggcatgttctcacctcactgcatcctccacctcccgggttcaggtgattcttctgcctcagcctcctgagtagctgggactacaggtgtgcaccactatgcccagctaatgtttgtatttttttggtagagaaggggtttcactgtgttggccaggctggtcttgaactcctgacctcaaatgatccgcttgccttagcctcccaaagtgctgggattacaggtgtgagccactgcgcccagcctcaacttgctgtattttcaatgtatgatgggcttatagggttataaccccatcctaagtggaggagcatctgtgtaggtcttttactaggtgcctgtctgggagaaaatgttatttaagaataggttataaggatttgttttttcttgcacattctttattttctagccagagtagataaataaacaaacaatatatagctcactgaaaaaactataataacaaaaaagtcaaaactacgatggaatgtatcaatcagaggagaaaacagaggcaaaggtttcaggaaaggaaggcttcccacagtactataagggatggtattagtgattgcttgcacctttgttcgtcagctttgtgctatatgccttataaatcatttatttttaccatttagtgccataggaatcctatgatgaagacacgatcatactcctgttagatgaggatccggcagttcagatgtgtgaagtaacttgctggccgttgcatcactaagggactcacgctcagttgtgatttgcttcaaagcctgatctctttattacatggcagaaaacaaagtgaatgttattcataataaaaagtatatgccacatgcaacagggactcatatctccagttttcttagttcaactgtgaggtaaaaattatgtaaaaattagaagaaaaggccgtctagcaaaggaagactcttcatctaatgaaaacttgaaaaaattaaaacaatagtgtaatgaaatggattatttattttttaaaattcaaaattaaatgaatattgattttaaaaactttagaaattagtggaatatgaaacaattcaaactacattagaaacaagtgccagtcaaggttttaaaatatgtccatctttagattaactaattaaaaatgttttagcttaagtaaattgtaaaatttctctgtcaaggatgtctacctactaaaatttcatttaaaggcattcattagttttagctaccaactaaataggaaagttttcatcgcaatttgaagggtatgcaaaataataatatgtaatttcctatagatatttttgttatgaattggtatttgctgcaatgatatcaaaaaaggaaagtagagcagaaggaagcccagacgtctcagttttaatttgaggaaagagtatgtgataagtataatataccactggttctctaggttccattaaaagactgtaaagagaaagaaaagaattctttggaactaatgattccaatctggagtctatctctggatccctaaggattcaccaacttaaacattagtttccttgttgatatttttgaagtcctaatgttaatacctttcccccacttaaagatacacaagacttaagacttaaactgttgagcattttcactgtttattactacatcaacagtatgataacattgtctctcctatatgtcggaagctctgatttgccattatatgtgtctttgtttataaataatatgaaactatataattcttactttatacaatttgcttggtagacaaaatttttgaattaattgtatacatagaggaatagataataaaagggtatattgaaaaggctgggaatcactattctgtatactgtacttagaatttaggtgagtaaaatgacctcatacatcattgcaagactgaggctggtgttttttgctgcctaaaactaaagatatttagcatttgggcattagctaataatgattaactctgtggtaggtgctatatctttgtgttaaggtaaacatactttaatatttgggacttttccttgaatattgtataagccagttatgataagagatttaagtgaaagtgctaataaactcccttcagactcagaccacacatgagaaacttcccctcagaaggaaattagaaggccagagggaagaaattataagtaaatgaacggcgttttaaaactgaggtgctgtaactagaatgctgctaagatattaaagtacttagacatttaaaagacatggttatttatatttaatttcaaaatgtatttaagtgaaaatttgaaaaatatttgagataagcagaactttcagatttttttttcattttgttaaaggaaatatcctactttcatgtattttgcaaagatgtcacaatgatattgaccattatattacctgatgtccattaaaggacaaaaaaagacaaaaagtaactttaatgttttttcttatcaaataataggagacatgtctgctccttactcatccttccttttttttttttgcattggctggcaggaaattaaatttagtattcagttgaggtaaataacttatctcagcctaactacaaggacatacctttcactatgcattttatttgaattttaattcagtaacgtaagtatttagttatatttgctgtctaaaatgccttttagatatttgtaacaaataaattataagtaaacaagtgacctctgagatataaattttttacatcttgctatttccaagttacattgcctgttcttattgaataaacaggttggcagaatattaagaatatcaatgtttacttctaaatacagaaaaacattgtaatggtaggcacaaacgcttcttagaagaaattaagaatgaatataacttaagaagaaaggctctttgttatttttgaagactatcctggttgactttacatttaatggggaagcagaggatgtttgatatttttacctcaactttttttcctcctcttcctttttgtagagaatactcttacttgaaaccctttgtatttggtcctcattctctgctttccgtggcttcctacctcgcctatttgttctatggcctgtgtgcctctttcttttctctttgttagttcctcacccttcttctcattgtgttcccaaatattttcccgaattttacagatgagaaagctgatactcagcggcattaagtagcttgacagagtttacacagctgctaattggtcaaaactgaggtgagaactctaatcctctccctcctggtacactgctctttctaatggcgttacttatagtagaacacgatgctgatagactgtgatgtagttctcgatggcttaaagtgtatgtgtttttctgtgtaaactagaacccatggggctgatgttaagccagttcacactggtacaactgcgctagttttaaaaatactgaaatatttccacattggctaattggtagctactgttaggagcctctcagctgtacctcttccttctttagaggcctttagtgaatccatcaggaacctcacaacttggtccagtggcaatcaaagagaggcatttagctacccatagttggataagatgattagtgtaatacttcatgtttttataaagagcaacgctctctaacataattatctttttggtctgcttttttctcatgataataatgagagggaaaatttattctgctcaaagaatgatgatttcaggttttgctggtttttgttttttaaaaacttcatgtggtgaaacgtgcctgaacagtatatgagaatgttatgatgcagtatcaaggttttctagcccctgtgttcacttaaaattttgcaagtgtagttccttttagagatcatttaaacattttaattctgaaataactgagtatctatatatgttttgcagatttcaagtatgggattactattgttatatctttactgtattcttgctcttttttttagttatagggaattgcactgactgattttcaaatgctaaatcatctatgcatttttttgtgataaacttcacttggtcatgatgtattatccttttaatatattattggattggagttgctaaaattttatttagaatttttgcagccaggctcagtgactcacgcctgtaatcccaaaactttgtgaggccaaggtgggcggatcacctgaggtcaggagtttgagaccagcctgaccatcatcatggtgaaagcacatctctactaaaaatacaaaattagccgggcatggtggcgcatgcctgtaatcccagctactcaggaggctgaggcaggaaaatcgcttgaacccgggaggcagaggttgcagtgagccgagatcgtgccattatactccagcctgggcaacaagagcaaaactccatctcaaaaaaaaacaaaaaacaacaacaaaaaaagaattttacatctatgttcatgaaggagattactattttctgtagtttttttgtaatatctttgtcaggttttgattattagagtaatacctcattggggttaggtagtattacctcctcttcatttttctggaggagctgtgtagaattggtattatattttctttaatcattttatagaatttgcaagtgaagtcatcaggcctcgtattttctctgtgggaaggtgttttgccaaatatttaatgtctataacagatatagggctgttacggttatttatttcttcttgagtaagctttgatagggtttttcaaagagtttgtcctcttcaagttcttcaattcaattgaaaaaaattgtttataatattaccttattatcttcataatatctatagaatttgtagtaattaatgtcacctttggatctccttttttgccagtattttaaataagtggacccactgtctccttgcctatactgtttcctaagaaatactagctgtcattcatattttgtctctttgtgtgtgatttttcttttactgtaaatttgtaaaataatttctcttcagttttggttttgagtatttgattatggtgtattttggtcaagttttctttatgcttcttgtgcttggggttcgctgagatttttggatgggtgagtttatagatttcattaaatttagatatccttcaaatatttttccatcccttgcctttggtgactccagttacgaatatattagactgcctaaagctatcccagggcccactgactttttattatctaattttctatctgtgctttcttttgggtaatttccattgctatgccttcacatttactaatcttttcttctgcattgtctcctctgccgtttagcctatccattgtatattttaatctcatatattgtagttttcactctagaagttcaacttccatcttttttatatcttctgtatttccacttaacgttttaaacatgtaattacagtttcaataactgtcttaatatctttgtctgctattaacatctgtttcagtgctggatcattttcaattcgttggcttttctcctcactatgggtcatatttttctgctttttaacaatcctgataattttttttggaaaccagtcattgtgagttttaacttcttgggtgctagatattttcatactcctatgaatcttagtttgttttggggtgcagttaagttacttataaacagttttatcctcttgagtgttgtttttgagatttatcaggactaatgcagtgtttagtttttgactaattattttctagtactgatacaacacacttctggatactctactgaatacagtttccattatgaagttttctagcatggctggtaggaacagcattcttcctggcctgtgtgagtgctggtcgctgttagctttaggcctctcaggtggtactttctcttgcctcaaatagttcccatacatatatgtattaatttgcactctgctgaatagttaatagagatcttttatagatttttagagttctgtgcctgttcagccctcttgtctctggtgctctatccagaaaactctaactgctttattgtccctgaaatctcagctctgtttcctcaagtctggatggatgtccaccacgctcccccggactctccctccctatgccatcatatagaaatgctctcttggcaacaactttgcacaatcatagagctcaccacctttgtttctcatctctcaggattgctatcctttgatggctcaagtctagaatcttgaaaaccgttgctcagcttttggttttgttcgcttcagggttttagttgtttcaggcagaagggtaaattcaattcctgctactacaagttgaaggcagaacttccttgacacttcatgcagagttgaagtgggaagacttttagacttaactaccaaagtgtccacttcagagagtaaaactcaagagaataaatcctagtattttttctattgaatacacctttatatttacttttttcttttcagaaaataaaaacttgcctttttttaaaaattggaaaagtatacaaaccaaaaaaaaaaaaaaaaaactacagctacacgaacacttaaagtttttaaaaataagataatgaaatagtatgattgtgggtaatttaatagattgtggaagtgttttccaaagtcacatgaaagtatgggtacttacctttaaggatgattttaccaggccacagaacaatgagaattaggaagtttttcacaaaactaaatttattcaatttaaaggactttattttttactttgtcattcttattagtgataaaattttatgcttaattgaattttaatatgaaagctgatgaatcgtaagaatttttttttaatatgatagctgatggattataagagttttgttttttttcttttcattcattaactggcaaaagtacaagagggggtgcatgctatgtggagtccccataacatttttgtactccaatagtctggaaacaactgtttgtatacgctcaaatactttacccatttttattcaaagattgattacctaagactattcagagaagtaatgtttgtttgtttctttgttttgtttttgagcatctgccctgtacaactcatagaatctttagggacaatggcacatgtctgaatggctaacttgtgtcatctttatatgtccttttctttacaccatatagaagatatggaaatcaattatttcattaatacttaaaagcactatttggagatgtatttttaattttcattgtttcctaatattatttctttctattgtatgacaaggaaacaggaattgatttggttcctgccctctttgtcatgaacatatgaccaatgagaaaaaatgcctttttaactatgatattaataataaatatgtgtcaattattgatgtattaagtgtatcattcagtacttatagaaattatttgaagtagccacaattattattcttttacaaatgaagaaattgaggcttaaagagttaagtaactgctcaaggtttcacagcaaatgtaaagccatatatgagacccccgtttgagtcaggcaaagactgtgctccatctactgcctccaagtgagaagataagttttagtgttttccactaagcatttcctggcagtatttctctccagacgctattcacaatctccaaagaggagaaacgactctattctatgcacaatttattactccggttattatacagaactctttatttaaaggggagaatgataaattacactcttgttgaaataagccttgtagacctttgaagagggttggaaaccaaaggaaacagacattccagaagtgtgacccattttttttttaataaatcttttcttttgcttaagatctcctaaaatatttccatttttataaaagccttctggtttctttgtgaaaatagctgcaaggatatgtcactgggtaggttcattaaaaattacaagcatacaccattactatgaaaagctcctatagcctgtttcctgcacattgggaagagtgcagctttccagcgatggtagcccatgaatctcggaggcctgcacctgcagattacagactcaggtacaggcactatgagaatagcccctgttttgtaaaaacaaaaagctctgctagtctatagaaattgttgggaaagagaagcggacctgtgtgagataaacaaaactcataaaccactgagattagataaattgttagagttgtttggaaggccaggcaggaacaaacattgtcttcctaaatgtagttttcctgcacttgggacaagcgtactatctgattaccccagatgatttatttatccttctagactgttgacatgaagtctgcatttcaggcctaggaataggtgtactttctgcagttattttgtttgcagaaatcactgacttctctcatgttactttttgtgattgctagaggtaacgatatcaaagttcaatgtgctcagcttgtctgtaatagtaaaatcttagtaaatcactctaggtttgaaggataggccctggtataataatataacaataaacagagttcctgttctctttatggttttagttacagcattgtatcagtgatacttcagtttcttcttgataaagatttttcatatttaaaactcataaaattcatgctgcagggtaagtaaagtcttctgaaagcatacattcatttacttgtttattcactgactccataaatttttattaagtacccaatttctggcagacattcttgtggatcatgcagactcagtggtgagaagaaaaataatatccctgatcttacagaactcattttttaattgggggaggggcttaaataaaaggtgaataaaccaaacaagaaaatatcaggtagtgatactacccagaagaaagtaaaacaaaatgaagcaattaagtgtgcttggacacctgctttagattgtgtggtcaaggatggcccctccaaggactagcgtgtaagctgatacttgaatgagaaacaggctgccatgcaaagatctgctggaagaacattccaggcagaagtaacagctcatgcaaagatatagcataatgagggcatgcctagacatgcatcataatgccttaccttgtaccttgatttgctttcatttttaccatttaaaattctgcttctgtactatgtcctacctccccttacccttcattatccttaaaattgtgtattcttaatgaaaactatattgttaggtgaccatagaaatattgttattttagatagttgattctgtagtgttttcaagaaattatttcatatttagaataattttgcaaagtgagttagtttaaaagtagttctttaagaaacaggtaaatttcaaaacacttctttccaaaatcttttatctcaaaacttgcattaaaatgagaaaatatgacatctcttaaaaacagaaaaaaggaaggaagggggaagggagggagggatggaaggagaaagggagggagggaagaaaagaaggaaggaaaggaaaggaaggaaagggaaagagaaaagggagaaagagaaagaaagaaagaatgaaaaaatgaaaagaaagaaaaggaaaaggaagaaaagaaagaaatagaataaaacagaaagaacacaattatttttatgtctggaaagatacagggaactttttcccaaatgaggtaactttgaagctgggagacagattcacacgttcataaagtgaaacttccagggcataatttcctaaattatttctttcactgccctcttggtagctcagtgtcacggatgagtgagtttacctcacaagtaagcatttagctcccccaaaacagtctcttaaccttagctcaccacgtgattagactcagggtgaatgcacaagattaatgagagccctgagtgaaaacagtctcttgtaaggacagcactaaatcttgaaaggctggtggttattgtttgtggaagctgagccctggactaatcccagaagggatcatggtggtggtgactcctaatctgggtatatctttcgggcttgatcatgtttttctgtgactgccattgtgtgtctgttggaatctatttttaggagccactgcatatccttgtgttttcttgctgtgcctaaatgtagatccttctattctacttttactccatttattttccagatgatataaagaggacatattctcacatctggaagttaatgccttggttctagtttattctccctccaagcacactaaagactttttcatttcctagcatcggtcttctagtggccaataaaatggcaagaaaagagttgggaaattcttccctttctcctcagtttccccttattttgttgcttcatttaatcctattctatttcagtaaaggaaacacggtctagttattgcaagggagaaagactagaaaggagaagatattggcaactagcaatcagccaagcaatagcaacaagagattcaatattgtcaggtgaggtagcctggttggagaatgcatatgccaattacaaatcgatcataaacaaatacttatacgcatgcagaaaatcctaatctattccactttgcccagtttctgtccatggactaatagtggtggtctctaaagagcactctattaggcaagaatgaggcattgattttataaaacagaatcttcaaaggagggggaagccaggcctgtggggaaagaaagcagaagtctggcaataggtcatgggaaaggaaggaatcactgtggggtttggacttggagagaaaaagtagcagcaggtcacaggccaacctgtcattagctttaagacacacacacgcgcacacacacacacacacacacacacacacacacacagccactgcttacctcagaatggattgggttaaaggttatttttttcccctctcaagactggtttcctatcttaagtttatgttaataattttactgcttctttacagtcctaagtttgcatatggagaggttaggtctcaaaactttcaatctcatagtccaaggtatgcccttaaagtgtaatgtggaaagggttctctttggctacacatgcatcagttttctatcaaaagttattttatagcagactgctattgggtaattgagatgcactttactaaaaatataacaggtttaaactagtggattttattaatacttgtttttgtttttacagtccaattacctagaacactatggtttattcagaacaggtatcttttgtttttatttcaaaaagtacattgattatttttatgaatgtttaaaatttaacagctttctatgcttttgcagagtgaaaatttcaacaaataattttttatttgctgtgattcttttgtaaccatagatattttttatttaagcgaggctatgtatatagtttaagactttgagaaaatcagtaaacctaatttatttctttgacaatattaaaagagcttagtttctggtattagaaataccatcaagacagggctttattcataaaatattacaagatgcttaaagcagtggcttaaaagaatagatttaacgaagcactattttcattttctataggtctgtaaaatattatccccacaacatagtgacataaaacacaactaattatttgctcatggttctgcattttggacagtatttaccagaatggtggtctctgctctcatggcatttagtggaggcttgggctgacaggcctaaggtggcctttcattcttcagggccattccccacatggcctcctagcatttgtagtcccaagctctttacatggagaatggatcccaagagagcaaaagtagaaagtgccaggcctcttataggctagatctgtttaaaggcttggctcagagtgggcacagtaccacttatattgcattatatgggccaaagcaagtcacagtgccagaccagattcacagcaagggaaagtggacttcacagttttttgggatgaattgttcacatttataaggagggaaggaactgttggctgccatatttggagactctagcccaaccttttaacaaatattttgaatagaaggagaaaccttcttaattatgaaggtagttttgatacatatcacctataaatatgcagtaattttatattcactcctaatcttgtaatatgagtttgtttccttgatttggagctatgacattccacgttactgatctttagtctgacaaaaaagagcttgacttctcattcaagtcaatttccaaatgtttactgttacacacttggcaatcaactgagttatttttgaaaacatccccttcaccagtgtagtgaaaagaatatagaggcaaacagatttaggttcaaataccaatcctgcatcttactgactgtggacatttgggcaagttattttaaatgttggggagtaattttactcatttgtataatgaaaataattatacctacttcatcaggatgctatgaagatgaaataaaataattataggacagtcactggacactatactggagggctcatttttcacagttctttatttttactttatataatgacaacagtgctcagaagtggaagtcatgtagtagtatttttgtttgcctttatggctattatgtgattatatgacttttacaacaaaaaaatctaatgagatattcttcttctattaggttttaataattaaaataggctgggcgcagtggctcatgcctgtaatcccaacattttgggtggctgaggcagacagatcacctgaggtcaggagtttgaggccagccaggccaacctggtgaaaccctgtctctactaaaaatgcaaaaaaatcagctgggcgtgatggcacgtgcccagctactctggaggctgagggaggagaatcacttgaatccagacagtggagtttgcagtgagccaagatatcaccactgcactccagcctgggcaacagagcgagactatatctcaattaaataataataattaaaataatagtaataagaatatgttttatgatttcctagttcagaatattctattattgtatattcaaattgcacattactgatgtgttttgtgtcaaagatatttgtgggttacctaggagaggtatatgaaaatatttttattattaattttaatcttgaggtgtagtacaccaatttttttcttgtcataaaatagcatgcagcaagttgaaccttggctttttctgaagttaattggacagaatttgcagacagcttgcaggattgtgtccaagtagattttaaaatttcagaaaaatgcaaaattatcattaacaaaattattatcgcagacaatttcatccaagtagatatagaaatagttgtaaaatgccagtttgcatctgagatgtatcacaatgacactgttttcatagttgaataagaaataagactattcaacaagtactcatgtcaccatgaaagagaaaaatgcagagctgaaggtggcatgacacattttcccattcacagctgagtgggcaggtgacgcgtgttagggagagagctgctatctgatattccactgatgaagcttgtcaactaaattgtatttggagttttcaaaatatcagagtggatgaagtctttggcatattttaacatttaactaagtcttacacatggctccagaggaggatcttccttcgccagttaatactaaattaccagtgctttggcaggaagcagaaagtgccatgtgggtagtggattctggagagttagcattgaaatactcactgtacattacatttatagaaaagattgagaggaaatttcttcctagcaggcttcgtgcaaggtttgggccctttctagaacgaactgcaagtccctttaacaatatccctgtgatctatgcatataggtgagatcatcatatgtcttagaacaggtttgttttgtccttcagaaattataccccttgtgatcaagtccagcctgccttttgccaagccagaagatattttttaactttgggaggacacaacagaagagagatttgttttcactttggacatgactgagtagttgcaggctctcagtggggaatagactcttcataacattagcacagtgatatacggacacacaattgcggaaatgcagatgcagtgttttcatttgatttttggtatagtgtttcttctgaataaatcaagcataattatgagccacatgtgactaaatcagatagagtaattccagggaattggttgatatatatcaagagctttaggagagaaatgttcgtggtttatgtttattattttttgttcatagcaatctctgaaagcagctgctatgcaagtcatttgtcattcttttccactaagtgccagtttgccaagtgagctttcatgtaagtggcggcgtttatgcaaatgctaatgcagtttttaatcttagaagcaaagaacctgaatattttgctaacatacaataacaatgatacttaatattaaatagcagcttttatccagggatagctatataatttacaattgaattggcgcaaattatttacatacattgagggcattgggttaccatatttagatcatagtttatctgatgtatgaacacactgaaaggaaatgtgaaatttgtattcagcatcttcaaagagtagaaaatgactacctcaggcatctaatagccaaaaagtttagtcacactcatacacaccatcttgaaattgcttttatttaccactctcatccttgtttcaagtctagttttatactttatgaatctgcaaatgattgcctttattgaaaggtttgtgttattcaagatgacttgtaaagtttactcaatcttccctagcaagggaaacaggaaattccagagaacactagactcagcaaacctataaaatctgagaaagcagaccattatttctggagacatttcacataacactttgggaagcaatgactaattagtttttggtcttaacaatagcactttcaggggctgttttctttctttttttttctttttatagctttcatattaggaaaagaagaaagtagctctgaatgatgaaatattggcaatgtatgcacttgcttctctgtaggagctcaactctttgatccttcatacaattaacttcattgcctagctggtattaaccggctggagagtaacaaccaattgttgcaggcacaacaacaccctaatatgctttgcctttaatgactgactgtttcaaattgaaagctctgttctctctattcctaaattcctgttgaagtaagttaagtccttaaataagtataggtactcattcacacctacagccttatcttttttgtggcaccttacccagtccccaattgccagagaatacttggtcattagcaggggtaagatgtattctgggttctctagacgtaaacatttgaatgttaggtctccttgcttgcttttatttctttattttttttttacctccttacttatttagtcattcattcattttagaatttgacttccatatgtctaaacacaagcagcctcccttgactcctcttccctctcccaatccacaatcaatctatctttgaatcctatctgctccacctctaccataatcctgctgatcctggcctccaccatggctcttggattattacagtaaccttctcattgatctccttggttttgtccttaatccccttcccctccacctctcatcgcccaccctggacacagtttctttcttcttctttttttttttttaaatattttcttttattgtggcaagaacacttaagagggtgagacccaccctcttaacagatttttaaatgtataatactgtattgttatctgtaggaataatgttgtacagcagctcttttagaaattattcaccgtgcataactgaaattttatacccattgattagcaactccccatgctctcccctagatcctggaatcactattctgttctttgcttttgtgagtttgactgttttagttacctcatgtaagtggaatcatgcagtatgtgtccttctgtgactagtttatttcacttagcataatgtcctcaagttccattcattttgtcgcatatggcaggacttccatttttttaaggctgaataatattccttttatatgtataccacattttaaaaatgtacattcatctgtcagtgtacatttatattttcaatttttttataaatactctaagtgggattgctggattgtatgatagttttaattttaactttttgaggaacctctaccgtttttcatagcagttgcaccattttgtatttccactaacagtgtgcaacaaactgaaaagcttctacacagcaaaggaaataatcaacagagtgaaaaggcaacctagaaaaatggaagaaaatatttgtaaactaagctaaacatctaataaatggttaatttccaaaattacaatgcaacagtaagaaaattaataatctcatttaaaaatgggctaaaggtttgcagggatatttctccaaagaagacatacacatgaccaacaggtatatgaaaagatgctctatgtcactaatcatcaggggaatgcaagttaaaaccacagtgaaatatcactttatacctgttaggatggctaacctcaaaacaaacaaacaaaaacaaaagagaactgttgacaaggatgtggagacattggagccctggtttatcctaaacccagcagccccagtgagcttttagaagtcataccatgtctcttctctgctcagaaccctccagtagcttcccatctgcctcagagtaaaagcaaaaatgctttccagggcccaccagaatctgtggctcccctcactctgattcatctcctaccactctttcctaccatgctggccttgctgcaccatccacatgctgagcacacaccacattggtgcctttgcatttgctgatcccagtgcttagagagttcatctccagatatctgtgtagctcctcgcctcacgtcttcagatctgtgctcaattgtcaccttctcagagaagtttttcagatcaccctgtagaaaatagcaatcctacccacctccaacctacggcaccctccttttccccttaccctgctttctccacagtccttatcaccaactagcaaggcttgttgttttgttacttgcaatcgatctcccccattagaacatacagttcacagaggcagagaatttgttttggaactgctgtattcctagcgcctagaccaaatgtctaccatgatatgaattaggagttcaacaaatccctacttcatactagttgaatgaaaaaattaaataataagtgagtaggaattaatgcctctactttcttctcatgttctttcttttatcttaccctccccactgccacctttctacattgtgccaagttctcatgtctcaagaatgtggtgttttgttccttgttagctgtaaatgtaatactccttcacccatttttatagaaaagttaactttcccctggatgcttgggcttcatcatttaatgtcctcaattgcagatggctatccataagtttgactctgtgtgtgtgtatttgtgtgtgtgtgtgtctgtgtgtgtgtgtgtgtatgtattttaaacttgtctttaccttttagtgtttgcagtaaaaacaaaggagattatagattacgtgtttttggtaaaattttttcatgttgttgcaagtcattcaagaatgaatgcaaagcataaagtttaaacttggagaggcagaaattcaaaatttctttgaaacgaatcatcgaattcctatgctatttagatacacttccattgagtagagagctgacaaagaatacacatttttctcagtggactgaattcttctttaaattaatttgtcagtatttgattgaaatactaaagcaattcatttcagttacattcaaccagcattgcctaagggactacaatgtaaactaatgttaataatttataaataccacttgggtgtcaagaactcttacaggcatttcatacattaggtatttaatatttgaaatttataatagttctataagataaagaatatcatccttttttgatattaggactttgaggcttccaagaggttagtttgccaaaatatacaaagtacgcaaagccaggaatgccaaagcttggaaattgacccaatttgaatttatagcttgaacttgttctcctagactagtgtttttcaaactgtggaccacaacctacagtaattgaatgattttttttggcgatggtgtcttgctctattgcccaggctggagtgcattagcaaaattatagctcactacagcctcaaactcctgggccgaagtgatcctcccacctcagtctcctgagtagatgggaccacaagtacgtgctacaacacctggctaattttttaattttttgtagagatagagtcttgctatattgtccaggctggtgtcaaactcctggcttcaagtgattttccatccttggcctcccaaagtgctaggattataggtgtgagtcattgttcctcacctcaaattctaaattataattatctacacacatacaaataattgaagcgaaagtttcattaagtaaaaccctcaccaggctgggcatggtggttcatacctgtaatccctgcactttgtgaggccaagatgggtagattgcttgtggccagtagttggagaccagcctggccaacatggctaaaccctgtctttactaaaatacaaaaaaaaaaaatagtcagatgtggcagcacatgcctgtaatcccagctacttgggaagctgaggcatgagaatcacttaaacccgggaggtggaggttgcggtgagctgagattgtgccagtgccctccatcctggacaacagagtgagactatctaaacaaaccaaaccaaaccaaacaaaacaaaactaaaccttaccctatgtaacacactgatattttctattctgttccagactaatctcatctagcctacacttgccatgccttgcattgcttatcctatcttgtcctgtcctgtcctgtcctgtcctgtcctgtcctgtcctgtcctgtccagtccagtcctgtcccattcctactcagcccatcccatctcagaacccactaaattggccttgtgatgcacctactgttccatacagtttctatatgcttgaaacactgtggatacaaaataggaaaaaattaaatagtaaggaacttacagataaatgaaaattaatcgttagatatggtaatgatgcgaaataatatattaaatgttaaagccctttgactcttttacttctatcagggcctgaaaataggagatattccttgaatcactcctctcagatactttcaagggtcccggcctgatgaagtcatgagaactagggaaacgactgccataatgtagtcacatcatgcctgtgtaacttttccatttattttttcttcgtccgtgacatgaattttgataccaaccaaaatctgttatactttaattttacaggggtttaatgcatgtgtattatttccccaacaaccctgaggacttcaattcaaggaatagccaaataagatagctgtaaatgagagggctcccaggcaatacatcattcctgatgcaaatatcattgctactaacattattattatcctattatacccccatgatgccttaaaaagtaaatattagataaatacatactggattgatgaatgagggacttatatgctactttcaataaatacgtaaaatacgattgtgggtatgactgtgaatttcatatcaattccttcagactcaaacattaatttttttgtctattgtaagaaaaatcacgaagtcagtttattcagcatttattgagaacttggtatctgtagaaagaacactgtgttgagtactattttcattgcctacatgagaaagtcagaattccagaatgtgtcctttttacctcttcaaacgcatcttctgcaccttcctcctcacatccttctgggcaagtactggttgaagtgtcctgaataaaacaggtatccatgcctttgtgccttagcccagctgtttagccctatttgtctgacaaattcaatcatggctttcaaaatctctatcaatcaaatgttgctttcttcctccaagttaagagttgcacctccatccacctatccatctatccactcaacaaatgcttattaagtacctactacgctccagctctgaactgattgggaagctctgaactatctgccattgggaagcatttctttttagctctgggtacccactggcagctctcccattccatccattacctgtctgtttcttctaatagattgtgaactcttatgaggacatgtattttaacatatttacctttggatttttagagcctagtatgagggtcttgcacatggtagacagtcaacaaatgttgaattaatgaatggagaaacattaaataaaaatggacatagatttctcatcacattcctcatgattgtagctattcctattccttcagattctgggcctttgttaaagcattctcatgcactgatatttgcatcttcccctataattgggaatagtgctactgtctacctactgaacactgttgaaaatttgaatgttcattttgcatgcttgaaataccagtggaaggccgggcgctgtggctcacgcctgtaatcccgtcactttgggaggccgaggtgggcggatcacgaggtcaggagatagagaccatcctggctaacatggtgaaaccccgtctctactaaacaaaaatacaaaaaattagctgggcatggtggcaggtgcctgtagtcccagctactcgggaggctgaggcaggagaatggcatgaacccgggaggcggagcttgcagtgagccgagatcgcgccactgcattccagcctgggcaacagaatgagactctgtcttaaaaaaaaaaaaaaagaaaagaaataccagtggaagggttctgcacaggaggatcatagtctatgattatacacacatcaaaaagctaatccaccctgaccaagtaggctttatccctgggatgcgaggttgctttaatatgctcaaatcaataaaaatgattcatcacataaacataactaaaaacaaaagccacatgatcatctcaatagatgcaaaaaaggctcttgataaaattcaacattctttcatattaaaatccctcaacaaactaggcattgaaggaacatacctcaaataacaagagcatctgtgacaaacccatagccaacaacatactgaacaggcaaaagctgaaagcattacccttaagaaccaagccaagacagggatgcccactttcaccactcctatttgacatactactggaagtcctagccaaagcagtcaggcaagagaaggaaataaaaggcatccaaataggaagagaggaagtcaaactatctctgtttgtagacaatatgattctatagtctctgcccaaaagctatagtctctgctcaaaagctatagtctctgcccaaaagctcctagatctgataaacaacttcagcaaagtttcaggacacaaaatcaatgtgcaaaaatcagtagcacttctgtacaccaacaacatccaagctgagaaccaaatcaagatctcagtcccattcacaatagacacacacacacacctccccaccccaggaatacaactaaccagggaggtggaagatctctacaatgagaattgtcaaacactgctgaaagaagtcagagacagcacaaacaaatggaaaagcattccatgctcattgacaggaaaaatcagtattgttaaaatgtccatatggcacaaagcaatttacagatttaatgctattcctgtcaaactaccaacctttttcacaaaattggggaaaaaaaatcctaaaaatcacatggaaccaaaaaagagcctgagtagccaaggcaatcctaagcaaaaagaactaagctgaaagcatcattacctgctttaaactatgtgacaggctgcagtatccaaaacagcatggtactggtacaaaaacagacacatagaccaacagaacagaatagagaacccagaaataaagctacacacctacaaccaactgatctttggcaaagttgacaaaaacaagcaaaggggagatgattcctatataatatatggcactggaggaactagctatccgtatgcagaagattgaaactcgaccccttcctttcaccgtatacgaaaatcaaatcaagatggattaaagacttaagtgtaaaacctgaaccctagaagaaaacctaggaaataccattctgggcataggccctggcaaagacttcatgacagagatgtcgaaagcaattgcaacaaaaacaaacattgacaaatgggacctaattaaactaaagagcttctgcatagcaaaagacagtatcgacagaataaacagacatgggagaaaatatttgcaaactatgcatgcaacaaaggtctaatatccagaatctataaggaatttaatcaaattaacaggcaaaaaacaactctattaggaagtgggtaaaggacatgaacagacacttctcaaaagaacacaaacccatgaccaacaagcatatgaaaaaatgctcaacatcactaatcattagagaaatgaaaatcaaaactacaagagataccacctcacagccatcagaatgcttattattaaaaagtcaaaaaataacaaatgctgatgagactgtggagaaaaaggaacacttatacacagttggtgggaatgtaaattagtccagccattgtcaaaagcagtttggtgattactcaaataacttctaacagaactaccattcaacccatcaatctcattatcgggtatattcccaaaggaatataaatatttccaccataaagacacatgaacttgtatgtttgtcacagaactattgagaataacaaagatgtgtaatcaacctatatgtccattgacagtagacaggaaaaagaaaatattgtatctataccccatgaaatactacacagccaaaaaaaaaaaaaaaaaaaaaagaacaagatcatgtcttttgctgcgacatggatggagctagaggccattatcctaagtgaactaatgcaggaacagaaaaccaagtactgcatattcttacttatacttgggagctaaacatagaccatataggaacacaaagagaagaacaatagacagtggggcctacgtgagggtgaaggtaagtgggagagtgaggattgaaaaactacctatcaggtgctatgctcatcacctgggtgatgaaatcatctgtacaccaaacccccaagacatgcaatttacctatgtaacaaacctgcacatgtaccccggaactgaaaagtatgaaaaagaaaaagtctatggctatatagactatggtaactagggtcaattaagtaatatttgtactatactagtagcaaaactttcgagagagagaaggtattggaaaactttgctactagtatagtgcaaatattattcatttgaccctagttaccatagtctacatagccattgactttttgttttttacaattttatgttcgggggtacatgtgcaggtttgttatgtaggtaaattgcatgtcttgggggtttggtgtacagattatttagaatcaacttattgtgaaatatttatgcatttgtgcaagctcattcatacagacttcttattttcaatcacaaaacaattggagaaagattaaactagaatatatctatactttagaatggaatagaaacatatgtctagacatggaaagatgtccaagacatgttgctaagtgaaaagagagtgatatgcaatatatatatgtgtatatatataataaaatatataatatataaagagagagagaaagaactggaaaatttatatatatataaagtatacatatatatgaaatatatgtgtgtattttttattgaagaggcgaggtttcactatgttgcccaggctggtctggaactcctgagctcaggcaatccacctgccttggcctcccaaagtactgggattacaggcgtgaacaactgcacttggccgattttccaatactaatattgatgactcctgtgtattttcttttaatatgtatgtacacaacatacatgaagtagttttacaaaaattgattactgctgaaatcttaagtggtattgtctaaagtttgattaagatgatatttttaaaatttctacttcaaataaaattatgcaaattttattattgctaccccacaaaggtttaggcagtaatcttaacggaaaaagcctgcagtctttgaaagttggtgtaatcgtattaggaattcttgtgagtaatggtaaggtaaatgggaaaagatttcccaatttcattcagttttcatttaaaaaatccatatgtggttttgttttcatgctaatttctgatagactgatctttatgaatccatctgtcttaatgattttaagttgtggaattgtcatgagggactgtttggtgcttcacatatacaataaacatttaatttaacgtctttgcacgggaaagtgtgtaaaacatttagcatctgctatgaatggttataccttgtaaattgtaaattcaatagatggtgttttcataaaaatttgcatgtgctaagtgaggcttcattttaatacacaatttatagttaaatcatctctgtgttagcagtaggcagataatgaaatgtagatggtggttcagcattgtttatttattgagggaagaagtagatgaataaggaatagatttgatgtgatgaaaataatgggattgctggtcctgaaattcaagcctggttatatattatttactgattaataaatctaacagatagcatgaatacacatattattaagtaaagattctctttaggatgaaggtcatgtaaagccagagatattttgaagactgtcttcccatgggactgggagttttatatactaattaaaactctgtaaatttcctcacagcactagcagtccagtatcaggttttctgagctgattttaattaaagttgattttaggctcaatttaacttcatttgaagctaaaatggtctgcagaaagtagcctttaaggtctgagggtagaaggagaattgtgaaagagtgtatgtgtatgtgtgcatgtggtatgtgtgtgtgtttatatacatatgatatattcaagaacactaaagcctgccaaaaatatcatatggcttttttgttactgtagtttgtttgagctctagccagaggaacttcagccaaccaaagtcagacccctgaatcaccagtgtgtatctctgcgaccatggacaactcatttcaagcctttgcatctttatgtgctcatctatactctgtttttaaataattgctcccatcaaaatatacacttcagaagtcataagggaaaaagattgcaaatttaatatgttgtaacttccagataatgtgtatatatatatataatctggaaattatatatatataatctgaaagtttatatatatatataaactttatataaagtatgatatgaaatcataccacagtacacgcacacattgtttggtactatgcagtgttcgaaaataattttcacttctctgatgcccttaactgttagcatcatcactgtaatgcaggcaaagataatttataatttctgttggttttaaaaatattattaaaagtttagtcccaaaaatgaaaataattcatacatttatagaataaaaagggaaagtccctctcacaggattatagaattaaaaattattaacacttttctgtatctctttccagatccctttttctgaacatttacacacatgcaccacacacacacactgccacattatataacgttacacacacacacacacacagacacacacacacatacgtagcatatcactgtcttttcacttggcaacatgtcttggacatctttataacatgtatatacactttatataaagtggtatatatataaagtttatatatataataaatttattagttggctaaatatttatatattaaaaataaatagtatataagttctcacaaatcaaactgaatataaacatgaacaaaggatatgcaaacacaattcatagaagaagaaatcagatggccaataaacatatgacatatgcttaagttaataaattatcaagaaaaagttaatatgagatacctttattcactctgaggattgataaaaaatctaaaaagattcctgttatccagtgttggtaatgctatggggtgtgctgggcactctgatatactattagaaaagtttgagggaccatgttttcatttaacaatttaaatataacactttgccagtcattggactttttagaatcaatgtattgtagtgaaatatttatacatttcttcagactcatgcatgtagagtttttattttcaatcacaacacaattggagaaagattaaactagaatatatctatactttagaatagaaacatatgtctagacatggaaagatgtccaagacatgttgctaagtgaaaagacagtgatatgctgtgtgtgcgtgtgtgtgtgtgtgtgtgtgtgtgtgtgtaacattatataatgtgtctgtgtgtgtgtgtggtgcatgtgtgtaaatgttcagaaaaagggatctggaaagatatacagaaaagtgttaataattgttaattctataatcctgtgagagggactttccctttttattctataaatgtatgaattattttcattttatgggactaaacttttaataatatttttaaaaccaacagaaattataaattatctttgcctgcattacagtgatgatgctaacagttaagggcatcagagaagtgaaaattattttcgaacactgcatagtacaaaacaatgtgtgtgcatactgtggatatgacatcatccttagtatttgtacttccatataatgtatattagatgtaactttggatgagtgtgagtaccctccacttaagcagttaatttatcttacattatctttatttatcagatctggtggctttgaataatgctaaatttcgcttctgatcatcccagagaatcaaaatgaaaaggttgccacatgtaggagttttcagtctgtttcattctctctctctttctctgtgactacaaagtgtttccctattctgcttttttcttcatctcttttctcattgtctctaattctaaaaacggttttctataaatactggaagcgcattgtaatttgacttcccaatagcaatgataaactttgaaatgcttaatattgtttaaatcaagacaacaaatgaaaccctgtctggctatcagtcttgttacagtctctcacttaggtaaagactcaagaacttttgcccatctcacgtctgcttcatcaggttcccaacatcctgtgcaccgataatgctaatatgcccaccatcaccttccccgattcattactcgaaggaaccctgggaaatttttggctcaaaaacttcagaggtcctaggtctcattactactgtcttcttattgacatggagacctatttgtagtttgagaaatcaatttagtggtttgaaactggcattttaaacacaagattgaaagtatcagaatgtataatatgtagaaagagtaagagaagtatcatttcataaaactttaatctctttctcgctcttcatacatacacacacaaaacacattcaaatctctctctctctctgaatgtacatacacacacacaaacacacaaaatgtaaaatgtatttctattatgggttgtggtaaaaaaattcaaatcttctattttttgaactgctttcacttaatgatagtagatattacttcacttaatgatagcaataccttcaacttgtattgatgcttgataaaatattttatgaaattcatcattgtacccactcttaatacattatcaaggaagttattcattacatcacttcatcatggagactgtaagagaaattcctgtatggtataaatataagaataactggacattgttttgttttgtctttgggatactgtgaaatattctcttaactaggtttacctcttttttttttcttttttttttttttggcggagtttcactcttgttgcccaggctggagtgcagtggtgcgatctcggctcaccgcaaactccgcctcccaggttaaagttattctcctgcctcagcctcccgagtacctgggattacaggcatgcgccaccatgcctggctaatttttgtatttttagtagaggcggggtttctccatgttggtcaggctggtctcgaacccctgaccacaagtgctctgcccacctcggcctcccaaagtgctgggattacaggcatgagccaccaggcccggccggtttacttctttatattgtaattaaatagactagaactaatgctgtgattcccccataagtgaataagggtttttgtatgcattttactttgtcttatttcagacatttttaatctctgttcttgtttcccttttctatttctgatattattttataaacctactcttgttttctatttcattacccttatcgattatattaactctttcttctaaaataaataacattttctgaagaaaaaagacatatacagatgctgatgattctaagatgccataatcactttgtttgccataataaacaaacacaacaagacatgtaaaactcaggaatttctctttcttagtgcagcctcatatatgtcttcaaaccttgatgatcttttatatttaaatactatcttttctgaaagctgcttgacttccagtctttcatattaatgttttgtaagccaagagttaatgatattaactgctttaattaagtgcattagggacacgagatttggcttctagttccagatttatcactgtgtgctcttggagaatttggcaattcaatggacttctctggatcatgttccttcatctataaaatggatatgataatatcaaattctcataaaagctgaagggataccccagatactcaaagttctttcttaggtctaacatttgtatatcaaagaacatgtcattctgttcgtttgttaatagcaacttcataagctcttttatatccagtgctgtgtagacatctgaccttttttaaagaaaaaaaagtattccattgcttcacccacatcacatgtcagcttttattgtaatattttactggaacatttatctttctctttatttttggattaccttttatcttttttgaatttttagtatcttagcacttgcatgacaatgaaaaatgttaaatgtttaaataaatatatttagaagtattaggtgcatataaaatacacacatataagcacatttaaaatctccatatttttctatatagtggtacaacacttgcttggaaataacatgaagtgatttatctcagctcttattttcacacatgcataatatagattgcaaattgtgttacattctgaggacattcttcagtattcacttgtttggaggtgagactctcaggagacttatgttttagaaatataaaacaaaagaaagaaaattatttaagaatccctctcttcttccacctatcttccatccagaaagggacatatatatatacacacacacatatatgttttgttgttgttgttgttgttgttgagacggagtctcactctgtcgctcaggctggagtgcatggcgccatcacagctcactgcaagctccgcctcccgggttcacgccattctcctgcctcagcctcccgagtagctgggactacgggcgcccgctaccacgcccggctaacttttttttgtatttttagtagagacagggtttcactgtatttgccaggatggtctcgatctcctgacctcgtgatctgcccgcctcagcctcccaaagtgctaggattacagacgtgagcccctgtgcccggctgggacttacatatttagaagagatacagtgacatagaggggaaattagttttcacagattttcaattcccaatgcagggattcttcaaagtcagagcaacctacagatgatagatgactaccaatgacaatgttttgacatcatatttacaggatttctttccggtcaacattgagcattttctacccctatgtataagagtggttgggaagacttctaattttttttcctgtccattcatctctcttacaagatacattattttgttgtagccttaagattcatattaatgcttggaaataaatttgagacaatagaagtgaccaaatatttatttccccaccagttgccggactcacattccttcaaagctgagacttccactccatgctatcatggtacatctccctctccacctttccccaatctttgcttaatgtattcatatgctcattttatctccattagggaggcccaaaatcagtcggatatcttagcctgcattggatcctccattgtctgaaatactgtactacagttgtcctcagagttatctgaactgacctatgtctgtattaaattttatctttttgagtgaaaggagtttatactgtcttactactttacaatatctatttgtaattctttagactctagtgtcatggaaaagctgtattttttcttctctctgaggttttcagtggttggatagtcaagatagcgcctggttaattagcagctggtttgtctacctccccagaggaatattcagtcctagcccaaccacaaaagcacagcttcaaacagggaaggtgactttgttgtgagtctaataagatcacaaggggctatatttggggcttcaactacagtggatggcctaggcatccaggctgatagctgattgactcctaataatctgaattattctctcaaaacaacacaactcaatgggagctactgatttgctagggtatcataaacagaaagagaattaatagtagtctctgccctgatacaaatccacttccactgaattgaaacaaactcagtaatcataaactagccaggaatggtgaagacctactttgacctaaattggcttattgacttgagtttttttttctgaagaaaatacctcttattgcttatgattataaatttccacagggattagataaattatattttatcattaattttgtgtacgtggcaacatgattggggaaaattatctagtgattaaatgtaactgtatttgctttgctagaaaattacaccaaagaagaccaatgggtaagtagtctcacctctcttgtaaataccagattggaaactgggtgtgttctaggaagaacacacatgcacctcataaaagtaaatagaattaaatcaacaagaagtaagcactaattataccatagggtgaatagtttttaaaaagtcttgtcttttcaattgttagttatggtccattctaaaaaacatgttatgctcttataacagtgaggagatcctcaggggatgaatattagtaaaccctcaagacatcttatatatgaatatttggtttaaaactaaatatttaactctttgtgttaaatagcagagtaccacccttcatttgtaaaatagaattcaagatcataaatatgtgttggatgacagtagaacccgttttaatttgtacacacacaaacattatgttctttctctccctctctgtgtgtgtgtgtatatatatacatatatatatacacatttgtataaacatttgtatatacatttgtataaacatatatacatttgtataacatttgtatatacatttgtataaacatacatttgtattatatatatgtatatatatgtatgtatgtatgtatatatgtatgtatgcatgtaagcatatatgtgtgtatgtatgtatctgtctatctgaaggagaaaagtttcatgctggccactactaacaaaggtgatttgcaactgggcatggtggctcatgcctgtgatcccagaactttgggtggccaaggtgggttgatcacctgcggtcaggagttcaagactagcctgacaaatatggtgaaaccccttctctactaaaaatacaaaaattagccaagcgtggtggcgtgtgtctgtagtcccagctacttgggagcctgagataggagaattgcttgaacctgggagaaggaggttgcagtaagccatgatcatgccaatgctgcactacagcctaggtgacagagtgagaccctgtctgaaaaaaaaaaaaaaaaaaaaaaaaaagagtgatgtgctatcaacatcaataatgaagtacatgtctcaatagacatctcagtttgtattttctacacactcagttacatatcttgtaaataaaaggggaaaggtagattagtattttttatcccccgaccactgtatatcccatactcatcttagtacttaaatggctatttccaaatacattcattttcttaagcatatgggatgagttgatggtatcctagatacaaaggagtctcattattttattttgccagaacttttttcttccccacaggtttatagtttcatagttctttatagtatgctacgcccaaaggaggcatgaataccgaaataaaaaagtgccaatgttaagatacatgttttgcaccagaatataaattttcgcattggttgactgataacactgttgtattgtcatttttctcaaagtaaggtcttactaagcctgttcttgaccattaccatcaagtaccattaccatcaagctatttataatctttgtatttagtttctatgtactagcaatagaaaatattatctttctcatctctttcatttagtgactaaatttccctagaatatacaagtgatctaagacccagggctggaaatgggaggtacatgtgagtttctcaaattatgcaagagctttatcatactatggcctgaaaaattcctgcatagtggccattgtctgtcttatagaaaggcaggagtttgcattcaccaaataaacgaaacaagaattcacagctgcagaaaattgaattacacattttcttaagacaatagtcatatcatggcaacagattacctacttaatcaactgtaatcaacttttagtaattgtgaaggtaaagttagttctattagctcaactcaaaacttcctttaagtagtaaaataaatctaattacattgagttaacttttttgatgactatagttttctactataggctatttttcaatgagttgaataatttgcttatatatttatatttttttatgatagtgttaatcaacttgacatatcaagaggataataattttctgctcattaaataatatccctaactatattgtcaaagtactcaaaatttaatgctgaaatatgtaggggctgagcggcctctgtgattgtttcagattgcatcttccattgttgaaagaattacctgtgatatcaattaatgttcatagaattttcggagccaattttaatgaaaagttaaacccagtactgtttatcagtgccagtaattgctctcctgtatgttataaccaggcctatctattcccaaatgccccgaggcagagctgtttatagatagccatgaaaacaatgttttgaaacttcagcttgcctgaatcaaaaacctccttttatgcatggttagttaaatcagccaaaaagatagttgacagcaatatttgaaaatatcctgaaaatggtttgaccttttcattaggtgctagaaataaaagcagagaattaaaagaagacttctatttaaccttttgaacaaaaaccggtttacaagtcaaacatatcttaggattgtgcgtgagctgctgatgacatagacactcatttgctccttaaagaacaaaatttgagcacaaggaaagaaaacctttctctggaacaagtaagctctatttaaaaagtgtaggtctctatttaaagagagtagggctggcaaaggcctttgtcgtctggccagcaaagaggataatgtgcagagacatttaaattcagtgggacaaacactaccctttgttggctcccacactctcagacacacacacagaacttccactaaagtgagagaactgtatctaatttggaattcagaagatggccaaaaataaatagtttattgtcatattcagatattatattcatggttttctaggttggtgtgtatgacatcactgctttaaacccagccatgcatcagcattggtcactgttctttctcatgcctagtcggggggtgggtttaaaagaagaaagtgttgagcatagatttgacaggacttgaaaactgggaaaggtttagggatacacttttgagttgaatcttttcctttttgctaatgctgcttctcatataacgtatattcaaatatattaggttttttaattacaaaagtaatacttgcttattgttttcaaatatattatgggtaagctgttttttaaaaagtgaaactgtctttctgcctctatgtccacatcctcagcaaaagcactgttgatatagtttttttcaacctttttgctatgcatttacaaatatacacgttcttttgtgtgtgcgtagatgtagaacatatattccaagtgtcattgagaacaacatatattttcctgcaagatgcattttttgaaaaaaacttggaaatatcaagggctgccttctgtgttaaaagctataaatactttcaacagattatccacagttgtacattatccacaatgtaagtgtaacatgattaatttttttcctaaggttggatatttagtttctctaaaatttttcactactatgaaaaaaagattcaacgtatatctaagtatatgctaatcaataaatgcttgtgaccatgtgagctttacattaaaaacaaaaagttttgaatatttgggtaaatgttgaattcccatcttgatagattctttcaaccctaaaaataagataggattactgacgtctttaaaataatggaaatatttattggccctagtgtatctgtggtatcattgaccttttaaaaaatccaaatctagatatgagtcagtggtgtgaaaacaaaaaataacagagagtttaaaattatttatgatgaaatatactgacacctaaaataacccccatgtgaagaaatatttcacactttattttaatatattttttatattttacagaaacacttatatatcgcttaccacaattatggtcactaatattaacctttttcatttaccatttttttacttcagagataaaaataaaaccaataaagttatgctgcttataaaacagaagaccttgagatgtgtctagttttattatattgttgtggagccatttgtattgttagcccatgtagaggaaaaacagaaatgcagccacgtccataattccttttattcatgtgtaggttataatttgaaatacatcagattaatgatcttagtcatgcaaatttaatttataaagttgagattattttcaccaatacctaaaacatctgtattcagagtttttgttaactatgctttattatccaggctgaatattgtagcaagaactttatagttaactgtcatatacatctcagaagactggcatacattttgtgaaatctatgaatttgattgcttaaaaactcctttggctcctatagtgtatgtattcctattagaatatacaattgaaagaacacaactagagcgtatacaaaggggagtggttaaatcatagaggaccctgtcacccacgctgtagtggagtggcatgatctctgctcactgcagttctgcctcctgggttcaagcaattctcctgccttagcttccctaatagctgggattacagacgtgcaccacaatacctggctaatttttgtatttgtagtagagaggaggtttcaccaagtgggccaggctggtctccaactccaactccaactccaaatccaattccaggcctcaagtgatccacccacctcagcctcctaaagtgctgagattacgcgcgtgagccaccatgcctggcgatctggaggtattctcctgtgaaaaagagacaactgtgattgttataaattattccataaactcttatgtgggaaacacattaaatttattctgtatagctacatgaagccaactaagaccaaagagtagatgttgaaaggagagcaacgttcaattttagtttaatccttaagaatatgttctgcttatattaataacaataatgcatatttatcgtacaaaatgcaagaaagcattaaaagaaaaaatatcacctttgatcccataaccaagaaatggtttggtaccttttctttaaagattttatatatgtatggttgtattcaaattgagtattaattattagatttctaacagttattaaattgcatagggaagagagggtaacgtaactattttatggtaaattgaacatttgtaataatttttttatttaaatattccacttttgaaaatggacccattccatcagtttcctttttggtcaatttcctattcatttctgaaaacaatttggaagagactcctttcaaaaatatattgcaaaaatggtacaaattaatttgcaaagtcaaattgtgtttttttggaaaggattcaggattttattgctaaaagtgagttggaaaacaacttggactgcaaggctcctgaaattctggtagaatttgatgtgttgatagttcaagaagaccaaacctacaagatttgtggcatagtagatgcttaaaaatataataataaagtgacagaatcggggcagatagaataatttgcatgtcagaggaataagaaaagctcttgggccaattaataggccctagagtattttgtcaaaactgaagcctgtgatataaaatcttacctttttgtgctggcaaaattaagcccaaaacactttataataagtaagtctgaacgtatgtataccttaagaccctgcatacacctttagatacatatccaatagaaatgtttacactaaatgtgttttccaaaagtacatgcacaagaatgtttgtagcagccctatttatagtagccaaaaagtgagagcaatgtgcctcaaaattagagtggataaattatgaaacattcatgtaatggaacaccatacagcaatgaaaaagaatgagccattgttacatacaataatattggtttaccttacaaatataatactgaaagaaagtaaccaaacacaagagtgcctactatatgactcaatttttataaagttaaaaatatggtcaaaactaacatggggtgttaaaagtctggctagtagttactttgagggtattaatgagagagggcacaaggagtgctgttgtggtgttcaaatgttttctttcttgatctagctggtttattgggagtgtttacttatattaatacactaagatatacacctatggtttgcccgcttttcaggatgtatgtagcactggaataaaagtttacataaaataaaaaagtttccccaccatggctcttccacccttcacaaaaaatactttctccattaaagaaggagctcagagttataaatattactgaaaattttattaaagatacatttaaatatactttttaaatgttttgtttaattttgaggaaaggtcttcctcaagtttattataaaatttaagtttactaattatctgtttgcagtatctcagataatgaaaatctccaatttatacctctgctctatactcatgtcttttctatttaacaaaattagaatcagacttttaaaatatgtttcacctattattctgtttttgccatttttcatgacattaaatatttccaactgaaatacgttctaacaaaggtgttaacaaatgaaacaagtatctcaaaagatcatgctacctctattaaatatttgagttgaggctgcatggccacttatgggagaagtaagtggactcagactaagatatcaatgcctggcaaatattgggctgttcaatgtgtctgtggaatgaattaatgtttttggaagtccttccaactctgattgcctagaataagcaaagtcagcaagattattgtgaaatgctcactcactgacactaaatggtacataacagtgcctggttctaattattacatcaacatctgtgattactgattcaaccctagctctttgatatttattcaccaactttgccattgttttaaagatagatgataagcaccatgaatactgatggaagcctttgcttttggcaaagggtagacaaggtgtctccaaaaaggctttatttcagcggcagaagaatttctaacagagcttgtaaacttatttttagtctccgcccctttcccagttctggttacagggcagacacttttagtaattttgcttgtctgataaatgattctatcattattgatattgttcttctcttagccacatgtgaacacatttgattgagactttaagaaataaattatttcctatttcaagagtgcttctcttttgttacagaactcagaggtctgacttggaattgtgctttcattgtttcttcatattcatactataactaatattgctaatgccaaactttttattctattttttaggaagaggtgaagcttcagagattatattgtgattggtcagcttcttaatcagaaggaaaggagtgtttgtttagatatctcatacatttactttttgactgctatgcaacaagacatagaaaatgagggtgaaagtgtcaaagggaaaagagtagtagatgtcaaatgtcatacgtgtttctacatggatatatgttcacatataggttatgtatacatatacataccgctgtggtctgaaagtttgtgcccctccaaaatttatgttggaacctagtcaccattgtggtggtattaagaggtaaggtctttggaaagtgattaggtcagaatggccttgccctcaagaatggattagtgcctttacgaaacaggcctgagggagcttgtgggcccctttgccctttcatcatgtgacggcacagagaaagcatcgtccatgaggaatgggccctcaccagacataaatatgctagcccctcgattctggacttcccagcccccagaactgtgagaagtaagtttctgttgtttataaattacccagtctaagatatttttgttatagcaggctgaatggaccaagacacatgtatatgtgcgtgtgtgtgtgtgtgtgtgtgtgtgtgtgtgtgtatatatgtgtgtgtgtgtgtatatatatgtgtgtgtgtgtgtgtgtatatgtatatatatatgcatacatataggtgagtatattggattacattagatagatatgcataaataatggagaatctcgattggccaggagtagaaattatacagtacagatctgacatgtggatttcccagatataatgcatccactgatgcattgtatccactgatttatgtggatatagaggtatccactgatttatgtggatattatttgtatccactgatctatgtggatatagaggtgcttcggcgggggttgggtggggggaaacatttgctattcagccctatcggcatatttggtgaactgtgtgatgtgagatggcttggagaacaggcggcacattttaggaaggagtttgtggtccctaggaaaagcttcactcaaagaaaagagtctggctcagtgacctggaattaaagggcacctggacactaggggaattatggctttgggaacagcatggcaatgtcacctaaatctgccccagttcagccatcgttatggtagatccatatcccagatgttaaggactgtgtggaacctaaaacagatacttcactaaagtattaggtctcaagtaactttgctgtaggatccatctgaagtccggagtcagcatttgaacttcagttagcagccttgagatgctagccagggcagtttgagtggccattgggcagattatcaagatagaattccaaggtcaacagcaaagtgacctgaatcctaggctgaactgtggtagccacacactccctgagcctcatgtagtgatctttcaagaccaggaacaaccaaaatgagcactaagaatgtggcccaaggataacatagaagtggcagcaggaacattgtccaggatacgtcagtaagaacacatacgcgtatgacactctgaggaaacaagcagaaatatcagaagtgagccttggaagttgaggctcatgtcttccaattgagggtcacaacctggagtgtgggcttgatttgtcaaaggacctttgtgggaaactacaggtgggaagacctgccatttgcatagagaaagagaaagaacatgtgaacagtcttataagatgcagacttagatgcatcaatatataattgatatggtttggctgtgtcctcacccaaatcttacctataattgtagctcccataatccccatatgtcatgggatggactcagtgggaggtaattgaatcatggggacaggtttttcccatgctgttctcattatagtgaataagtcttacaagatctgatggttttatacagggcagttcccctgcacatgctctcttgcctgccgccatgtaagatgtgccttttctcttccttcacgtgtcactgtgattgtgaggcctccccatccatgtggaactgtgactcctttaaacctcctttcctttataaattacccagtttcgggtatatctttattagaaacattagaacagactaatacaataatataaacttggacacacataatataaactaggatgctctatcaaggaaacaataaaatgttacctttttttcccaatgtaagtttaccatgattttgcttttttcttattcctgtgatgctttttataaaataaattataaagtattcattgaatgaatttatatcttctaatcagaattttccttaggaacttctctaattgtgtagttagggtaaaaattgctttgtatatgcctgtggtttcaaaagactggaatgtgctatttatctttttatttactgaaggttttcacttacttcttatgtatttcttatactgtattaattctaaagtattaacctatttccaggtgtaatgatgataagtacacaaaggtcagcattgattaaaaaaagtggggggaaggaatttaattctggagctaaaatccatttagttaaacagatcaaggacatacattaataggctgctgcaagcacataatagcctaagacataaataggcaaatatttttttccttggatgttaaattcacagtattcacagtagctgcctagagtattatgttaagaaagaggctgaggtttgtcggaaaagaattagtagtgcttatctgggagtgcctaaactagtgcctgggaggttgtggtgacacaagtgccacatatttgctaatccttgtctaaagcttcccttaactatttagtttagctagttcattaatactatataatatcataacttattttgttttgtttttcataatttgtctacagagattacattattttccaaaatttttgtatagattattacaaataagtaaatgtcagatattttatgcaggtatctggaactaaattatcaatatttataaatatgatctaaatcaaacagtacacttgctaaagcaatctacagatgaaaaccagagtctcatttagaattgcccaaagacaaaagggaagggactcaggagccttgaataaatggggaaattgttccttttcaattcagttgcagaaatatttatttagcaagtaccaagatattctcggaattagattatgcactgagagcctcataatctaatgcgaaaacagacatattattccaaagtataattgcctaaattaataattatagaattgctaaaattttctgaagtgttaattatggaattactaaaagccagcttagatgtaacaaaaaagatctaggaattgtccgatacatttattaatcttatcaaaatactggagatttacaaaatcagagatttttttacttttgggctcaaaaaattgaagttcttcttggacagtgtaattaatcttataattttaggtaggtcactcgaattttgagattaaaactctagaatactttataatagcagtgttttatatttgaatagcactttaaaatttgcaaagtgttatgttttcagatactttacttggtaatataaataggtcaagtactgtcttcacttcctatgtaaggctactgtggctcagaaaatttaaacaagttactctagtttacaaagccagtggagttggaagtcaaacccaagtacttgggtttctaattccaaatcctttctttatgttagagtaagctcaacataatatattcttgaaagcaacttagaaacatacatcattataaggtaaaataaaatttatttatttacttttcttattgctcaccatgtgaagaacctgtgaacagcaagaaactttctttaattccctaaagaaaattatcttataccttgttatgcacctgctattttcagcatttatcctaaaaaatgtggcattggataattaaccaattatatgaattttatttaactgttttgttgttctaattatggggttaaatataattatttttctatagctttgtaaaggaaaacatcataagttaattttcattgtgtatcttggctcttgctgaggaaaatattcaaaataaaagctttgtcttacctaaaaatggaggaggatggcgtcagaatttactgtcatcttaactgatttctaataaggtgtctctgaacatacaggtctcacataattcacagctgcctttggtcttgattttttctttcttttttctttttgaaaactgaatatttttttactttatttaaagcccaatatttggataataaaaaggagacagggacatagaaataagtgtagtaaaaaagccagatatcttcctgtttgctctaagaaacttaatattctgtagcttgtatatagtcatgtaaataaagataaaattagttctgttttttcagtttaagttcaagttgatatttgaaatagcttttaaaaaaaaagttaagtcaaacccaaagaatcctgtaaaccttttactggaaatatttatggctatgatatccttgtccctttttctcatttttttgtgtaattttagccaggacattgatttcattacacaattgaagaatcctgtataattacagcatttaaatgaaatggaaaaagaattttgttactggtatttatctttttttccaaactgagaaggaacaattcttacagtgagaatctgccagccaggtctcagtgttgattataatcgtattttaaaaacataaatgaacgatttttatttaatcattttccaaaggatggattgaagcacaaaatctgttgcacacccagaagacagtgcaagaatggactgggttggggatgtagccaaccatctaattacaccaatagattcacagcacagttgggtcacaaattatgtttctaaatttagaaggtgaatctccaccataaattattgaaaagcactctgtggtactcctctctccatttcccacaaattagattactgaaagctataaagcatctttagaatgtgttttccttgctgtttaaaaatgttcctttatcatcaattagtgccaaccttgacatcagctataaccagaaaacattgaaaccaaaggataaaataaagaagcaaggaaattatttctaaaagaaacagaagaagcttttttacttgctagggagatttaactccttaaaatatttgtgagtttccatctctaaaattttcttgggatagaaatgtaatgacatattacataaatagggtccccagcacattttatttccttgctgatcgtattaggtaaaataattacagctgagctagaacaaattttgataaaataatttcattctaccataaattaagtcatttgcattatttgtccaactttacttttgatttgatttgattggttggttggttgatttttttgagatagagtctttctctgttgcccaggctggagtgcagcagtgtgatctccactcactgcaaactccacctcccgggttcaagtgattctcttgcctcagcctcccaagttactgggacacaggcacatgccaccatgcctggctaatttttgtatttttagttgagatggggtttcaccatgctggccaggctgatctcgaactcttgacctcaggtatccacccacgtcggcctcccaaagtgctgggattacaggtggtagcaaccaagcccagcccacctttagtttttgagcttatatatactcaccactttcattcatatgatttatgaacctgaaaaacagttgatggaagatattagaaaataagattatgtataacattacactaaatttaaggtttggcctctctatttcagttatgattttctctacaccacctctcttcctgtgtctataaaatgggaataacaatccttactgtgtacttacttaaatgggatgattcgcaagttcctcgttcacaagagatttttcaaattgttttttattttctaaattgaatatgcagtgatgtgccatgcagaactctggttccaagttaaaaatgtccaattcaaatagctgcagggtatttattggctcacataaacgatggccctggaagtagaaccagctttatatatagctatactcgggagtcacacatagttttatccaccttcagttttgctacaaattgtgttgtcctcaaactcaggttttctggtatagaaagatggcagtggagctcaagtgcctaccttttctgagaccttagtctagtagatttccattcccaggattccttggagatacttgttgaatctcagagattttgattaactcagcatgtccatttcttaacccttgctaatgagaaagaagagaataaagcttttttcatttcatatcccagaaaatgtgcatgcagttctgctcccatttttcctacagtatttcaagtgaaccactcagtgacaatcccatcaacttatactgccttactcttttaatttaatatgaaatagaactgtcattaactgaaagggaaattgcttcagtgaatatatttgtgaagaaataaaattgcttcagtgaatatatttgtgaagaaataaaattcatgagatattataaatttgatttgccttcaaaattttaatttaacttttaaaattagttacaaaatatagttttaaaaataatctaattattcataaacttttaattgagagtttctttctgattagttgctgtctgcccctgtgcagctgacccattatatttacaaattggttgatctctgcatataggccataatagttttataaactgtaggttataaacgtctgctctaattaattttctttcatatcaactgaatttgatgttgttgaggcattagtgagttttttaaaaatagtttacatagagcttcattttgttgattagtcaaaagtattgttaaactggcttcatggtgtttgaaatcacctattttcaggtgataagactttctaaattgatttttccttgttcctggatgggtcttattctgccagatgggagttagatcacttccattgaaagagagtctgcatgtgttcccagaagcacacacgtgtatgcaaatgcacacactgacactacagagtctggttcgtgtgttctttctcactatctgaggttgtgtatggccatacacgcctcagatggggttggtttttataaaaacgttaaggctgaatcatatttgttgtattgtgacatttgctgccttgccatcaaagagtaggtgcctttgtgctgacaactctttggcattttgccccagggaagtgttgcattatcaaaagagacgctcaccctctcagtgccagggtgctggtaattaaatcgtggatggttgaccagaattcacaggtgaaaatgatgaaaagaatgtattgaaatgaaaacctgaactaggcagcattatatctaatgagcaagaggagagctcttttaggcttggtaacttagatgagcatatgtgaactatggctaatgcttctgatagaaaatggttactaggaaaccataaaaaaccctctaattatgtgacctccaagctataccaataaatatagaattcagatgagtttgtgctaaaaccagtagtaacccactaatattattaatactcttgtagtttgtttccaaaggaagtaagatttattgtccttttaagtactggataacaattcacaaagattgaatttatttaaaagttcatagccaatgctactgtgttttaactgatgaattttggtttccttttgcagtgttctgtatcatggcgaaaggtcacaaaataatatcttgctatcaaaacttttttttgtggcttaactaggcaaaacttcgattaataaatgataagctgtagacctctactcagagtagtaacaaagagagagctggaggtggtggctcttgcttgtcactccaactcccatggagggtccttccttcttcaacctgactttcttatccccacagacctcatgtggaaccttgtaccatgggtgctattctgtggctgctgtaggatcttcccaggtagaaccagaccttatcctttttctttggtttcttgggagtagagctgaacatgagtgggtgacttccttttccaggctattggtcaaagctgcggtcagcaacaacttggccaagatatgcttgacccagttttgccacgggctactgaccaagaggttgctgttcggagttggcatgagtcagagaagcaggttaccagcaggttaccagctgggcaaaactcagatcgattagacatatcttggggtctttttacccctctctactcgtgttataattttttatcttaggcccctgcattccttcctctccttagccacaactgcctgatatctgttacttcctactaagttttaacagataaaccagactgaggttaaaatgctaagaattaactcctcttcccagaaaagtgtaatagaaggatactatagtggagtgggaatttgataggaaagcataaaattatattaaactggtaagtgaaaaaattttctacaaaaatggtgagtaaataaatagcattttggtagtttacatgctcagatgctttatttttctagtttttttttaaagcatttgtcttctggggaagcaattttataacaggtaatgtaagcttcctttgactgactgtaattgactaatggcaaccacagaaaacagcccttagccttcaatttttgctcccttgccagtaaatcgtcctgcctggggtgatgatttaattttcatggtattcaaattacaaattaacatttgcaagtgtagatttgggggattatgctggagcctagtagagttctctaaggatagtgtgtccccttgggctacatcatataacttccttattaaagtgaaaggaaattcccttttggttttcttacagcttttcttcctgtcctcatatttaagaaaggcatccatctattccactttaaatatcaagcttttcttatatcaagtatttcagatagtcagtttgcatactgcttatggatgaagttaagggttttggaaatgttagcctacagatttgcttttttttttttttttcgagacagaggttctgctcatcacccatggctcactggagcctcaaattcctgggcacaggcaatcttcccacctcagcctcttgggtagccgggactacagacatgtactaccacgcaccactgatctttttgactttttgtagagacaggatgtcattgtgttgtccaggctcgtctccaactcctggcctcaagtgatcctcctgcttcagcctcccaaagttatgtttgcttctaataatcatagttgttcatgagtagaaggtataattccagcccatcaccatactgatgataatttatagcattatttgtacttgtgtttgtagtttaacctgtgtggaattatagagaggaaacaaatcttttgacaggggctaagcttggtttcagggcagaataaacaatatttttttcaattatataaaattttgtagaattatggtaaatagcaactgcatttgaggaccaaaattcaaaggtttctgtattttatggaattcgaattcattctattgtattaagagtagattatcctggggccaggtgcagtggttcacgcctgtaatcccagcactttcagaggctgaggcgggtggataacctgaggttgggagttggagaccagcctgaccaatatggagtaaccccatctctactaaaaatacaaaattagcgaggcgtggtggcacatgtctgtaatcaatcccagctactcgggaggctgaggcaggagaatcccttgaacccaggaggtggaggttgcagtgagctgagatcgcgccattgcattccagcctggacaacaagagcaaaactctgtctcaaaaaaaaaaaaaaaaaaaaaaggagtggattatcctgaacccaaatagaaagtatttgaagggaaagactatgttttcctgtaaggtagattgagcagaaaaattattaaaacaacctaatgatctactgtgactaacattttgcaactcaacctatttaataggctctggaaaataagcaatgatttctagagaagagtaaaaaagccagaagaagaaaattaaataagcggcactctttctgtggggaagcctattaaccgtggaaaagaataacaaagttaggcaaaagaagcctacaacaaatcttgcgtatgtgtacgtgtgcatgcgtatacatacatacacacatatatttctctcagacatacgcagacttttcagtcagaaaaaaaaggctaaatgttggaaaccagtacttaattgatttttagaatgcaaacctaaccctttttgacatagattgatcctattacaaaattcataaaatttaaaaataaaaatctgttatgtaatgcttaagtagatattggtaatttgggattaagtttcagttaaaatggtaaagggagaattttagtggaagtgtttattgtaaaattgaatgatactaaaatattttgcttacaatttttttaaaagtccaaaatgcttaaaaagttttggtcatatccaatatttcctaaaatgtttataatattgtaacctggtagtgtgacatttgcccctcattttgttagcagctgtattatgctctctaataatacaatttcttttttattatgtaaatataacactgaaattagtactaggaaaagcaactgcgtgttaaaaaccatcatattttttactggcaaatttggactgaagttgtcactttgtcacttttgtcattgcctacctttatctccagggcagcatctgatcagagatctcccttaattattttaagatcactgtgttactgttagattttttaaataaacatttagatgaaatatttgattaaactgttacactaaaaatgtgtttaaactaatatgactttagtcagtttcctatgatgataatgtagcttacatgtaagggatgcatcttatgtaccagacattcagctagacagctgacatagattatctcatttcatcctcccaaatgtgaggatgagaaaacagaggcctggagaaactgagcagtgtggtcgtgatcactaaattagtaaatggttatgttttgactaagtatttcttgttatcatgtaatactatctatctcctttaaatagttataaaactcagagtttacaacttctggtcttaacattaaaaaaaaatcatctggaaattatgactatcatataaaagtatgttttaaccttcaaataatgatgttataagcaattccatcttcacagtcacccgccagtatttgatctctgataaatgaattgtttgttgcacacagcctcttagcttctttcctttgtctaggcttctggttctcatccactcttcatagaactgttttataaaattactcagacactaggttcacattattactcgattatttttaagaatgctgttaaaagtcaggaacctttatttatttattttcttaattaaaaccctcatacagaaaatgctcaatgaacatattctagttcttaacccccagatgaagaaataaaataatgccagtgcattagaattatagcaagcaagcccccaaccccaaccccaatccaaccttcttccccaaaggtaatctctatcttgatttctatcagtgtttttgtttcattttgcctgtttttatgctgtataaaatatcatgatattgtatatattcttttgtgactggcctttttattcaaacttaagttggtgagattgattcacaatgtcgtttataactttagtttgttgatttttactgctgtataatatctactccatgactgtgaatatatatgacaatttacttaccactttactcttgatgggtgtttaggtgtgtccagttttgatcatgtttaatagtgtttttattattgctgtttttcctatgcatagggaaaactttatatgccattaatatgccataggataacatataaatatagtcaaatttaatactcaatattgaacagttttccagggtgattgtgccaatgtatagtcctactggtactgtatgagagtgctggtcactccaattccttgtccatacttggtgtccacagttttgtaattttagctatgccactgggtatatagtttcagttttaattaaaatttttcttgaagagtcctataactgaaataaattgaactcatccttaacttatttctggatttatttcttacatttgtttaggattttagtctctatgtttacgaatgagattagtttgtaattttcctatcttgaaattctcttattagagttggcgccaagatatacccacataatgagttattcagtattttctcttttctggaagaacgtggtgttatttcttccttaaagttttgcaacagtttactgataaaattgtctgtgcctgcaggtgtgtgtgtggggcaaggggaggttttaaattatgggttagatttgttaaaaattgttttatgactattcaaatactctatttacttatatgtcagttgtgtatgtttggctagtcccttgtatctaaattttccatttttatttttataatggagaatcctattatatttgaagtctcctttaatattcctgcattatttgtttgaatttactgaacctctttgttctgcatattttttctatttaaataatttctgcagttacctttttaaaaaatttccttcagtttaacttttatttctttttctaagttttgaagtggttggttgcttattgattttgttttcctttatatattgaaaactgtagtttttcctctcagcatattatgctttagtttttcccagttttattatcatccaaataaaataattttttgttttccatttgattccctttttgacttatgagtgtaatacttgtcaaacccacagatgttatctgtttattatttattatgaatttctggattaattccactgggggtataggacatactcagattttaatacttggaaatttgttgagactcctctggtcaattatcctcaaggatttgtatgtacttgaagtcatgtgattaagtttttgttgcttgtgtggcatttactgagggaaatatgttaaaatctcccagcatgtctgtttgtctatttgacttttattttaaacatatttcattttcctttgtatctaatagtacttttttatggtgctaatttaactacactggttttcttttggttagtgtttgcatagtatatctctcattcatttcaaactttctatatctttatatttaaaatttcttttaagcagcatgttttagtccagactgaaaatacttgtcttctaaaattgtggtattaattcacttccatttaatatgattacagctacatttggatttcaaactaccatcatattttttagttctgaatggtaggtagtggcttaaaaagttctcaaagtcatctttttcctacttgaatatgttaagtatgtttattttaatatctgcattggatagcacattatttgtattacctgtaggttcatctgtgtcatcttgatttttgtcagattgtcttgtctcttcacatgcctagtcattttttaattgcatgtcagatgttctatgttaaaattctcagaaacaatgtgaggcctagtatgttgtttgaaattaacaagtcatttttcaaatgacagggagcattgctatacagtattgctatactggatcaatttaatcaaaattctgggattgaaatgattcaagtgtggtcttttatgttatctaggaatattttatgcttccttttatttctgtgttataacaccttggagtctcaatcctacatagagtgttttgatataaccccctctttggtgagttctggacttcaatttatgtcctctaagatttagtagattgtcaaacctttgtttagcctctcagctaccttttctgaaatcactaaactttccaagggtcaatgtgataccaaattttaggcttactcctctgaattccttcttatcctgtatcttatccctttaatactttcttgtatgtttgggatattttgggcacttaggatctttagcttgatgtctttcatcagttttagttgcctttaaaaatatttgtagagcttttttagttctttctacaagtgttgattctttttacctgatacgccattatatgaagtacaatttcctcttttaacaaactctaaaattttttttagtttcttgaagttctttgctttatgttggttaattttatattgcttctccttgtatagatgcaacatagtcttgtatatttctaaagattcccattatttttaaattgcttataggttcttttatttcttgaattatctgtatttcatctattattgatttccctcctgtttattttgatattgctttttatgttgcttactttccccacaaagtccttcactgtgatccttcattatatattcattattaagaaagaggaaatacattagagagtctgatttctgtggaggtgggtggggtttgtgaattttgcagctttcatttataattttttaaagagcagaatgtaaacaatacaaatgcactctcttttttctgggctgctagtttctgctgagtgggaataggagcaggatctactcttttggaatcagaatctgaataactcttcatacattcagatctgagtattagccgttgccttttcattccttgattttttttgagactaaagtctgtattcttctgtctttatttctttcccaaagtacaataatttatagctgtgtctgatcttcttaatcagttactaagcttctacccctttccacttctatcttttgtaaatttgttaaaaatcccttatccagtgatggactctctttctttttctaatgtggagatatatctatttagatgttatattaattttctgttgctgccatcaggaactaacataaatttagcaggttaaaacaacacaatttattattttacagttttgtgatctggaaattcagtaaggatctcaccagactaaaatcaaagtattagtggggcacattggctatgttctttgctggaggctataagggagaaatcagcttgttgctcatgcaagttggtggcagcattcaattctttgtctaagaatgagctactgtgttcttaacgatgaccactcgcagcttcttgaggttactcaccttccttgtcccgtgacctctatttcttttatgtatttatttatttagagacagggtttcactctcttgcccaggctagagtgcagtggcgtgatttcagctcagtgcaacctctgcctcccaggctcaagccatcctcctgcctcagtctcccaagtagctgggattacaagcatgcaccaccacacctggctaatttttgtatttttaatggagatgagttttgctgtgttgcccaggctggtttcaaactccttaactcaagtgatctgtccacctgggcctcccaaagttctaggattacaggcatgagccactgtgcctggccacagccctttttctttatcttcaaagccagtaatattgggtagacgtcctctcgtacttcaaattgcttctgtctctttatcattgtacatctctgaccgactcctctgacttcctctcctacttttaaggacaatgtgattaccttgggctcacccaaataatccaggataatctcctattttaaatttagctaattaaagcattaattccatctgcaatcttaattcccttttgccatgtagtgtaacacattcaacgaagtaagactaggggggtgaaaatcatgtggtcaaaaattctgcctgccacaatctgtggtctgcccactgccatgcactgaatgctccttcttacctttctgaagatcgtctgtctgtttcagggaaaccttattcttctcaatctccttatttctaccatttataatttccctccctcttttataaaatatctattcattcttatgcttgactattttctctttctctaagcactcttattttttcaaagagcttcaattactgtctatacaccagtgactttcaaatctgttatctgcccacaagacccatctgtaaaactacctacttggcattcctgtttggatgtttcacagtcaaataaactttaataaggccaaaatatctcaccgtcttcttccctactcacacattccaaacttactgatctttcctctttgttctctgtcagttaatggactcacattcccagtcagttatacagaccagaaatgtggtaatcatgtttgatatttccctctccctcataccctacctctatcagtcattgacctattaatgcttcctatcaactatcctttgaatgtttccagtttatctcactatcatatatactggtctccatctcactccaggcctctgctgctttctctgcctgaaacaactcttgttgtttttcctgctttcttgcctaagttatacttatcttttagacctctgataaatgtcactttcttggaaaagctctccacaaatcccagggctgtcataaaattctatacttgccatttatattaccgtaactataaatgattgataaattatgtaacttcataaaataaacattttattgttgaaaattttagatttacagaaaagttgccaagatattacagtccccatatattactcattctttttgccttatgtgttgttaatatctcatatcactatattacgtttattacaaccagagaacccacgttggcacattactgttgcccaaactccacagtttatttggattttaatagttttccccttgtgtcctcttcctgttccggtattccatctggtatacaatattgcatttggccatcatatatatccttgccttcctctggtccatgccattttctcagactttgtttttgaggaccttgaaaatcttgagtagtactactcagatattttataaaattccatctgttgggttatatctgtttttttcttcatggttagacttaggttataggtgttcagagaaagatcatggaggtgaagtacctttccctcaaatgatgcagagggtacatatcaatatgacttatcgctggtgatgtgaactttgaccacttggctgaggtaatgtttgctagacttctttaaagttacttttttctccctttttatactccactctttagaagcaagtcactaagcacaactcataaacaagggggtgaaatttaaactcctccttgagaagagggtatctacataaatcatttagaattcttctgtatgggagatttatctcttctccatttatttatttaaccacttacttagatcagtgtggacacatggatatttattttattctttgtgttacaattcaatactactttattttgttgctcaaattgttatagctttaaccattggaaggtgtaattttttttttttaagagaggggtcctgctgtgttgcccaggctggaatgcagtggctattcattcacaagtgtgatcatagtgtaatacagccttgaactcctgggctcaagtgaatctccttcctcagtctccctagtggctagactacaggcacgtgtctcttggcccagcttaattttttaaatgtctcttttcctggatagaatgtaaactacatgagtatgggcttcaggtcttctaaaattttagtgagaagcctggcacctggtaaaaatcaatttgtattttgtgcaaaaataaattcatgaatgaatgggatctgtaaagatgagaaagtatcattgtgcttatttaatgttgaatgattcctgtgttgtcttccatttctaagtgccagatatttctttatattctctgagcctccagactgtggtataagtacaaaccaagagacacaaaaatcaatttaaaagataaatctctgtattgtcagccttgagtttagatggatgacatcattgttaccttggtcatctgtctcacttcagacttttattcatgcatcttactcatcctgccatttctctaagtcttataatcacctactctacattgattcagacccacatctaattgtggtggcctctgggttttcccacagatagccaccaggtttttatgatttctagttttactccattggccagtgtgactaaatcaaacctgtgggaaggagctaagatttttttattgtggacctatgtatgtgtatgtgattttttaaaacttttggctgtgtgctgaaagaagaattgtgttaacttatttttaatattctgctactttccctttgggaaagaaaagtacattttcatggtcaaatatgggaactttatattattattcaccatcaattatagatctcataaatcaaaaagcagtattaaatgtcatatttgtaaatgctatttctgggaaataccagatctagtgttattttgggaaactgtgggttgaccttgcaaaactcacattaacgagaaaaaaaagcacattttaaatggtgacacatctaacagggagcttaacagagcaagagaaagtgtgtaggtgttcagtagtaacaacctaatggtaccacattgtatttcatgaatgggagcaattcacaaagttcccacaaataggacctcatgcaagaacacaactgtatagtggttttctctatccttattctatcaacattttatgagtccctactaagtagcagggaggatcctagttattgtgaaaataaaaatgagtgagttacaattccttcctgcatgtagctcagcttagcaggggaactcagatcttataggtaaatcattcatattatatattatagaaacaacgaatcataggttagatcaaccaggagagtaaaatcatgtcacccagcttgacgcccagatgtgttttcttgcatttaataagccagtagcagagaggaatataaggagctatgtcagaaacttaatggaggtgatctctgtgcatagcttattaataacgattttccaaatgttccatagtttctaagacaagtatatatatttttttaatttaagaaacagggccaggcatggtggctctcacttgtaattccagtgctttgggtggccaaggtaggaggaccccttgaggccaggagttcgagaccctgtctttaccaaataaataaataagccaggtgtggtggtgcatgcctgtagttctagctactcaggaggctcaggcaggaggatcagttgagcccacaagtttgaggctgcagtgagctatggttgcaccactgtactccaacctgggtgacagagggagacccccaactcttaaaaaaaaaaagaagccaaaccaaaaagccagttgttttaagctactataatctctaatttgtaacgataatttcagtatttccttgtgtttatttccatacgcttagccacttgtggagttttctttttgatggtattaaaataaaattctttcttttaaatcattaaaatgcagaggtaaaagaatctttcactacagacattagacagcctatgtgagaatctcttaaggcaggagttggcaaacgttttctataaagagccagatagcagtaaatattttgggctttgcaggctatatggcctctgctacaaggatttctctgctttttagcaggaaaaaaaccatagataatatgtaaataaatgggcgtggccatattccagtaatacattatttagaagaataggcggaaggttgaatttgccatagtttgccccacccctgacttggaggattcattaaaaatgcaaagaccaagttcttacaccttcctgaattagatttcagagagataagcctttggaatctgtgtgcttaaccagttgcatatattattaatattattattattacttatactcaagtttgtgaactttcattttatttatatactaggatatctgagtcctgaatttgtctctacagtattgctaggggatttttcatttagcttgaatagttactttgaacttttttttttattttgaactatatttatggagtacacctttatcagatggaacctctgtttcaaataattgaccgagaaaatatgaagggtaagtttctgttgagttaaagttcaaaaatggaaatgctgaaagaacaaggacctttttcctcctctttattgctatatttctagcacttggaactataaccggcacagggcaggtgttttgagaaatatttgtgtaatgaatgaatacacatttgtattacttcactctcggcatacagtgatggcctgaatccaaatggctgcactgtccctgtatttgatatctgggtaatcaagtcctagccatagcctttctgcttttacacaataccttttagtttttatccaatattccacctgtttgcattaattttggggttatgaatgctgcccttaattgtgctgtttcaacattcatggttccaaagcaacatctataagtatgaatgattatattagctaaggatcttttgactataatcaatgaaaatccatatggtcaacttaaacaaaaaaggtatctattaggaaaatgggttaggtgaaagctcagtatcaggggcctgctgaacttctctctggaatgctacccaacataactcagctcctaaccttatcctaactccaggcctgtgcacatgctgttctgtgtgccagtttttaattctgagagattgggattggcccagctaagggcaagtgcctgttgtttggtttaatttcttggctggtgggtcagggggaccattatgtaaccatccttgtggagagaaaatcagagattactaccagaaggatgtgggagaagagatgagagatgctaggaagatgcaactagtttagatatgttgattttggtgcctttaagaaaaaaaaaactttgcaaataactatttgtgctctgatttgccaaagccctgttttaaattctgctattaatgcaaaccaggctgcagacctctgaggtccatgctgattcttctctccaggcctctggtctgctgtgaacagggctgttctctaattgttacagacttcctctaaacctgaagatttgatttggagccttgctttagctgcctttagctggaagatttgattttgagtcctgtttttgcttttagattatatttatttataatatctatccctctctacttccaagaaaagattgttaattccagatttaaaatcaaattccatgctaagaaatgacacagatcatcttcagactgctccctgtaatctactcatctctggttctgtccttgattagctgccacccaaacagagtggcccagcatggtcctaaatccaagccataggataaggatcctagaaagagaatggagttctttcccaatttatgtccccatctcccacatgcgcaacccccggaagctcagtctttgttcctttattgcagtctgcaactactgacaggttctgactgctgtctactccaaaagcatcatgtatacttctccccactgctttttgtgatacagttccactggcctgctttctgttacagacacacagaagtctattccctctgcgtgaagcgggccttccttacgtatttacaagaccggctccttcatgtttttcagatctcaggtcaagtgtctccaacttagcaagagatgccttctcaaccaccctttctaaatacatagagcatgcctcctgagtcactctgtatccccttaccctgttttattttaatgttgcaatgatccctatgtagaatgtcacttctttgtatacttgtttatcgctttgttttcctgctagagtgtatgccccaggagggcagagatcttgtctctggtttatcccagttgtttagaacagcacctgatgtactgggtgttcacttgtaaaaatgaatgaattaaggccacttagcaatttctaaatcacctttgatatacaacaatccatatgcacagcaatccagatagactcacctgtctgggatatgtcaaagccacggagaagaaaactcagcaatcagcatttttcagactgtggggagctgagatcactggccttgctgaatctctggtcccagaaacaaatacagacagggatcgccagcattacttaacacccattcaaaaaaaggcattggggatttgcagcaacttttatacccatgttcttttgtcacccttctcagtatctgtatcagcatgtttgtagggttcagcagagaattttgtcaggttaggaagaagtaacatatggtagttgtgatgaaaccttagcaccaggcatgcctctaacattaactcagaggacttgttttcgattctttcttttatgaaacccagcctttctattttctgctaaatcaacagttcctatatacacatcagctttacaagtctctaggagacaatatttcttttccactaatatgtgtattcacagcccaggtgcacatgtgcatggatgcacagacaagggactgcattttaagaagttttggcagaagccaagccatagcataactcattaagacaacctatgacaatataagaagagattattttggaaattcttaaggtaaagataaaagacaaaacatacatcgagtggtctttagcaaccctgagttctttcctcagtagctcttcttggatagcacacttaagttttcatatcaaatagtaatacagctcacctctcactgactagagccttgttatgttttccgtaaagcttcatgctgatggatcaacctgttggtgaaatggtgttaaatggtcttaaaatagttcagaaatcaaacccttcaaatctttgggtaaagtctaagaggagcattatattagctgtacagtaaataatgctataaaaagactcttgtatgagttaatggtgttccacacacatcacttagggtgcaggaatgaaacaacttgttcttaacttgccaagcccttgtacttttcagcttcttatctatgttcttggaaatcatcaaagaagaaatggaggaaggggatagcatggtaacatttctctgaggaaggctatttctttccgtccaatgctgattgtgagccttggtaatctctctcaacttttctatgtgcatacatatatgcattttatggaagctaaattaaattacatttaaaaacaacaatgtggcaaaatgttaataatgggtgaatctatgtagagggtatatggagttcttagtactattcttgtacctatactgtaagtttttagttgtctagaaaaatgtttaacaaaatatcagcagcatccaaggtggtcacacttgtgcttttgcatgtcaggtatccatctatagctgcccctgtggcatgtgttttttcctgctcgactctagccacaataatcactagggtaggctgagctgaactgatgaaatcagatatccagggaaacaaagcaatcaaattttaatatatttctttatttgtacatattttattatctttgaactatagttttttcctttgggggagtaaggcaggtttattaccaaattttaagaagattttatgttctcagagcatttaaagcatgtttgaaatagataatgattattttatgtgtttatcttgagctgagattcatattctatggtttcagggtattagtgaactacttcttaataaacacagcatcaaacctgaaagtcagagacacaaaaacagtgaaatttaaaaccgtctccatagcaagaatctggaaaatctagaggagaaaaagtgaatgaataaggtagtatggaaggaagaaagagaggagaggagaagggtggaaaggggaggggagcaaaaagcaagaaagaaaggaaagaaggaatggtcaaaaggaaagagaaatctataaagacaccttgtatggatgttgctgatgtcacttattgggaagcataaaatgtaattgaaagatagtcacagtaagtgttaatagaattttaaactaaagttcattataggctgtggatttaccctgtgggttttgtggcagctcaggcttcaagcaaggcctgctgtagtgtcatggtcaggaggaatcctttgcctaacagagctcggaaggatcttgtggtggtcagtgaccagaccttgatcttttcacccagggaatccactgccttagtaacaaatctctgcaaatgggacaagagccatggactcttctgacccctgatcccacacaaagtgccatgtcaccaaatattctgtttcttgaactagtagggaattgttctgtgtataaagtgattaagttaaattctttgagtcacatttttacagagatttaagagttaattttatagagggtgccaagcttcttagaagcaagaatatggataaatatttttggttaccatttcccctgtcccgggagatatcttgctatcattatcagaaattacttttattattgtagaaagaagttcattctgtagccccaaacaaggcaaaggtggcaattggacaataaatcagtactttgtcaacatggagatgcatttttttctaattttactaacactgtagccagtcactatgccgccccagcccatgcagctgcataattatacatcagatctccaaaatgaattagtttatttttaaaacagctaattgccttagtggagtcatgttttaccagaagcacaaaagggctttgttcactgcagggaaattttcttctggaatgactgtgttaggctctagcttctgtaaatgtcagtcataaacagcaaaatatcagcaaaatccactaaaatcactaataatccagaacatctcaatgcgacttcagcattatttgctctgcatgtagctctatgtgattttaagattaaaatggcatagttaggtatgttctgtggtacaaccatatgtgactttttatgtgtgctttctgtagcccagtttagatatgtctcttgaaacccaactatgtgtttataaggcagacctcttattgcatgtttggtctccattagggatgacaagccaatttttggaaatcaagactcctctctattatagtcttaaacttcaatttttacattttgtttttggatgctattatatttaaatagaaatagcaggtgtaatgtttatgctatgttactctgcagggatagtgggctcagaaaacactgattaaggataagttcccacagtgtggcatcaccttgacaaattcacatcagtaatgcccacaaagactagtagattcaatcctaatgacaaatgaatactcacaataaaaagtatttccccaagggacaatatcctcatgacttaatgaccaacaagttgtaagaaaccagattataattagatgtatcatggcagaatattgactcaaacccatacttattagttacatggtttgagtgtttaatagcatgaggctaagacggctgactagatctgcctctaggggacttaaatgtggcaggaccatcacagacagcctcagatgtgaccccaaacccaacatgacgtaagtttctggactttctctttaaactttaaggcctgaagcattagtatttcagacttcataatgtataagaaaaaagccaaatgattatcatacagttaattttaaaagtccaattaaatatcttatttcttcccttaatatttctccctagaaggcaataaacttatctgtatatctctgtttcaattttttcttcgttctctgtccacacaggtcccaaatagattttattattttgaacaactaagttctggctccagttttgtattcctacctagaaaagcaaagcctgcagttagctaaaccctttctattgtttgcaaagttctgctttttaagtttgccccctggaggtctcatgttccatgccaaataggttttcaaagtatttacctaataattcctaggaaaacattctgctcctaagaaaaataatacttaccacttacaaatataggaattcacatgcctttggtactgaacaccctctcctcaaagtagactttaggtgggcattgacaatgttcaccttgacaatgttcacctttgtgctctgcattttctctgactccaaagctaacacataccccttctgatgaatccttcattaaacagattaaagtaattaattatattatagtcaactatgactaatctgcaatctactatatattttctaatttgagttagctcccccaaaacatgaatattaggacaataataatagcctttgagaccttacttggtccccactaagtcacagtttaatccagcgtgtcttaatttctaagcaaaggctgacaaacagggtgatcagttatgtgtgcgtgcgtgcgtgcatgcgtgtgtgtgtgtgtgaaacaaatacacacaggtgtatttatttcaggaaccaaaagactgcatttacaaaatatatttgagatggagatagttattaaattaaggccaaattgtttccatatggtgaaaatacttctttactagtaaaagatatttttataatttaagaggtttaagatggtttcaaaattcatttctcatcacatttccagcattcatgagcctttgaaacttaaagccagagaggagcttatcatttgacaaattacataagagttccagaatttaatgttatgtcgattcttaaaattggccattattcacaaattatatttatcacatgcgttcatgaaaatcaagagaactttagaataattatatatattcctttatctaatgttaacgactcacagcctgtaactaccatctgccctttctgccaatggtgtatttattaatatattttaataacaattctaatagttttcattttagcttaaaatgtgtttgcctaccacaactatacctgcatttttctatgcttgcttttcacactagaaaacaaagaccagtcaatactttaattgcccaagggttgtaaacagacatgaatgattccttaaagcaccaatcacctttaggaaaaaacaaacaaacaaaaaaaactttttttttttttgagatggagtcttgctctgtcgcccaggctggagtgcagtggcaggatctgggctcactgcaagctccgcctcccgggttcacgccgttttcctgcctcagcctcccgagtagctgggactacaggcgcccgccaccatgccccggtaatattttgtatttttagtagagatggggtttcaccgtgttagccaggatggtcttgatctcctgacctcgggatccgcctgcctcggcctcccaaagtgctgggattacaggcgtgagccgccacgccgggccaaaatactgtacttttaagtgcagtttatgcattttctaattctgtgctgcactctcaggatgatgggctgcgcattattagctcattccttttatgttatattacttagtttgaaaatcaacttttatttcagatgccatagtaatttctcactgttgataacagaattacaatgagaaaaccttgaaaagaatacatttagtttaaattaaatagaaaagaaaagaggaagataaatttagccaagattcaatttaggattgtaccagaatatttagttcccttacaaaatacaaagtattgctacttcaaatgaaaatttcttgagaaactctagccctcattaaatgaaatgtttgtaacaaaataaactttcactatcaatgtatcagagtccttattactcagcattcttaccaatacttggtattgttagactcaatttttgtctgtctgctgggtttaaaatggtgtctcattttggcttaattttcaattttctgattactaatgtgctgtaacatatttcatatgtggattggacattagagtttcttttccatcacttgcctattttcttttgccaactttattattgggttgtcttttcttattttttaaccattattaatatatattctgaatactcatttttgattcattaaattcactgtaaacgttttctctcaatctgtcattaatacatttccctttttaaaagtgtctttgcacaaaattatattattatatcatgtttatcaatctttttctttatgatttgtgttcttttatgtctcatttaaatcaattctttacctgagaatttaaatgtattctttgacattttttcttgtaaaacttttcaagtttgctttttgtatatatgtttaatctacttggaattgattttctgagtgggagtgtacatgtatatgtgtatgtgtagtttgatacaaaaaataagagtttaacatagagtagcaattatcttagcaccagttattgaaaatcttcccttctctgtagtgctagtattgatatatgtaaagcttccacatatgtgggacaatattccacatatgtgggcctaattgtcgttggtctattctgttctcttacctagttgtctatatttgaaccaataatgtattctcttttgtatagcttaacaaataactcctgaaatctgataaggcacataccctcattttaagttccttcaaaattatgacttttcttggaattttgctatttcatgtaaatatagaagtagcttgtcaagttaagaataatattaacactaaatattgatttttttctatccatggacaaaatgtatctccctatttttttctttattgtcctttatctattacttcttcaattcaggacactttacttagtttaactatcgctcaagactattttattaacattattttaatattatgtaatatggtaatggtttattatattacataatattgaagtgtgagagtaggcctgtgtgtgccaacactcagttatcctagattgcaatgctaagagaggtctaaaatctgctaattttagcttttcttctttctcctttattttataaattccactctgtcttttttttttttttttttctggaagattgcctgtttctagcagaaccttttcctcctttctatttttttttccctagtctgctgccaacgaactttttagaatttttttctgagataaaagtaaatttattttgagtatgaggtttacaacatactaattaattagctactagttgttgattaaatactgtgcaccagtgtttgtattagacattctaggttttcccagcaacactactattagggatagatggtaatcaccagtacatagataaaaccgaggataacatgccccagattatgaaattagagtgctgtgtggtcaagattgagtccgaatctatgttttttctcctagcaccaccctgcctctaacacataacaatattttaacactgaagtgtaatcagagacaatgtgctgtacaattctaaaaccagacaacctgattctgaggcaggatgggcacccttccctaactttggggccatagagcaactgctgtgccagaaagtttgtagggagggagagtggttaggtaagtagaagagacagagatacctgggggatagagctgcaggaggctttcaaaggtggttgtagtgagctgaataaagcatttccagtaggtcagagctgcagattgaggaaaggaaatagagttttaagatatttagtctgttctgctgcaacacgtgtttctataacaaaaattaaatgtgattggtacataggtgataatgagtataaagtgatgttggttcttaagtgatttttttctagtcatggggaaccagaagagtagaaatacaataataacttttagtaataaatgggaaagaaaaagccatcaactgggctgctacattgccaacaggaatcatttggagtatgtttaagaaattaaaaactagtatctgcatccagtgagttgcttatctcagttcctcgtgcccaaacttgttatgctgtaggctcatggcaggggacatttcctccaagcccacctaggctgcagccctgcagcagagctccagttctcccagcagtgcctcagtccccatcaccccgcttcactgtcctctctattgttttgtgcatttgtccatccactgtggcggcttctggccaagctgagctgctggttttttggagagggcaatccaacttttatccccacttaacaactgtaaatatcagtaataataataatattatatgataatgatagtgatgatggacatggtggtataattaccaaataacataggctttgaacagtttgcttataatcccatcatctcataaacttgttatttagagtacatatttaacagaatatgaattttctctggaacgcaattattgtgttattgctgcatacgtgtactgttacaggtctaatgtttccttcgtggtgttcaaaaattacaaataatggaccttacttacttagatattacttttgggttactcaaatggatattaactacaacaccactataaactgctgaacactatgggttatggttataagggttatacttggttctgtttactttgagtaccagggtatttttgtcttcagtagtcagattgtgtcaccccagtatccattataatacctaggaaatttattttcattctaggctttgaaaagatgataaaatgatgtaatgtgagttaatcaactgcagaatggcttactttcctatatagttaaagcaaaattatacatgacaaatgatgagttgtgatatgaatcttcagttcacccctcactgtggatctagtgtatacctttagcatatggagctaagtccaggctagattacttgccttgtgtagtctgaatgcttgaggttcagttctggatgggccacagtattgcatgaagacttttgtctggttgttacttcctcatgtccagatccttgtaattatttgcagaaaaatcattattagctgtgtctgtaatggcctgtgggtgactttatgtgccaagtcttcactaccagcattttcaaagggcttggtttccttccaagccattcatcaattgcctatcgccacatcatatatgccttgaggcatgatcattcagtcaggagcctctgtaactctgagtgtgctctgcactttctctgcaaaattaaggtgatggaaaagatcatattctgcttgttctggcaagaagggaagaggtctgaactgaaaacaggggcacaaccatggaccctcatgtgccctgtcacactgttaaagagtatccctggctgctgagcatagtggtgtgtacctgcaatttcagctgcttgagaggttgagacaggagaatcacttcagcctaggagtttgagaccagcctgggcaacatagtaagacctggactcaccaaaaaaaaaaaaaaaaaaaaaaaaaaaaaaaaaaaaattctccttggctgccacgtctcagggattttttttaaaaactattttccccttatgtggatattgtttgtatttttgtcttgatctcagttatcttccagcaataaatacttgagatgttattagagttatcaaatcttacaaatgattattacagaaggatagaaaattgtattgaaggattaaaacataaattaagaagaaaagtaactgagcaatgcccttatttattttttttcttagagaagcatcacacatttttaagacatttttttggaatcacagagcataacttttcttcctgggccatcgaatcaaagcattaccaagggagcattaacagctaggtgtgcctggctctacagctcatgggtgtcctgtccagtggcttgctgccctctctggtcatgcccactttgtgtgaacactgaaggcccttcttcccaggagccattggaagaactaacacttgtcaaagcaaatcatatttgttatctaaatatgaggaaacccttaaaaacagaacaaagtctaacgcattactctataagacagatttttttgaagtactgctctgaagtgtgactttttccactgctatattaagaattagcaaaagaaaaagatggtgaattatgcattatatagtatatgcattatatacagtaaattacgctttatatactacaaagaaagaagagagatgcagaaaataatatggaagctaatggataagaaatatgtgcttaagttggggcaagaaagtcaacttttgatttctgtgaaagaaaacaaaggcttcaatgagtattatgtaaatgggtgtctcaagaacaggtaatgattgctgaaatgagggagatatcatcttaagcaactagaaaggacatgtgcgaaagcattgatatacagacaggatacagtgattttgaagaacctaagtaaagatgagagcaaggttttcagaaaaagcagaataaaggaaaataaacccacagcagtgaattggaagaactttgaccagtaatctgtttgatagtggatgtgttttgaggattatttatgacctgtatcagtaggcattgttgttatgatcataggaaaatcctgggaaagagggtttttggaatgaagggtggccatgttgtctaatgtgtcttcttacccaggtcgccctatgttaagaagcttaattctagaaaattttaaattgcttctggatacacataagaacttctggcagaatttttctcatctggaaataaagtcatttaaaatttttacaaatcaagttctttctgttttttcatttatctcaaattttctaaaactgatgctacattggcaattctgttaaagttcaaaattaacaaattttattaccagaaaggcttatatcatgactgtctaaacattgtgttattggcacagattcaaaattcaaaattttgagtattattttaatctttctgttttctatcaactgatttgaatcacatacatttaaatgtctgaaggccaatatattctactatgtaatgatctacacagttttgagatgttacaataattcatgattcatttgaaagtgtaaaaaagggtactttagttttaccctaatggctaaatatttaaaatactgttatggggctgggcatggtggccactgtaagcccagcactttgggaggctgaggtgggaggattgcttgagccaaggagttcaagcctaggcaacaaagcaagaccttatctctcaaaaaaaaaaaaaaaaaaaaaattagccagtcatggtggtgtgtgcctgtagtcccagcgcttgaggggagaggatcccttgagcccaggaggttgagtttgcagtgagctatgattacactactgcactacacctgggtgacagagcaagatcctattaaaaaaaaaaaaagtaaatgtctataggtattgaaatacaaaggtagccccattatcatagaacttgataatcatgggttctcatttcttaacccccatattggtttaagtttttttgttcatgtaatgctataagcatgttttgagtgaagtgcatattttaaatgaaatcaaatgcctgaagtttttgaatattatgtctgctgagtgttttctccctagcttttgaaggggatagcattaacttatgtttgtggattccctgttaattagcccttagaaccatttagctcctagattttagtttcgtttaactaggcctcggtttttgaagtcaacacataattattcctaattgaaataatgaaaaagtattaaccaggcatggtgatgcatgcctatgtctcagctactctgaaatcacgtgagaagattgcttgagcctaggagtttgaggctttagtaaactatgattatgctattgcatggcagtctggatgacagagcaagaccccacctgtaaaaaaaaaaaaaaggaaaacgtaaaaaattttagttcatctagggttttgaatttaaaataactaaacttgggttccaaagggtcccttctgcttataagcaagtaccattgagaatttccttcagacatagccaaaataagacaacagtccctgcttcattacaaaaaacagattgttacagcttcaggtgaaataactaatgttagctgattgattcttaaatagactgtccctgccatctggagagaaaacattagttggggggaacacattgtttactgaagatattcctaggttcgaattaaatgacaaacacaggcgtaattcattgtacctaatgaaggctctgtatttcatgtgagtgttgttatcaagcttcgtttctcatattaaaatgtcagatttggctttataaaaagaatatagcaaatagcccagcatattccaccaccttcttgttcattatttccatatcttatttggcagttaggaatcattgaatcattgaatatgaatggtttgtttagcagcctacagagtgatattcatatgatgaaaatttccattctaacttttcatatttaatttatatatatttattatatatatttattttttctttaagaaacaaagcagactaatgatttttatgttctgttttatgatgtttatagctgatgttagttcggcaatacagaactcaattatcttagttcagaatacagaattctaagtagtccttcaatcatttagttctaatttatgtattaatattatattataatcataatgactactgtatattgagtgctattatgttatcataatgctaggaactttatatttactgtttctaaatattgaagctatactgaaaggcagatgttaatatccccatttataacatgagagaattgtgactcagaaaggctaagtaacgtatccaagttgtacagtcctgcataataagtggcagagacaaaattcatatcaaattctgtcttaatccaggcctcttatccatacaataagccacattatttgaaatgttattgtcttagtctgttttgtgttgctgtaatagaataccacagactgggcaatttataaagaaaagaaatttatttacagttctggaggctgggaaatccaagagcatggtaagggcatcttgtgtggccttcttatttcatcatcccgtggtggaaggcagaagggcaagagagcatgagaaagcaagagatggctagatttgcttttataacaaacccatttatgataatgacattaatccattcctgaaggacctaatcacctcctaaaggtctcacttctcaacactgttgcattgggaattaagtttccaacatatgaactttgatggcaaactataccagttatatagttctgtttcataaaaaagagatgccattattctcatgaatcaaatttaaattaatatctgaagccaaagtttccacattttccagaatatatctctctgatctagaaagtatatgatcataaggcccttccttcaaaaggcttagaccatgtaggatctctttaaagctgaaaagacagccttcaactcgatgacaatgtaaggtggaacttctttttattagagctttgatgttctcagagtgtctcatcaatgtgttctgtagaaaaactgtaatagaagccagtatggccgttagacagaaccagggagacccttaagagcatagaaacaattgttaaaattattttcagtaaacatagtttcagtatagaaatggaaatgttttaagtaaattctctggaatcttgaatatctaattcctgtgtttaattataggaaaataaagcataatataatttataatctccatgttttatattgataatatgaaacatgtttgggtataatttcgtccagaaaaaatattagatttgggaagggtggtaggtagaatggggaatgataatgcagaagatggtcaaaattgtgtgcctgacatttatttgtgaaaataagtatgaatggaagtgtttagttatcaaatgttttatctacatttctgtagattcatatgtatctattcaaccaacatgtggctttgccaaggagatcatctttggagagtgttttgggggatgaaaaggatttactgcttttagctccagagaatatggtgcaccagcaagggcttctatctcccttctgtgagctcaccaaatgcagagacttttatattggatataaggaaaaagatacagaagtaggctgcttataaaagagagtgatgcctaaaataaaggcattgaaaagttgaaaataaagggaaagaaaaatatctaccaggcaaatgtgaataaaaagaaagtctgttgtagtaatcttgaggcaaaagtcatcataagggacaaagaaggacattatatactggtaaaatgaaaaagaatttcccaaatgaaaaagagtgaatacaagaacatcatgttcagagacatggaaaaatgaaaaatttgggtaatatccaggaattgtgtctgttgcatgatgtttgcaaaagaaagttaggggttgaactcctaggtcaggtggttgtcaaaacttgaatggccttagagtgtgtttgcctctgttcttggcactgaaataagagaagtcctgaagtagagaagattccataaccataggatgtataatataaacttagtgatatggccagttgtaaatgtttgtatttagttatatgccattgctataaatacttttgatctgttgaaacataagtaaaatatgttttaggtacttgctatttcttaaattcaatagttcacacccaattagatcgaattatgaagtcagaattgaattgcaacattaaccaaaagttgttgctattttcagaggctagctttctagaatcctcttgatttaaattggttatagatcatggtgtggtatgccacgtatcaacttgacttttgtagcaagaaatgatgtaaaaagctctgggttgacttttggtatctgctacaattatgttagcaagtagtaacttagtcttgtcacagctctcaaatgtggtatatattcagatgctacacatgacagaatttttggtgttcagaatttccaagttgataaatattaaatgtgcagctacataagaagcagacttattttgtggaataaaataaacttttgattcataccaagtagtgaagatcagaatgctaatccttaactggacttctagaatttttttattttcatagtcctgtagctaaaaatagtcttttcttgaaacagagctttccattaagtttctgatcctgtgaacaccttgtatgtacatagcttagtcaacataggatgggttagtcagtgttaacttgcatttcaaagtagacactgttaaataaagaaaatagtgcttcattattcagcatgaaccattacgtgtcacttaaaggaaaagcaaggttttctagttgatatgtactgatacattcaggcatatgtagtacatatactaatgcaaaatgatgttaagttgcttagttatcttatatgaaacattagttttagggtcacagaaatgctgtttatacgaagtataaaaattgtgttataagtttctgtagtgacctttgaagggaggcaaagttgggtctgaagctgtaatatatttcttctagaattttgagcgcaaatggtgtattcagtgaaattcatgagttaaagatagagcatgaagacattagccaatgcagcttataaccagagttttctggaagctctgtcatgactacaaggttactagtagtacaaggttcattactgtaaagcagagttacaaacacatttttatattttcttagtgctgatatctgctataaatgcctcacaagaaagatattttaatactttgttcattcaaattgtactagataatgatggtcacattgagatcatttatgctacagtctgatgccaagtctttttcactggttggtctatgttgtgggacaagaacaaggcaaaggaaatgcaaaaagtgaaagtgcaattaaactgcacttgctttcaatgagattctttattcagttatatacttagcttttaattatggtttatttttgttattaaattaatattttaataagaaactatataaaatgaataacaatgaaatattagaggttgaatagtatgttagtgatttactcaagatcagtagtcacttaataggttcatctgaagaaggaatcatttattcattgcagaaatatttattgagtgacatactatgtgccagacattatgctaagctctggtaatacaggagaaagcaaaatgaactattttttcaagttgatgcatgaaactttttataactctgagtaaataattcaacatttaatcaattatataactttctttagaatttatacagtttcttagaaaaacaaatgagtaacagcttttcaacattttaataatcatgaattaaaggtccataggaggatatttttaataatcagttatagtaatattagctagtatttattgaatacctatttgccaggtattgtataattctctatcatccttataacaatcctgagaaatttattattttgaatccatgcttataaattaaaatttagggaagacttgaagaaaatttagttacagagtttcttatcaaactgtatagtaatcaccttgattgtattgcttctaaaactgaaaattccatgaaagtagggcctgtctcattcttgtatacatttatatcttcagggcttgcactgtggctgtgaaatagttgatattcaatatatgaaataactcactttcatagaaaaaataaacttcccttgattctatcaaaagactattaagttttccttatctctaattacaggactgcacagggccatattgatttctcctcctgtgctggctgccttgagtgctgcagagaggggctgatgtgcaactggaaaacactcagaaaaaaatagaacctggaacaaaatggctgagcagggaaaagctgtgcacacatgcccatcatcttaagagtacaatgctgctctcattcgcaagctagaggatccctttcttagcaatccaccttagtctttcatactccgaatattgatagccttgttcttacctagccttacctagtctaattattttcatttttaaaaattgttctctaaaaatgttggctaatttgaaatcacaccaaaagatactttattcttttatatttttgctgtgtaactcctgcttttgaaaggatgatctcatcttatggttctcaaactttattgtgcatcagaattacttggagggctgattaaaatacagattccttccagagattctgacttactcgttctggggtaggaaccaataaattgcacttctagcaagttcccaggtgattttgatcctctgtaatcctctaaaaatagaataaatcttggctcaacacatcccatttgaagggaagagttattttcaatcactgcaaggccaatgattctaaagtttttgttgtcgttgatttgttttgctttcaaatataacagtctccctgaaatttcaatgccaacgtgatttctcagaccctttacctgctgtaaaatcttgcgtcagatgaggaagattttctcagaagaccatttgttatctaattaggctttctaagtggggagaaatcacttgttaattgagtatcccttattcacatagaattgatgatgttcctctaagaaatagaaaattcagataaataaggtcttgagttggaacaaaaattagtacactgtactttcccctccatcctattccttggaggtctaagggaatcaagctcactgactgcaggcaaatgcatatagttttattgctttaacaatagtttgaggaatgtgaggttgggagaagaggtaacatcaatgagtgagtgagtgagtgagtgagtgagtgagtggaggagcagcagttattggtgagtaatttgcagcatactacaattgtagagcacaaattcggtatttgaggtaattaagttttaaatcttacttcatttacattccagaatcatagggtttgttaatacatgaaaagtctctgcttgattacagatgaactgatgatatatcattgtggtagaataaattgggttacattacctcctttgcttgtttccagttatcaactgagattgattttagaagaaagcctattataatccagaaaaatacaacttgaactccataatctcaagtgttgaaatcccaaaagatgaaaatataattctgaaagaaataataaaacattctttatatttatttacattttaaaagggggtttatttgagaaaaattaaaacaaaacaatacactgtacacgataaaataaataatggcacatatttttacaagcaaaaacactcaggtatactagcaacagtcacaccagtataacagttatgatgcagacaaaccgtatttataaagaaataggtcaaaaatggaaatgtataaatgcatatcactgtggttgataattgtgtgcacccagctttatataactgtagtcatcttaaatttccggatgaagaagctaagctttttggcaagatggatcaaaaaattcagtgggtcaacaacacgcatatagttacccaaagaaccgagatcctgataaattttctttcacaagcgcagatgtacaaaatctttctttcatttattgaagaaatttcgacatgtttgggttcagaagtactgcttatatgcaaagtcaacgttgtgataatgcagttctcgtggaatcaaatttctgatgtccaaggcattcgaagagaagcctgccctagttctcagacagaaaccagttcacctcctgtgtctgttctatatgggtccccggcagatcggatggtgcctgctaacattgaggggagatcttcttcacctaatccactcaaactcacactaatgtcatctggaagcaccctcacagacacacccaaaaaatgctttaataggtttctaagtatttaatccagtgacatctcaaattgaatccacaggtccaccccttgtcaacttggctcccgtaagtctctccttaaccatacttaatttccaagtaaagactgtaacagccgcctaacatgatgcaactaacatgatgcaataatcctgcatacgaccaaaaactaatcgcttcaccagaatgcagctttcaagatttcatatttgagattttaatatttcgagattgttattttcaggattgtagacgtgagagattttagacctaagggatttagaccttagggattttgtatcttttcagatttcaacattcaggattatggcatgtgggattgtgtctttcaggattgtgatctaaatccattttagaaaaggtcattgtgagctagaggtctgaggatatttctggaaatattttggtgccatacaggttttttaatactttttttttgcttatatgtctgcatagaaagaaattggattatggtaactttgaaataacattttacattaggatttaattcccactttcatttactattaaattgagaacctgagatttttttggcccttgttactttttttacctttttctttgacctatgtgtatataacatataatatttggattagtttgcaataaatgcttacttaattgaatttgaatttgttacattgaaactttttaaactacccatctacctagcctgacatttgtattagcttgttatagttcttgtaatagaacatatatctttttcccccacattagtaaactgtagttttataaataccccaaaagaaactgagtcacatttctttactaacattactgagatgatgtgggaagaattaactcaacattcttaataatggaaatatggtaatcaatatagttgatggttgttttgatgatacttatttttcttctgagaaacaagtggggttttttgtaagtatccaatgtcttttcactctaaaatattttttcattatcaagagttaaataaaagagaagatggctgatggaaaaacatactgcaagaatgcagggatgaaacgtaaataaacctcatgttaaataatggtcaaaatgaagaagacacattatttacagtattttatgtggaatgccctttcctggatcctttaagaactaggataattactaactcagtcttctggagttttattctattttttattttttattataaaagctgagagatctttttttatcaattgttgtttgaaggtgtaatttaaacttaaaaagacaaaagatgcataggcatattgtatcaatatggtgattttgttatctcttttgtatattcatcataaatttttgtattctgttaaaaatcactctgaaacagacagtgggtccatttttcatcagtagatcatattaaattttatttggaatatctcagataatgatttgtatcattttggtaagggacaagatggtgagactggataatataaatgctagacctatatggttagttattaattacctgtatttccttaagctactgtctttaaagcctgactccaatagtgagtccttttgtaatcaagcctccttcgtttcctcatgagtgaatttcaatgattgtttttcttaatataagaagttcttgttctgatctcaccacaaaaaaaatggtaactagctgagatgatagatttgtagcttgattatggtaattatttcacaaggtataggtgtatcaaatcatcaaattgtacacctgaaatataaagaatcttgatttgtcaaatataccgcaatttaaaaaatgttctttacataaatgttttgtagaataaaaaaaaaaaaagttcttcaaaagaaatctcaaatctccaaatggaaacaggtaaaagtggagctcccctggttccacggagaaccttttttgaggaaacttaggcaactcgcaggtaccttatgtcatgagacagagtttgaaaactacaattgactatctctaaatttcctcccaggtctaaaatgtgatgatagttactacttcagtacatcatccttaaggaaaattattaggtccacactgtttctatcctttgaattttacacataaattttgtaatcaaaagtttatttgtaatatcagatggaatcagataattgctttttgttttttccactgacaggaacataagattttgttgtgtagcttaagtcaaacgcagtttggaatatatattttttaaaaattgtaacttacatatccaaatacaatttttcaagaagtagagtattcagtagaaattaatctgtgaaagaagaggaattcagcagtggcctatttgatgaatgatttaacgtgcttatttcttccctttcatcaaaactctgtgtccccttgtttgccccctctgacttcatactctggagttgaccaagatccctcttccatcggattgttctgggaattttgaaataatctgctttttcctctctttcccctgttgcttctgatgccttagaattacattttcctcgctgatttagtttagaaaagagaaaagagcttccatgactagtagattatcacttttgggtttgctcttggaagtgacaagatgctaggatccctctttggaatgtaaaatttatctcttatatagaaaggatataaatgtagcaccagagactataaaactctgatactatctactgtactgtatagctgaacgccacaatgtgtctggtaatctattgactatcataaatgctatttctacagaaaagttaggaggtccatatttcgggcaaccaatgtatagctgaatgcagaacagtcatagttgggtactaaccatatatatgatttatccatcaacaggtgcatatgctcagaaattctgtatccataagaaatcagactactttcttttccttttgcaagtaaattgaatttagcctgagaggctgaggggaaattttcacatataagccacggttttgtgttttgtgttttgttttgtttatagatatagtactaactggatggatgcgataaaattcataggtggtactaagatacaataggatttgtgaaatggacaattgtcttgcataaatagcaagtaaaaaatcaagcctgtccttcataaaaattttattctggggtgtgcttgttttccaaaagtacctctgctaaatctcctgttagtcctgaaactagaaggcagaaaagcttctagtgctacagccaactgcagtgtagcctgagaaacaggcaacaaaaatagaacaccaggattgctgtgcgtgggtgaggcagaaaccacattatgagcaaaagcttccagtattattttagaaccaatacagagctctgtacttctctcctctctcttccaaaaacacatactacaaaaataaaatgaaatgaaatgtatgtgcatttgccctcttagaattatgattcttaattttttttcttgccttcctttctttggaagcgaatcgccagtatggaaacacagtgtgtaaagcaagcttcgagagaggaaagagttaattggttttaaggccctgcgatagagaattatggttggaaagatagaggctggacagctgggtttgctggggtatttttaaatgcattaatgcaggctccaatcactcggccatgcttgacctatttttggctcaggccgaccattgttctatttctgtgcctgtgggccatgctgttgttgattcatatgcaaatggattatcactcgctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacaggttggtaacatgggaaaagtgtccaggtctttttaaaagtggatgcccatttgagcagaaaggaaatcattgtcgaagttgatcctctgctgcttctcctcagggaggagggagaaccagcgagggtagctcctggggccggtgcactgagcagtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcaggtaagatcctctttcataactgagacgttttaggtttgaaagggggctggcttgggaaatgcagctaagaaaagcacctctcttaaggaaattgctgctttttcgtgttgatgttgctattttcttggtgcgtctgtagggtttaacttagatcccttccattactgtttctgtgcatattcagtctgcttagggacagcagcttctgaatgaaattgcaaactattgcttctgatgaaagatgagactgagataagtaaaatgtagttgggggtgttttgcctttactatgcaactagaaaaaggagctgtgtactgattgtaagcctattctaataggactttaaaaatcaggtaagttcatattggggcttcagtttaaactgcagccccgctagcctgacgattttatatttactctgtgcctacagaagcacatctatttatagacctaccttctaaaatgtgtttgccacagagttataaaggtagttttcttttttccattatgtggctttttctcatcagccccaaatgaaactgtttaggatgaaataaaattgttattagcagatgcttattttaattttcttcaaaaacatgtgggaagtctagcattgtcaggcagatgtgatggcataacacacatgtaaatgtgttaaaagcaggtgcagcgttttaaaggataataggaacagattctaatttctagtttctcaaggagatgagctggtgggagattgagcttgtcagccttgtcaatttatacttactaaatgaacatactctccaggcagtatcacttaacgtgtaattattgcctttcatatttatttcctatggctatttcctaaagctttgggaactctttgtttctgtcctcttctgaatgtttcaacctaaaattggcttaaagttctcacttagatcccacttcccatgtgggcttaatcgtaattatagatcaccgcctagatttccatgataagaatgccacataaagcagtgtttactttgtagagctaggtgtgaaagaaatattccacaggttggcatgatgtctgttttggtgttaatacaccttcccatatggggatctatgtttaaagctagttttctttaaaccttggttagttatgttaattttaagatccttctgttgacccaatcttttcatggaatcagaataaaatatcaattttgcataatttggtatttatacacttaagtgacaggaattatgttaatgaatagtgcctgcttaacaaaagcaaacctaccagaatttcagtacagtttattcttatagctgcaaagctgacaagggctccgggagggtttaacaggtatgtctctaatgggactggtcatttaacttagcattttattttttaaaatatggatgaaccctttgaaaataactattttagaaatcttttcagcactatgctttatccttttagtcctcacttctgtgttacaagtttgatattttttttcatatggtagaaacatacatgccttccaagtagcaagtgtctgctgaagctaaggctggctacaggtgtttgcaagctttgcttttttctccacatctttgataatcacatacagctttacacccatttcagtagagattgtcattttcctagcatttaatggtttgtgtacaaagcaacaagattttcagacagggaagtgcttcaggctgtccatgctttggccagttctacaagaagcaacatttaagcagcagctagctattaaatgaaaagtgatgtaggttaacatcaactcccaaaacctgtctggtataaatacataatcactaagttctatttatttttaaaatgtgaagcataaaaacaattacacccttcctgccatgccatatatttcatatatgttcttaaatttaattcacctagtctttattgtatacttcctgtgaggcactggctctcaaagttggactcaccagaagcactttacaaaatatgatacctagattccactcccagaatgcctggtttaattggtatggggaacagcctggggattgaggtttttaaaatctccccaccttaaccttcagcaaactgagattcactgctgtagggctagggaacagatggtgatgctggtgaaccactatcagtagggtttgtcctttgagctaactgctaaattaggggtatgtttgtcttaatttagctacaaatcttgttcagctcccttttggaccagtggtctggacgtgattcataggcttagaagcagagtctttggatttgaaagagagaaaggatgcctggcagcagtgcaaaggagtggagagagcactgttctaggagtcagacactctgtattctagcatgagctccactgctagccgattgtgtactgatttttttactcatcttcaaactgaagaataatgatgtcctcctgcttgcctcttagcattcttgtgaggttcagatgtatcaatatgtctttaaaacgtatactcactattagaattgttgtttttagtgaatgaacctaagatcttggttttcaatgccatgttctatcttgctgaacaagccacatgagttacattgtaggtcacatgggggaaatgattgtttgttttgataatcagtttgccttagttatcttataaatcaactatttattttgttaccttggtttgataagagttgagatctttcctatgcagactatcactataggtaagagtagggtgtgtatgtgtgtgtgtgtgtgtgtgtgttctctgaaatgtctcattatgtaataaaggcaaagaagttgcacagtatgtgattgaacagtgaaccccaatcgcagatttcatgagattatttttaaaacattggttatgttgtgtaatttctttagcaattgcattagagttcccatttgttgttctagttatattggatattatgcactaatattgatggtttttgtacagagctctttatatactattggaatacaagttttttttatggttgtatgtttttttgatattgactcggccaggctaaacatgtttggtagaaccaggttctataatattgtactaatatattttagtttaaagttctataatattaaatcttagaattcagtgtgagtgacacattttgtcaagtacatccctacttttgtggcttgtgtgggccagggtaagtgataactgtggcagaaagtgaagcatgtacaaatattgactcaggtcactctgcaggagctggcaggattaggggtgttctcccattgccaagcatgttgcttaacacgttgggcagcagagctgtccagacaatattggaacaattattatgaaggaatttcctagagtttgtacagaagtaatgtaagatatatttacaataaggaaagctcatattttggccatctattcttactttagggtataaaagaaaaacatttaaatcaaagtcctgaaattcttttatatatcttcacccttttttgaatccttttgttccttagtgtatggtgttgaggggaagggaacattttagattcagtagtcacgtcacttatgtctacttgaaaagcagaatctaattatgaaaatgtaagtctgtgaaatgttcctgtcatgtcaagaatcacttctggtattccccataattactgttttgccattctctaactcaggttatcttcacttgcaagtctgttatcaattgagatagatgataggtatcaatcagaaatataattataaatgggctcattgagaatggagacaagaatgagtatttcatatttctaaggatgacacaggaggcataattattgttatgtccgttaagtaagaaaatccaataaaaccccttggaagactgaaataaatccaaattctgaattcaaaaaatattctaaatgatgattttaattttggagatgagcaattttaaaatgtgcctcataatttctcactactgataaataatgaagtgagcccaaaatagcatgtcagccagcaaacataccttccatccctgtcacccaatatattcaacagtaactgagcaaagaaaatgatataacctaatgcaacatacctcagaggctaacagccaaggcaaaaatggatgcagaggttctttgatcataacagagagacctgtctcctgggctgtcttagaattttactggcaagttgaccagttcctgaggattctcactaagattcccaaatctgaagagaagaaaactgagtaggtatcctcaccattttgggttgttcttgttttctcttgtggctgagaaatagtagaaatgaaggcttcagagcagcgtactaaattgggagaaagatcgatccatagctctttggaatgacgtacctttcaccaactaaacttagagattctgccaagaagaaaaacatcaactcattgaacccatggaattagacgtcttagtattgcttcctacaaatagagcaccttacataaattttatattaaaaaaagctgaaaggtgagatgataaacaagagaatgagatgagaaaggagatatagatctcaggaaatgaatcaagaatggaaaatcataatgattatagaaaaaaatattcattagaaatagaagaaaacagaataggcccaggtaaaaatctttacacataaagatgaaaggtttgaaaaaaatcagagtaaatgaaaaaggaaaacagttagacaaagtagaaattctcaaacatgaaagaggctgcttgacagtgaaagccacacagtgaagagatgaacttaaaacaaacaaaaaactaaattcagaagtagagaaaacattatcaaagtaacgagggaacactgaatgcatttaaacaactattggattgtgtttatagggcagaaaacagatattataaagtaggggaatgtaaaaatattaataaagctggccagtgtgaggtgttagagagaggtgagatggaaggatgtgagaaatgctaatatccttccctttctgagcagggacagactccctgctgcttaaaatagaaacacatacttaaaaaaaagattcaaagcactgatttttaaaaatagtttatttaaccttaaagaggtctttttggaaatagtatctcttacgttaaggaagtatttagtacatttatagttccttcaactgcagttttaaatctgcttaattcagttaagtttaaatttaaattcagttaagtttaatttcagtttttaaaaataaatataacatcagtgatatgttcttatttttataattttttaaatctatccatccatctcctgaagaattcatataaagataggaagaaataaggaaagatgctgtgctgtgtttggtgaagaggaggggctttttctttcagcatcatacctctttacagtgtatgattttttataataggcatgtattctatgagaagtgttcattacacacccccacacaaagctaccatgtcaaaatactaacagtgattaattgtaagtagtaggtatattagttaggttgttttctcctgcagataaaagaacactctagtcaaaatgacagacaagtaggacatttatcatgtgataaagtagttgggtggttaggcagcaccaggtagtcaaaaatggcagcagcattcaggtccttcatatagctccactctgctggtcttagccttggttggtgtgatcctaagattggatcctccaatggtcacaaactgacttgtagcagttccaagcattatgtatgtttatgcataacaaattgcagagacaaaggttggatcctccaatggtcacaagttgactcgtagcagtttcaagcatcatgttatttatgcacgacaaactccagagacaaagaggggaaactgctgtcttggcgtctcttttaaaggaaagaaatcttacccagacttctccagcagatcatcctttattctatattgactagaatagcatcacctgcctattctttcacttgtttttcagaggagtgggacccatgactgagctgggaaggcaggatacctaaacctgctcaagtttctattgggaagaaccaagaagcaggaggaatagatgttagctaggcactagcagtatttgctacaacgtggatattggtgataagaagtttcttctttgcaattttatttactttttagtttccacaaatataataaagtaaatggactatgtttataatttccctttcagttgaactatgggtgttgactttcttttcatgaagataatatatctgtttaaatactaatgtaagtattttttactagtattgaatataagttttttattaatattgaatagattgcctttcttagtactgtctattgttagaagaagccccctaataaagagactgaagtaattgtagaagaaactggatctctctaagctattaatcatgttttctgaaggaaggagagtcaacattgtggcctcatgccttacaagcatttattataaacgtgaatagagtattcctttaatgttggcttcgaggcacacaaaattttttttgagaaatataataatatatgaattgttttcaatatatgaaaggaggattatcttaaaaatactcagaatgtgttcgccagtaggttgtcacaagtattacattttaagaatcatgaacaatttttacaatatggaatgataagcactacattttaacattttttttctgaatttgaatgctttgaaaataatttaattgaaataaaagctcatgcaaatgactttagaaaagaagctttcaagaagaaattcaaaaatatgttggcctctgcctcaaatgagtgttggctgtgccatggtcccccctgtttttgaaaggaagctgaagtgagtggttagcttgggatatgtggtgtccttcctgttggcagttttccccttttcttttcccagtaagttggcaataaggaagcaaagaaagaggaaatgcctggtgttcctagttccattcttcttcaactaagttggttgcacaaaacaaatttaatttaaacaacatttttcacaatactaaacgacctacactttcaagtgttatcagagaacgttatgtttaggtttactctgagttgctatgattcatgaatataagaataaatacttcttgtgtttttataagaatatattttccattcattatcataatgttaacttttccatagtaaaataagtgatgggcttttcgtgtacagtgtttcttaaatacccattaattaaatccaatgaaaaccacttttaaggaagaaagaaatttaccaaaccacagagtgtaactagtcatttgcttatgattaaactttttgcatgctgataaggttggaaatacccacgactttattttcctgcttctccttatggttcaccacttgtatcagaaacttttaaattcataatgtatgttcattattgacccagttgcagccatgtggatgttattttcaatttgcttgaggtacattttggtgaatgtctaaggcatgacattttcaaatgagaatgtcatgaagttgtttcaaaatttgaaacttgatattaaaaacaaaataaaccccccaaaatccagaaaacaaaaaataagtaaatttcactgagttttcattaaatgacatcatagcttgggagttcttgctttagtaaaaatgtgtttacccagaaggttttcagggaaccccatgtagggtgaataagaaaaagctcttgtgttaagcactgttttaactttattcttgatgatgcttttgaaatctcataatcaaaattcaagggtgtattttaagtacatgatttttacattaggaactatccattttaagttagaaagttatcaccacccgtttttgtttttttctgtcatactcctctctgatcttctagttgcttagttccaattttattttattttgttttgttctgttttttgagacaaagtctcactctgtcatccaggcaggagtgcagtggtatgatcttggctcactgcaacctccaccttctggttcaagtgattgtcctgcctcagcctcccaagtagctgggattacaggcatgtgccaccatgcctgactaatttttgtagttttagtagagatggggtttcgccatattggccaggctggtctcgaactcctgacctcaagtgatctgcccgccttggcctcccaaactgctggaattataggcatgagccgctgcgcccagcctagttccaattttagaggtcagtgattgtaagcatatttttttcaaaaatttttatgtcattcttttattattgacacaatggctaatgtttcaaaagtttctctgtgtatcacttgatcatttaatcctcaccacagtttaataatgcagtagttgttgcagcaatattggtgttttacagttgaggaaatatattcagagagataagaaatttactgatggttactgtaggtaggaaatggcagggtcgtgtttaaatggcagggtcctgcccctttttctcaaaaaatatttagcataggataattctgcttggtactaaaaatgtggacacatttatatatgtataaacaaatacctagacagacttcttaatcctgggaggtttaaggcacaaataggcaagcatgttgaaagttttgctggaagatccttacttcatgttctcagtgctagataattaaattcgaggaagttagcactatccagggctgagaggagcttaaggaaaccaagcttctatgagcgtgctcttttccttggagcagatgctctggacagaagcagcattcctgatgcatttggcacctgtttgccagtgttcatgatacacagatcatgagggtaaagttagccccgcttcaaaatagcaaattattattaatgtattttggcaggagaaagtaattttttttgaaatgttagcattatggggttcatttattttgaccaaaaggtttgaattatactcaccttggcatttaccttgaaatgtaaggttaataaagcctatatcaccactcaaatcctaatttcaacttgcaatgtgaaattctctagccacaataaagatctagctaacataattcagtttctacttattttgaatatatatctgtccaatttgggtccagtttggacaatttaggtgaaaactggatggctgtgtttatatgtattatcatcatactacgttttactttatcttgagttaattttgctttattggatgaatgtcatatgttctgtaggtggcttaagcgtaaaattcacccattacctactaatccaattatgcaaaagcccactcttggctttccaacaggtaatttttatgatcttatttgctatgagaatcttgagccatcttcaggaatcaatacattgtaaaagcattattgattatcacgttaatgattgacataatttattgccttcctaggggaaagaagctttcagaagatcattaaatgcattaaaacctgcagatgtccacatgtctgtgcctctctttagcagcctgactcctttgggtcagttattcttagcctcggtatttctatcttatggcatcgcaggtctaagattagcttgttaggcgttatcatgccatatgagttacctcctaatataactctacactggaatgattatttatagaaagagcattctgtcatttttgggttatttctagtagtttaaataaagaagaataacattcaagtgaaaccacagattccttcctgctgccaaaatagcatgataactgtctgcttaaggggcaataatgttgtttaaatgtgtgcttagggtgattgcagaattctttttatctctgccaccttgagagaaaagggagagctctggtaatgatgtatcatgcttatggaaaggcaaagaggcggccttgatgctgtctcagagcacacaggactctggttgatgatgacaacaagagacacacagggtttatttttagaaacagacattgctaagctctccatttggtgttaatattgctcataaacagagcttcttggggctgttgacccttctcgtgaatatggcattacacacacatactgttttcttttttcactttgtaagaatgattctattattgaaagtgtatatatatctgtttctaaaaattaagaaatctaaattctattcaatttctcaattttttttttttaatcccatgaagcttgggtttaagaattggtttatgaaaaacaattgactattataagcacaataaatatacaggttaactataagtatgggaaaaaggcaagtatacatcatgaatgacttttaataataaataacaccaatgctcctagctttattaccacaatatataaaatatagccataaaagatactgtcattataatgcactattgtgagttactgatttaaatagatgagataaaattctcagcatatgagaaaagtaagtgtaagcctctgcttgctgtttgggtattactacctcttgatgttcccagcaagtctcatatacagtaaaatatgcagttttacatttgagaagtgttctctcaatttactttgtgtgcttaattcaaaccttagcaattgttactttgctctaaaattagaattgtgttttaatgttaaattcgcattttatattttactattaactcatttttcctaaatgataaaaatgttaaaatggatgttagtgcattttatgttaaacatttgccaaatgctatagaatggataacttatgcaggtcttccaaatattcattacatattattattattattattattattattattactatttgagacggagtctcactctgtcgcccaggctggagtgcagtggcgcgatctcggctcactgcaagctccacctcccgggttcacaccaatctcccacctcagcctcccgagtagctggaactacaggcgcccgccaccacgcccggctagtttttttttgtatttttagtagagacggggtttcaccatgttagacaggatggtctagatctcctgacctcgtgatccgcccgcctcggcctcccaaagtgctggaattacaggcgtgagccaccgcacccggctattattattattattttttgagatgaggttttgctcttgttgcccaggctagagtgcaatggcgccctcttgggtcattgtaacctccgcctcccgggttcaagctattctgcctcagcctcctgagtagctgggattacacgcatgtgccaccaagcctggctaaatttgtatttttagtaaagatggggtttcttcacattggtcaggctggtctcgatctctcgacctcaggtgatccgcctgccttggcctcccatgtttttaaaagataaatatgttttgtgttttgtttggttatctgctgaccattaggaatttccaaaatgaaagacaaaaataggaaacacacagtaattgaaatgtatcttaaaagaagtcaagatggaaataaattcagagagtggaaatggaagcaactgaaggaacaacataacatgttgcatcctgaccactcttttaatgagcgggtcgaagactttggaagatgaaattgtttgaagctttgggaactggggtgaaagagtcatttatcggttcattttttcacccaaaactgttttaagaaccaaccatatgacacagaagatacagctattaaacaaagcaaggagatacatggttggttgttcaatggaatgatggatggatagataaagctacttgagataggaattagtattaaggtgaaataagagaatggggtagaaagtgactgatagggcagtattaactagggtagctagggtagttaagtgaaggcttttgagtctgctaacctgtaaagggtatctttctaaaaaaagtagattttccttcaacgtttaatttggtctaagtcaagtagaacagaagcacagttaaaatagattaggaatggtctggatctatttcaatattgttacctctgctttgtggaaaggatggggaagcatttagcagtaggtaggtaagggaactggagaaaggctgttagctatgattttctctgtttttcatagagatcgtgaaccaagtgcctctctcttgtattcatattattaacttgaagtgaaggctcttttagaacttgttccctttccttgttcctaaggttcacccttgtccctcatctcacctgccctgtcaattgtgcttaacatttcttacccaagcagtatgagtcattgctagtagttcagtgaagcaaacagtttctctttctcagaaacccaaaagaaggggagcagagtatcttcgccagctgaagttagaagtcttagaacattttctcataaacacaatattgcacactttttaaaggagtatgaaatacagtattcatcacacaggcatttactgtgtacctacaacgtgccaggtatttaattcaggtagatcatgggtcaaatcacacctttgttaggcggctggagaatcataacttcccaagaaaatatttagcatacatagcatacacagtcgtcgttgggttagcaactggctagattcgtgacatgttgttacaaaaaaatagttgtataaggaagtatttcatgaaggtgacacatctattttttaaaaagggagaaacagctaagagctatttttcctcacacattatgctttgtgaatagggaacaatggtggatacacagagtaggttggacaaacatttttgagggactgacacattatctcacatgcttgatgcctcatggggttttccctcaacattccaattggtctaagtcaaagcacaattagaatagagcaggaagtgttctggagctattttaatctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatggttagtggtgacttgttttttcccccgagtgattatctcattcaatcagtatttattgagtccttgaaagctgtattttttaaatgaggctgcttgtttatctgtttttgttgttgttgatttcttagtctaagaattaccaggtatttccttcttctgagataccttaatgctctattccaactggtcatcactggggaaaattctcttacaagcccaatgcaaatgttacctaatgtctgacaccatcactgatttcccctcacctctgtaatattaatacttccctaattacgtgtattttttttctctttctcccttctctctcgatcctcatagtccttttattactctctttagaacatttccactttctgtcttacactgtgactgtgtatgtgtgtcctcatccccccaattagttatattataagctccaagaggaaaaggatcatgttttacttctatttttattccctacagtacctagcatataattgatccctgagactatttttagataaatgaatgattaaagagtacagtgttattgcacaatgtgtttttatacatttggtatttttaaaaaatgatttcttcttttatgaagaaaattactcctcagtttctttgtagatttgaaaaatgtagacatttttgaggtgttagagctttttgcccccaaattaaaattattcattatagaatgtaagcaggaatgacctccaatgctttaacaatgtgtgtatgaccctttaaatgcttcagttattcttaacgaagggaatttgggaatattcttatttgatgtgatttttcaatgaataatgaatgccaatagaaatttcctgggatatgtgtctgcattcaaaatgtgaaatgtgaaatagctaatttaagactgcctgaatataaatgcatactttttttaatccaagagaagaataaatttagttgtgaaaatgattacaggtgtacttttatgttattcaaataacactttgcatttaatactatttttcccttctcctatgtttttatgtagagacaattttcttagataaggggcaaaaataggtggatttttctgttaataataatatcaattggaaataatttatccccacaattgctatctagctcatctacatttattctgacattatttaattagctatattatttgacaagggggcaaggaatgatgatttttgatgaacaatttaatcaaaatctcaatgccaagggtatcagtaatttgaaaaattatctaaagtaaaatgtcagaataaggagttaacatagtgagatattaaggaaatatagatggaatgggtgaatcaatctctatgtacaactcttctaagagaagaatgagaaaattatctttatgtgtatgtgggaaaggaatggtatagggaataagatataaatctttcagggtagtctttttgctctattttatccttaaaacagcataaattaggataagggcattaagacttagaaaattaattgagttcgttgataatagatgtgtgggctgagaaaggagttagataataaaaccgaattttacagcataggtgttgaacacagtgtagtatatcatggtgaacaaatgtatgccagtgtccttttagtgaatttgcaaaggctgccaattaggctttcttatcattgttcatttgtttgctaaaagatgaacataaaaatattagaaaaaaattatctgaataccagcttaacctaacttttatattgtaagaaggaaaacaaccctcaatcaactgatacccgtagtacccctagtctctcactatttattatcccagtaattaaatggacattcttccacatccttgatctggaaagatcaatatctttttctttttttactttttctttccagcacatagtttcaaatctgaatatagttataactctaacgttagaaacctctatctcagttcagtcttagatgactacaaaccaaactaaattgccaggtacagtggttcatgcctttaattccagcactttgggaggctgcggtgggaggattgcttgagccaggaagtcaaggcttcagtgagccgacatcactccattgcactccagcctgggcagcagagtgagactctgtctcaaataaataaataaacaaataaaagaaaagacaaatattaaattgtttagtggacacaggagacaacattgttctatttgattatctactgcccagtcagcttccttgggcactcaaccaacaggtaacagagattatctttatgcttcaccagtcatatatatgagacccactttcttcacacccctgccaatatattggatattgtcagactgtagatatttttgccaatcttaaagatgaaaatggtagagaattacttttttctgtgaatttttctgactactgttggattcgagtggttttcatatgctattagccatatgggttttcttttatggagagagaattccaggaatgcaagattggttaaaggaaaaaagtctatcagtgaatgttgccctgttaataatgaattaagcaaaaaaaaaaaaaaaaaaatcttctcattagatgtagaaaaacatgcaataaaattcagtatacttccagcatagaaactcttattaaactaaaaaatagaagagggaagtaagtattgttgaccaaaacccattcaccctatctgaaactttatatttaatggtaaaattaaaatacattctctttaatgtcaggaattgtctttggatgtcctagtcaatatttcaagacatgagcattcaataagatgtattagaaattaaaaggaaaataaaataattgaaataataaagagttcacttatattgctcagtacaaggtcagtacaaaataaaacattgaaaggactgttttatataaaaaacaaccaaacacaaaatgtaatagtgctagcatttacatggcaaatgaaacttttatggaaaaattaataacattgttgaagggcatataagaaaacttgatcagatttgagcgatgctatgctcaggaataggaagactacatctttaaaaagttatttattcccaaattaatctacatatctctttgtttttaaaacagttttttaaaaaagatgcttgatgaatagtattaagtcagatacactaagtgatgtataacaagaagtaaatcttatttccacctcaactctactaaccattcgatttcccacctcatacatagtctgctgtaaatttcttctatacattatatgtgtattatatttcagcacaatgttgattaaaatcctgacaggatctatgaaggaacaaggcatactgattccagaaattcaaatatacgagtaagtgtgcacaaatggcagttttgtaaagcaacaaatggagagaagaagcctagatgtcaagtcatacaaagctgtattaataatgattatttggtttgggcagggacatgctcacatagatgacaaggaatagaatacaacgttatttttagtagctttgtgtatgacagagtttgcatcacaaatcaatggaaagaggacaaactgttaattaaatagtttgggaacaattaatatattcagtttttaaactcatagccaaatgattttgtactcaaatatctatgtttgcaatactgttgttatccagttatgcaggttacaatttaaatttctgcaaagcctatgtattgtatcatgcatgtaggatcttgcattgtatagagggaccggaaggaattttatgaagatagggcagggactttagtaaagtggttctaaactaggtgagagaagtacacaatgtttatctagctcaattctcaaaaaataacttgagaccaaataaaagattcagatctatgagtacgatagagtgaaatagagaggtgataatttagtcaaagaagaaaggtagataactgtatcctaaagcttcaccaagttagtcactgaatagtgccttaaaagaccaatggagaagtgacttttaagctgatgcctgagtgactagaagagcccagccatgcaaagatcaaaggacagcaattccaggcagggggaacagccaatgccaaggcccttgagaccattatgtatttggctgttctcagaataaaggccactgtggctacatcactttcaacacaatagagaggattttcaggaggtttagccaaatctgccactgtctgtgtggagataggtaatctagctgtcttctctggcatctgtaagctaggatgggttgcctagattaccgttaggtccctgccatccttaaaaatgttagggatttgactttttaattccctaaaccagatcatatcgcaagactatgtctttcttgaacctccaaaataattttgatttagtgggcaaataaccccagtaatttgtttgatactgctagtttataatcctacagattttaggtttagaaacccattcacttctagcttatttaaacgttattgcttattttgaagcttatgccatgtctgactttggcttagaatgtgttgccttttcacaaaagtgttgtggtctgttatagacctgtttacaaagaactatcactaattgttatgacttatctagcttagtttgatacctcaaaacaatctgagtcaatctttctttttctgtggtgtgtatatgcgttgtatgtgtatatgcatatacaatgtatgtattacaactgtaattgaactatttcatatttttctctgtagcaagttatgtcattcttctaatagaagtagaaagaaatagatggaaaatttgactatatgccaaatttcttatagcttagaactatttattaccatcttagtaatgaagattattatttgattgtttatcagaaatataaagttgtatcgttagtgttcatgtttttcttccaatctctttgcccagtgactacatttgaattttctaggtcaatttaaaattgtatttcacttttaaaaattcggacttattttgggctaaaatagaaatttcagttaagcacaataacagagatgattgtaaaaatgcagaaattccagttaaatattaacacttaatataattaattgctgcaggtcagctgcttaataagtaaataattgtttccagctatcttttttccccagtttattttaatcaaaataattttcttggctgtgtgctgtggcccatgcctataaacctcaggatttggaaggctaaggtgggaggatagcttgaggccaggagtttgagactatccagggcaacatagtgagaccctgtctctacaaaaataaaaacgaaaaataattagctggctgttgtggtgtgtgcctgtagtcctagctactccggaggctgaggtgggagggttgcttgagtccaggaatttgagtttgaagtgagctatgatcatgccgctgcactctagcctggatgacacataagaccctgtctctaaagataataagaaaataataacaataaaaataattttcttcgttaaactagtattttgggataagtactacatagtccttaggaatttttattcataactttttctaaactccagtttatagtcatatggttaaaatttaaaaacagaaagagagattatattggttattggttctaaagtcatattttattgggttttacacctactatggtgatatttaaatgatgccaaagctacatgttgcaatcaagataacaagagtattttttccttcttcctcattccaatcttttgaaatgtaatgcatggaaatttttctttcatatgttaagtgtatctcattgctgaatatagtgtgcctcactgaagtattcacttcgttgccaaaaacacatcagtcattcacaaatattcagtattctgagaatgaaatttttttttagctacttgggtagttggtgaaagccagtttgcaaagatttctaactcctacagcgttagacatattatgtggaatccagggctaagcagcagctcccaaaacatgaggtagagttctagatacattggacccttcaggccacagtatcctggaccaagatttgtagccagttaacagaatggcagtaagcagtcttctattttgtcagtgagatcaaagagcattataattttggagaacaaagggggttccatccctgagcacattcattagcatttaaaggaaatagttataaaataaaaatacaatccctgagttaattaaaacatggagtttcaacataagcaaacctaaggcttagaagattggttgacatataataattgcttaatgaatattcatgggataagtgaatgaatgaatggattgaatatcatccatttacagcagctgatatttcaagtgcacatgtgcgtttgcactttaaatgttctaggctttttatcctgggttttctaggcataagatatataaagaatatattttaaaagccaatttttaattttaaaacttaaagggaagaagaacttcttttcattcttcatgatgcttttactaaggacacattattatttttatgaatattaactacgtcatacttcaaatatggaggttcttcagtcacacttaaaattttttgggttgttttcttcagacaaaaatggctttgcagctgtgattttatactcttcatcctgcctgcgggcctctttctagtagggccacattgtgtcatcctaatttattatgtgcagtatagttagagaataaaacctcagatggttgggcttattgcgttggtttctaaaatgaaatttaaaagacctttaagaaggatttcctctgggtaaatatattcagttatgctcatatccatagaaaatgtaatttggacaataaaaggccaaaatcacttgagtctttggtatgttctggatagctggtgtttttagagttgtgatttccaggaaggaggatgtcaccttaccgccctagtcaatatcctatttacttaagaacagaaacagggaaaggacaactcaaccttcctctcacctccttcacatgagaaccccagaggatgttctgatgtgtgtcaaattcacattctagatagtaatatattaggctgggtgcagtggttcacgcctgtaatcccagcactttgggaggccgaggtgggtggatcacctgaggtcaggagttttgagaacagcctggccaacatggccaaaccctgtctctactaaaagtacaaaacttagccaggcgtggtggtgtgtgcctgtagtcccagctacttgggaggctgaggcaggagaatcacttgaacccaggaggcagaggttgcagtaagccgagatcgtgccattgcactccagcctgggtgacagagtcagactccatttcagaaaaaaaaaaaaaaaaaaaaaaagatagtaatacattgagcatctgatctgccttagctgaaaaatcaaacatctggcataatggtaaaaaattatatagaaagattacttaaaaagacatctgattttaggcttctttttctggcaacaacaacaaccaccaccatcaccccaattcagccagcattctctacatttctaatttatgtttaaataaatatgaatatttagtccaagataaattttttgatcaaaactgatgatctcacacattgacagatttactttctggtatttaaagacaaacatattcagaaaggttaagcagtgcagggcgtcatgtgcttacaggaattgatatcttttaagagtccgtcattgtgactgcctcatttcacggcttgccacctgactctgttcttacaaacgataaaagttcaaataatacattatgaaaatgcgttctgaggatgttttatttacttgctactttccacttgtagtttcatgtcaagtatggtcccttacacctggtaagaactgaataccatgtttgggaatgaacgaactaaaggatcagcttgtgtgatgcgagagctgcctgcattatttcctcccctccatttctcctcttttacagtctagagtctagtatggctgctctcatagttcttctatacattcattctaaagaattagctgtaatctattacacatcatataccaactttgttattctcttgtcagtcacatatcttttctcaacactgatttgaacatttgtccatctttcagaacacgatgttgcaggtagaagagtacaagttaagacaggatgccttaattaaagaagaggcctttactcctgttttcttccattctcacccctctgtttctgccagaattgtgacagcagggcagaaaatgggcttttcgtgcagagttgacaagatacagggtagtgaagacaagaatcttctttcacatgctaagaaactcctgactatacttctgaagtagtaattggaatgacagcttttctggctgaagtacaatttttttgttttaaaaatacaaatggtccctctcattttctattcccagttctttcactcacatgctcacacttacagttatacagtgttcacacatacatttttcattgttttctcatttgaaataaaatgttatgagaaattttcaccataagcaaataatcacttattttatttgttttaattgagcttttaaaaggacattatttattattatttcacacactcgtgcatttattgatttactctctcccacagtgattgatttaccggtatttatcttctccaactagactgacttctaatgactcatttatttgggaacttcttctatacgaatcaaaatcaagagtttgaagtaacccagaaagagacttggagagcccaagggatctgtgaatgagctttaggcagtttctgaatctaagaaaattgtctgcaaacaaatatatttgtgtacatatgcatttttggggagagactgtcaattccatgtcttaatactcaaagaagtttgtgtccctagcaaacgtaagtgatcaattttagaaagagtgataacaaatttgattatttgggtcttcagcccaagactaaaaggcatagattacaagcaggggagtttactagatttagactacctaaagacttacctagagccacagcacacaataaaaagcaaaaagaaaaccaacccatcttccaaatatagaaaaggtcgagaaattaatgcaaaagcttgtcccacctccattaaagccgactgctgtatttaactggccctgagggaaccacagtttcacaatgcagttacggaaaggccagtaatagccctggctggctcctccatgtcatagatatctttaaaatcagagatgtatctaacccattttggaaagcataccttaaaacattaaagtgtttttgatatttcaaggaaaaggcttccgacatgtgaaatgtttattttctagattctcttattccaaaatgaaatcaaacgtgtatgaagctgtgggatgtgtcgtttgccccttgaagctatagtgtggtagaaattgaatctttatgtccagaagcccagtgtctgtattattagttttgcaaacatctgtgggctctaagtgattgataaatactatgtatagaattaacctaaagtttagtttgaagaccctacttcatagatcaatatgaaaatgatgccagcaaaaaatatagtttagacattgtgccttggaaaaatatttctatttatattaatgagcttatgtgatgtcatcacaactcattctaggaaagatctaggtcagtgtaatcctatctagagaaagttaaaaaagaataattgttgacttggtattcttcgtagtcagaaacaaattaaatgacaaattatgacactattttttattacatgacagacaaataaaaagttaccatatattaaatgctcaagaggttaatatctataaagcagaaatataaactgtaaatcagtaagaaataccagtaactcagtggataaataatcaaaggctatgaataagacatttacaaaggaataaccaaaaataggcagtaagtatccgagaagatgatcaatctttgtcatgattaacacatcaatgaggtgccatttttgtcaacattatgggagtaaaaataaatgactagataatgcttagtgttgattgtggtttggaggaaaggggtgttgtcatgtattagtggaagagcacactgttcaaattttggagcagcataaattggcagtactataaaaattaaaaatctacacacccaacaatctagtaattccacttaattggtatacagaaatacttgcacaaattcacaataatttatgtaccaggatatttatcagcagttttatttataataatggaaaactgagggcaatctaactataagtcaatacataatccatactctgaaatacaagtcattaaagttattaagtaatgtctgaagatattaacatagaaggatgagctcaatatattaatgaatgcaaaaaaatgtagaatggtatacagtacatatagcatagtaagctcaactaatggattcatggtacttgtttccattattttattgttgtagtaggagcagaaaagtagtaaaagtattttaacccaaagaaaaaaaatgctagcatgaaaatcacagttcaataaagtgtttttatatcagtatgtttattaataattaaaagtattaataagtttacttcaggaataagattaatttacgtatctgtgagaaacttcgtgatatacatcaaaatattaaagtaatcatgctatatttttcttttcattctgaagaccacctcttgcaggtaactttttctattttattatactgtcctattctcctttctttacttagttatatatcacaactatagaagaaataggttacctgttacttgcagaaatgtcactcactattaatattactttgcaacacagaaaatttttctgaataattagaggcaactaagcaagcctaaatggagttggttaattaagttataaaattctaagggagtatgatgaaccatgtagacatatgagctttctgttctgcttttttatcaaatgtttctggcacctgggttttctcaactgcccttctgttgaatatgattttcgaattgatgtaatgaagagtggtgctctctggacaagtaagctgttcatttgtagaataataatatgtcaacacatattttccaaaataacagtcctactaccgtaaatgtcttggaaacagttacctgacacccagagagtaagtacaactagcctagagccttggtctgacaccaagcaagagggtttatgaaagaagatagcccagaaagctggagtcctgctctgctgtgtcgacatgtctacagctcagaataaaattgagtttcctgctttagccatagctgggtcttaaaataacctgaagaaattatagttctgattacatagaaagtgaaggacttagaacattctcctaataaagccatgagaatgacacaaagcttagtcatcggcagtcctcctctaacaggcgttttagagagaaaaatagaggtttgaaattggataatttgatttgaaatcttgcctaattattttaagaatgcagaaaacctttcttttttggccaaaaaaataatgatctggaatccaattaggaaagaacaggcttttaaaatgtttgatatctccagtaatggagaaaaatcatgtctttaaaattacattctgctacaaacctcattcttggatgtcttgctttttgcattttgaatggacaaatttaatgtaatttccttttggaaacatggcattggaaaagttagatgagatgtttaattttatgttggatcctatctaccagggtacagatttttaagaagaaaaacacttcttgtttcgttttatttcccaagggagatatctcacttaaccagatgccttgcgatttgtcacaatatagatcatttacacagaatttgtgtccagtcgtccatctatttgatttgcacaccatgaataaaataagcaaaatggataaagcttctaatactcccaattaaaaaattgctatctattttttcaccattaatatgctatcccaaatggcatttatcaccatactgtctcaccatatttattcgtatgctgttgttttctcaagatacgttcaattcagattatgtttgacttgcagccatatcaataatatgactaataataaacaacagtctaggatttccagtttttagaaaaacgataataaatttgaagtgaacctatattcagatttacattttacttagtattgtttttaaaaaaacattcaattaatattctgaaatgattccatttatttttactacaaagttagctggacctttacagcattttagagttttacacgaggtttagatttgactaagccttagtacgatgtctggaaacaggaggttgaatgaacatttgttgaaaggaaaaatcagttattgaaatattgtgtcttctgttatcattcttgagaaatggtggtgagacaacttagtagaagtgactaacaactacatatatacagaagacaggatgtaagtctccaaggtaatcaagaccaacaggaggatgttagaccaaaattaacaccgcgagaaatgtgttatgcatatattacagcccacgtgtgaaaatctgttcatttatagagagattgcttctctgtgaatggctaagttggctccactaagtacaaaaaagcacttagggccattcagaactaacagccacacactctgaaagactaaaccaaaagatacctgattagtaagtgctctttagatgtggggatagacgttttaacaaagaaaggacagggatggagaggactaaagctccgtgctgggaaactcttaaggagccagggcctcccaacaatatgctaagagtgcacccctagctgtctggccacattttcatttcttgtctcaatcctgaggattaatcatgaattccagtccagtttctttccaagcatataactggacatgacagagtatcttagcttctacatcataaagctcaattgttaatactgaaaaaaaaaaagcagggtggtttttttaaaaaaaacaaaaaacaaaaaacaaaaaaaaaaacatctaatgagcaaacaaaccaaacatgcctctcttatttcttgtcctgtctattttttatttaagcgctgtaggtgaggtaattgaaatggagcccatgatatgtcttaagaaggattaataacattcagtgaccattaagtgctatgaattttcaatgtataatgttttatttgtttctcccaggaatcctctttgtaggtggtaaaaatcatttaacaagtgaggaaactgagctcaaagaggctgaataactttaattaacaagcatttatggatgtccactgtatttaggccaaagtaaatgatgtagtgtcttgcttccaagagcacattgtctagagtggaggaaaaaggcaaagtaaacatgagagaataggtgctaaaactagactttgcaatattgagaaggcctgggaagcctttcaaaggaaataaatgaaggggagttcagtgtttttgaagatggttggaggacatgatctataatgttgccatggctggagatgacactgcaaaccaggcaggagacagatgattaaggacctttaattccatgcaaagctagtgactttgaacttctaaaggattttaagaagagctgcatgatcagaaatacttcttggaaaagtaactttagctgctgtataaaggatgggacactccttaaaatgggttgtgtaattatcacataacctctaactattaactagaagtgcccagcaaggaatagggagagaatagtaagagtgaactggaaggaccagaaagagataaattgggaattcatgcaagaggtaaagggacaaattcagagtctgagatttccacattcataactgggtagatgtgttgccattattcattcattaattattttttgagtgtctcttatgtgccagacattatcttcgtgccaaaatagatgacagagcaaaacaaccttatatatttgcccttgtggaatgtgaaatctacactgtttgcacatgtatatgtgtgtgtgtgttgggagactgataataaattataaatgtacataattatgtaattggttagaaatggtgctgttagatgaacaaaaggtagggcagagaaaggtggttcatgagttgggagagaaaggtgcaccatcacatagagtagttagagtaggtaatttttatgaaggtaagattttcagcaaaggattggagaaggattgttaaggtgaggaattacacaagagacagatgaggagatttaaatgtagaccccgccctcccccacctccccctccccgctccgccctgcttcccattgcttgtcttgctattcacctggactggcagaataagcgtggagcttggtaggtaacattgattgactatcacaaaatgaagtgtagagcaacactgagagtaggaaaaccttacactatgaaaacatagaggggaaagaagcacttcttcatctggctgggttagctattctcaggataggtactcaagtatggaaggtatatagagattgggccttggcatacattcatatctacacagatagcatctatttacctgtgtagtgaatgtgagcatgataattcatgtaattaactgccatatttcttgtagggactgaaagttaacaactttgtatattaatactctaagagaactctaactatagtctccaacaagaattgcagggattttaaactcataattactcctcagctgtaaatttcagatgtgggttattgctttttctcatttaggggagtgaaattgcttcagccatcgactttgtgatgaggcctgcagtcagctgtagttgagaggggtgctcactctctgctattattagtagtttgtccacgtaaagacaatcatacaacatgtacaaaagttggattcaggatagcaacatattatgttttgtggctgcaagatatttaaatctaacaccaatagcataacgtttaaaaacaaaaattttattgaaaataaagtttatgtttggggcaaaggaagattaagaggataggaatatatattttcccattcttaactctgtctctcttctagggattgagagatacagagagattgagagagtgaattggagtgagtggatatgagttatatagcactgcctaatggattattacctcccaaacccctgagttgaagagtagatggagagcctgtgtaaaagattttgggtagacgattttgaaataaaacttagtgacatacacacacacacacacacacacacacacacacacacacattacagataagtatatatatggaaaaatatgtatacgcaaggaaaatactgctgttctaaatgtagtataatgattttaatatactacccaagaaatcttatgagactttaaaatcattttaagatttaataatagtaatggatttaatttttttagtatgctattcattacaaactagaaaaatcctaataaatcagtctgaatcagtaaagcctcatagatttccatgcaataatgtgtttcctcagttgcttttacaggaaaataattactaattatttgataaatttaattttggagcaaatgtgttgacagctgaaaaaacatgtaatgacttggatagagaccagatataacactagaacaaataatattggcgacttaaaaaaatagtaactgatgaaaaaaatctaattgcgttaaatattttaaagtacctaaaaataccaaggattttgtatcttttgtccttttctacttgaaatttcttaatcattttggtgatcatacaagataaatctttaaaattactgtgtgagtattcttaaaataaatataattctttggttaaactatacttctctaaattacatgcagtcttaataaaataattcctatggatgttaatgttcattctaaacaattttgctcaatccatatttttgtaaactgcattgctttgctttttttaaaagctactgtttatatagtcctagttcccagtttttcatatatactgtattgtgtctttaaaattagaaatgctgctgaaacatagaatatattaatccttgatgaaatgggacctctctttgagtataggactgttgcctgtacaactaagtctagtctttcagaacagaataggatgctgtatatctgttccctggaacttagatcctttggccttggttctacctgactttgagaaattacaatccctagtttttgtacatgtttcacttactttctgcatacgatttctggcttacttgactcttaagttcttgctgccagtcttgcctctgcagcagtccacattctctcaccaccaaagacataatgtcttgtggcttccccacttttatctctttgcctgctactcaacatttgttctgcaccagatgaaagtcactgttttaggtactttttaggggtacataaataattatttccttcaagaagccagcaatctgcataggaaaggttcacaaagcaattttgaaataatttaataagtctgcataatggattatcacatgagctttgtaatttatactattttgttggaattgtatagcaatatttataagttgttactatttgagaattcttgtgtcttaaatcatcttcctattagactgatatacaagtctccccattgaccacccccaatgccaaaaagaagcatgctgtgaacactgcaaagtaaactattagaaattaatggtcactacctataaagatagcaaaatactaaaggggtggtattttatgagcaatggaaacttttgttgtagatatttcaactgacactgtgcctttattactactttatacctacatctgaagatccagactctagtagttgtaatacaatagatgcaaacagtgggaacatctagttcttgtcaatgtgtcaccaaaacatattatcaaagctaatctcataagggtgtcagaggaaattaaagttgcctttggctgcatgttataagaactgactgaaattttaaactacctcagtagctgactatatacagcagcaggaagccttcaattaactgcaccagttctatttgtagtacaaaggatctatggcttaggatagcctacataacttaaaaagaaaaaaactcaactagatcttaacagtatcctgaagtacagcctgagagaaaaggatagatagggtcagataggagcatggagcatagtaactaattcaaagacaagggggtcttaggttgagctttaaaaaatgttctgtctagtcaataagaaattcagagacaatgtctttgaaagaaaggtaagccagaatgaagagtagcagtctacattctagagattataacaataaaagtcagcaatattaaatgatttagtatagaaaaaggtgagcttttacaagaataatggatagaaaagagttcttgaggttattaagtagaaattcacatggatttaataatgaaagatcatttccacatgatcctcaggccctgtttcttggactgtaattaagaagaaaaatggaagaacactaagagaaaggactaggaagtggtagtggctctaatgttcttcttttaccttttgaaatgctacctgatactaatttttgagaaaaatttgttggagagtgaaacttgcatgtcttttggataattttatttaaaggtgaatgatctcaattttaccttctttgtttttcacagttgcctccctctccttttgctatatggactatatgtatctaagtaagttaatgttggaaaaaagtttaaacattgagaaaattactgagggtgtctgggtaatatctcagaattagatttgaaagtcactgaacgatatgttgtggctcaatgaggaagttgttagatttgtgataataccgaaaaaaatccctcttttggttttatctaaattagcattcacaatacaaaagtcattctaagaattataattaggagtctgacattttacacagaatttggtagttatttttggtaaataatttttacagaggatgtttgatcaaattaaaatgtaaaaattttaaggatcaacctatgattttcttgtattaatatattcacgtgggatctaaatgctgaaaaattgtattattattttttctagtttcaaatctaccagaatgtttatctataacaacttctatacagaagttgtttaaagttcatggaaactatcttctgtaggagacagtttacagtttacagttctgtaaaatgaatcataaaatccagaattttgctccacttgtcccattactgatccataaaaactggatttaatttctactgtagttatttttaaaaaatacacatttggtaccttaagaatgaaataattataggtcgggcatggtggttcacttctgtaatcccagcaatttgggagggcgaggcagtaggatcacttgaactcaagttcaagtggagtttgagaccaggctgagcaataaagcaagactcagtctctacgaaaataaaaataaaaataaaagtaaaaaagtaagccaggtgtggtggcacatgggaagctgaggtgggaggattggggaggtcgagggtgcttctgtagaagttttccatgaagtatttttttttttttaaattaggtcgaattaatttgcttatttttcagaaaatagattttggagctggtaagaagaaatgagaaatactaatatagcatattagaacaaataacattttatataagtgaaaacagaaaaaaattaggtaaaatgatatatttataagcccagtgaaggaaatggaatgaattatcttctgggttttcagaccaaatggactgtcagatcctttagttaaaaatttgaaatatcacctttaaaattaaggtttagtcttctcttctttgccactttacttacttttcagggcattaaaaattacttagcaaactcataattatgtaccagaataattccctttaataggaattttattctaggaaatcatttctaaaagtgataaaattttaccaatttacaaatacttttgtactaacagtattaataacaatgaattttatagtagtgatagatacataaggagacaggaatcgatgagcatgggacttattatggaatatagttgaccatgtttcaacatatgaagtattattagaaagtgatacctctctacctccactcttctttctaactttaacaatttcctgcccagtctagggtgtgcatatttggaattatacctatttacaaaggaaccacataagtaaaaaacatgagataaaatggctattttagccatcagagtttttctggggtatttgtattacatttctgttttcttgcttgatgtctttatccttctgtcatgtgaatctctttattcccaaacatttgtctgggtattaaaccttttttcttatatgactcaatgttaagagagcctcaaacagctaaacaaaataacaatgagtggaaaatttctgtagccaagaagaaaattaaaaataggagacagaaaataaccagagaagaaaaaaaaaatcttttgaaaaatggtcaaatgtcatccagataaccttccaaggaaagctgcctctcatctccttcccccttcttttccttcctcatcttcctaaggttgtcagttggcataggacataaaagtaaataaaaagatgggcataaaagcaaatcaaaagtggtaggaaagcagccaataaaaatggggaggtattgtcccagaataaggacagagattttactttagccaattccaagttaagttttcatccaacacttagtttggtatttacatgaatgcttgtatagatttccaaagtagatgccaaagtagattgaggaagttagtggattagtccctagggtttgtttgttaaaagaatttgagaagcttcccataataactttaacataacagaaaagaaaactgataattgtgtgtatttcgtgtatttatggttatatacattatgtagtttatttcatccatagacttgttttttctcaatcatttctttagttgttttagaattaagaaaatgcattcatacattgttgaggaaagagtcttgaactcattggattcaccaatgtttaaaatctttattgcaccaatttttttaaatctttattggttttcattgatctgatgtggttcatgattttccatgacattcactcttttaaaatgaatcataaaatccagcattttgctctgcttgtcccattacttatccataaaaactagatttaatttctactgtaattatttttttaaaatacacatttagtgctttaagaatggaataattacaggtcgggcacggtggttcacttccgtaatcccagcaatttgggggggtgtggcaggaggatcacttgaacccaagttcaagtggagtttgagaccaggctgggcaacaaagcaagatccagtctctacgtaaatagaaataaaaataaaaaaaataagccaggcatggtggcacatgggaggctgaggtggaaggattggggaggttgaggctgtagtgaaccatgatcatgccactcctgttctgcctgggcaacagagtgagatcctgtcttaaaacaaaacaaaaaagaatggaacaattataaaataatgtatgttctatctgaaaacaatgtcgttaacactttatggaagctgtccccagagttgagggacacttgctgatgtgaagttagccaacacatgactgcttcagaatagaaacaatgttcaatggtgttgaacaaaaaaaaaatgcacccttgctaaagctacttctaatgctgtgtagctctaacaaatgatttatactggttttccatttaatgagctggcagggaggatttttagctactgcaaaatcttctagaaaaaaaagaaacttgttgagaagtctctgaaagggtgtgaagtttcttattttacattcattaactttttattttattcaaagttcagaaataggctattggtcatgcattgtgaactcaccatctggctccatccagcttcctgagggatttcccccagtgtcacagtcttctgatgtacttcatgtttgtaaaagttttgaatgcttaattatatatataaaatatatatttatatatgtatgtgtatatgtatatataaatacatatatgtaacacttataaaagtgtgagaatttaaatatagatacatagttaaaaaaatcaatcggtatataaaggcttacagtgaaaagaaattatcctctatttcacttcagcttcagcccgactcgtttcagtactccagccctgcctcccatattagccattttaacaattttttactcgtatgcttctagtgcaacctctctgtctttaaataatattcttgctttattcactttcagcattgtctattgacttaatgcatggtaataagaataactcaccaatttttctcttttctcccctgcttcaaactatacttactttattcttagttcattcatttattataataattattattaattagtgttcagaaacctcaggaagaataattctcttaactggtttctaagttgttgagatatgtgtggatctgaatgatttggaaagtaagtaagtggactagcaaactgtaagcatcatataaatatgctttattaaggaatgtggttacactcaaattactcttttacttaagaaaataagaatttaaaccacttgacataaactgcaggaaattgttgaatgatttatcttaatttaatttctttaaattctttcctgtgatgtgctaatatgtatgtaattaagaaccaaatgagaaatgtactcttgaaaaaaactttaagttttgaaaaccttataaaaatataaaaagtcatttttcccctatgattaaagaaaatcaagttaatgcatgacctatatgttgctccttgacagtctttaatagacaaaatactggatttcctataaataagaaaatggaaaggaaaaaatcctctgttcctttcatacttttaccccctaactctttaactatacaatgtagttcggcctctaatgtgcttgtgtaagcaaaactcaatacccttaacctccgagaaccacacttctactgttggagttctattgaactccatttcaatgcaaacaagtaaaggaaatgtttaaaaagttgacgtgtgatgagaaatgaactcttttatgttttgtcaaaatttggtgcttctggaaaaaaattgtcaaatacattttttggtccaaagctttcattttatatttaaagaattaaaaggctgggcacagtggctcaagcctgtaatcccagcactttgggaggccgaggcaggtggattacctgaggtcaggagtttgagaccagactggccaacatggtgaaaccctgtctctactaaaaatacaaaatattatctgggcatggtggtgcacacctgtagtcccagctacttgggaggctgaggcaggagaattgcttgaacctgggaggtggaggttgcagtgagcccagatcacaccactgcagtccagcctgtgagacgccatctcagaacaacaacaacaacaaaaaaccaaaacaaacaaacaaaaaaccacaaagaattaaaatacttccatactaaggcatcacattttggccatccaggaacactgttgcctacagtaagattatgagctctcctagaggtatgattctaaagcaagattaatgcatttgattatttctggatacagggatgggaagagaagtggtctaattattcatttaaaatataccaattccaaaaattaatttgttctttcttgtttaattatatgattttcttagaacatcataaacttcttgtttatgcctcttctctctactctgaatattgactatcgtgagagctgttcaggcattaaacaccgatttgaattttgggttctctatgagtgaacaagtaaaattatcaaaacgttatatattgatcctataccgtttttgttttaaatcaaagtaagtcatgcatttagtttaaaaaggaaaaggtcttttaatgaaaatagcagttctctactctgcctctccccaatcctccttttcactccacagcagcaactaccttcaacagttctggctttcttctgtttttttttttaactttaatatttctaaataacatatccgtttagaaaattatttgtttatgcattttaagcactatgcattgttttctcagcctgtgagatgaggaggttcccctgtacccatatgtgttcacccacaggagtgtgcttgtgtgtgtgcacacacacaaatatgtacacttttcttctctactcttcccagtagttgaatcaaatcaatagtatttatatgactagtcaaatgtttactgctgaaccaagtcatgtattataaccatgtcaattttcaagttcaacttaggcttttttctgaagttcattgcaaaatcgtaccctctatttatctggttttgtatacttgcatgtttctaccatgtgcttaaaaataaatattttccacacctgcagcacttcaactctattttctccgggagtttccagccttctttctctattgggaactaattgctttaggctccccactcatccttggtctgttcctttgctgttcttttgcgtaatcctctctttcttggattcttgtagcttctttgtcggttttatttttgttttaattttcagaagaatattttacaatagcttatatttgttgaatttttacatacctgaaaatgtcatttttctatctttttcaatgatagatttgtatgactgggcatagaacccttgtggaaaattattgtgagttctagtcccaatttgactctctttcctttgcatttggcttccccaacacatttggaagctttttagaatcttctctttatctctgtggttctaaaattgtataacagtgtatcttaccttattcattttctcggttattctatggcctctttcaccttggaggcttatgttttcagtatttagatactcactcgaattattttcctttctttaatataacttcttctcctttgtgttctctactcttatttttctgcagttcttactagttcagtgttagaccttctgattagagtctaattgtattttctttcaggtagatttagttcactttgtcttcaagaacatttagtgacattttaatttaagttactgagtttttaatttcaaagagtttaaaatttttttttaagtttttcatcaaagtgcaccgttctttattttaatgtagtaggtaacttcctctattcgatagaggctattaattatagttaaccacattttaatttttctgcgtgcactttatactttttctctgctctcctcctttcatgtttgttttgatctctcctgcgtgttgggagccttcatatttaaaatgagcatttgatctttggaagctcatcatttgtgtggcaattgtagcatagaggggttctggtatagacggcatggacatttagcagccctttcagtgggtacatgtgtgtttgtgtgtatgtggttagaaagaatccttgcatgtgcaggcgtgatggctcacagctgtaatgctagcactttgggaggctgaggcaggagggctgtttgagaccagcctggacaacacggtgtgaccctgtttctacaaaacaacaacaacaacaaattagccaggcatggcagtgcatgcctgtagttcctgctactttggaggctgaggcaggaggattacttgagccttagaggtcaaggctgaagtgagctatgattgtgccactgcacttcagcttgggtaacagaataagaccttgtctaaaaaaaaatttagagagagagagaaaaagagagaatccttgcgtactagtgtctgcatttctcaccttatgagtcgttaggtgtctcaaggaaagaattttcccagcttctacttgaaggcaacgtgcttgtttgccagagctggggaagtagatgggtgagtgtgctttgtggaactgcactcgatccaccactgtgcagctcttgtgtcccacgtttctgctagagctgtggcctcacctcagttttgtttgtccagggaataactctttattcttctagtgaaaagaagggtagtaaatacagagagtggcagggacttagagaggaggagaaatgtcttggctgtgagggtatgggcatggtgatttaaggatgctacaatcagaccttaaaccagtccctgcgcttttgaccttgcgcttgaccactcgtcttcctctgtgcctttctgcaagttctgaacctcttagggattctctggcatgaggctgcttgttgctcactcactgcagttacttcgggttgtgctttctcctttcagtggggctgttaatcactatccaactcactttccatcttcagcaattcactgaactctcctgctcattcttgtcatctcttccctcttctttttttgctgtaggtttatagcattttaattcttttactgtcattttatggcatttctgaagggagtagaaataaatgcatttggtcaatccatcatttttattcagaagtcatacaatttttaaatcacccccaaattgatataataaatattattgttgatgttcttattattatttataatatgaaatattttaagttcataatactggagccattctgagaaagttcctaaaatagactactgcggaagcccattattgccatggacctgatatatttacatctataattttaatgaggatgtcataagattaaaatttgtgatggacatttgtgatctctctcaatgatgatctctattatatctacatacattcatttctttattaatagctcatccatgcagaactcaattatccaacaatctcattttattgataacaaatgctagaaaaagaaagtatcagaaatggctttgaaacaacgtttgcattgaatctacaaacatttttctggggatagcccataaaggcattaagcaaaaaaaaaaaaaaaaaaaaaaaaaaaaatttacttctatttcataaccaagtacaacagcttttgaaatttacatttcaaatacacagaacttagcaaacaaaacagaagaaaataagagggagcctgtgaacagacaaggaatgatcaatgaaactctacaataaagaggaagagaggggaaccagatggtagccaaagcaactcacattcctattaggagcttgtaggagaagctgtagatgccccactcaaacctcccagggctctgtcatttttatgttccccggcctggctcttgtctgcataaacctctctttgcctcagagctttcttttgtagttcaagcctacactgcaacccaggtgcatgacaggttaaaagtgccagagaattaatgccaccaggaagcagcctgcaatgaatgactggcagaattgatgtgtaaatatcccagcttccttgccccttggttaagtctaaagtatgtgttgtgcactggtgaccagaggtccctggaaggatgaagctccagttgtcactgtggtaatctgcctgctttcttggctgccttcctttactgtctcatttctctactctactataagcatgatgttttcccgaatcagctcccacctaaaccacaaatttgaactaaaatttgtaacttaatttggaagagcccaaaataagaaagaactatttagatttggagaacaattacgtattcctcaacaggacattattatatgtacaaaaagtgaaatatttaattttcaggatgacccacattcagtgaggaaacattcagttacattcaatatattctatttaagaacataaggatcatgtatatgtttaagaagacttctacttaatctagctaatacattatggttccagtgtttgacctttacttatatggaaatttaaaccaccctgaatgattcatctgattaaaattctggatatataagagctcttgggttaaggaaaacacgtgtgaatgttaaggtactttaaggaaataggagattattaactaaattgtatacaacaaaaatcctccataagcctctgtaaattcaagagaatatactagggagggtattaaataagttagttatagttactactcttttggaagatagaatattctaaaatatttaaaaagttaacacatttatgaaataaatgcttgcataaaatactatgtgtatatctgtgtgtgctttctcccagcttcccctggaaattagtttactagaatatccttattgctaacacatttccacgttctcctgactctcttgggatcatctgaactatggggctaacttactctcactctactacaaaaatttaactaacaggaataatcgtaaagcaaacattttaagtgtatcctgaataaaaaattgtctccatgcttctccattctgctttctcatcttctaacaaaaactaccagaagagactaaggactaaattttgggacaggtgaaggagagagttgaatctctctgccaggagaatggaagaaacatatctgttatcgttgttgtttctagaggaatggaaccaaactaaggggtttgggatagaggagaaaaggtttggaaaaggaataagagagaggagccaatagacttgaaaaatagcttgtatcgaattgcattttacagtgattgtgctgcactcatctccaatgctacaataaaatcaaatgcccacaaaaagaccacaaattaatgagtgatttatttttaaataaataaaataaatagggatcaaaagcagaaacttttttttttttctaatttctgtcaacaacagaatcaatgccaggacagggataaaggtggaaaatgcaaagccaaaaacaataatttagtggaaacaggaagttaaagccagaagtaaccttaaggttctaagtccttggaaattcccttacatacagagaaagccattggatttttgtatatggagggaatactggttcatcccagtctgacccaaaagttatgcgggagaatagttaagttccagagagatgtagctaatgtctgagtatctacttagtggccacagacattgaaaatcttgaaaatgcccaaatcttgaacttgagcacttcagttttagccacaagagtgaagaggtagaccagcagctttcctaaggcctcagttgatgggccttgccttcagtccttcataacctcaggcagcatcatcctctgtgcccaacgtgacctctgctctattctgtgcttcacaagcttaatggacttactttgtagtagaccactcattcttctacagtcttgattgtatggaaagagggaaactacagtagtttttttctgtaacaattgtctgctgttattttctgtacatttctctggcattcaccctgaattcattttctggtcatgcattaacttacattctcccgtggggtctcactttccatttagtcctcctgttcctagacttgatgatgtttatctgtgttgtctggtatcctactagtgacaggtcctgtttatcagtttgctaattatcacacagctcagccacagccttgtgaaataaacatactagttaagtatggtggtatgttaaggagtaaaagtaaagtctgtgagttgcatacttagaaaccgtgacaggaatttatcgcttcattctcattgacatttatgttgtggtagatgaaaggacagtctgacaagaagagagcacgtgtttgggaatcagatattcatacacttgaattttatttttaccccttactaactaatagctatttaacggccatgagccttaattcccttgtgaagtcaggatggtaatacttgactcatgtgtgcagttataagtaaaaggaaagcaccctctacatgataactttcacatgataggggtatggataaattatgcttgcaatagcatagtcataataatacttttaaattagtgactcacttccaagaatggagtataggaaagtgaaaattgtaaaattataatgaagaaacctggcagaaacctctttaaccaagtttcattctgttttctacttctgtgttagaatgctggagactgtgtaatttatagaaaaaaagaaatatatttcttacagttcaggaggatagggagttcaaggtggaggggctgcctctagggagggctttttactgtgtgatgcagaggctatcacatgatgagagggcaagagcatgccagctcaggtctctctttatcttcttgtaaagccacaagttccaccatggggcctctaccctgatgaccttatctcatcttaattacctcccaaaagccccacctccaaatgctatcaacatatgaatttggagattaaatttcaaacaaatgaaatttagggaacacagaaacacattcacacaatggcaccaagttatcaaggtgaacatcaccagtgataagtcatgtggctctactctacttatgtgggtgtgataggaagggcacttcacctcgttgtttttcccccaaatttatatcctcagtccaatcacaaaaaaacaccagacaaattcaaattcaggaatattctataaaatacttgatcaggaatcttcaaaaagcatgtaggtcatgaaaaacaaggaaagatgggaaactgtcacagatcagaggagacagcaagtaaatgcaacctgggaccctggattagatcttagaacagcaaaaaggatactagtaaaaactgatgaaattcaaataaaatctgtagtttagtaaacggtattgtactcacgttaatttctttgttttaacaaatgtcttatggttatctaagatggtaacatggaaaactgggtgaaaggtatatgggaacttatactatcttgaaaacttttctgaaaatctgaaattattccaaacaaaaagtttgttgttgttgttgttgttgttgttgtttaaactgaaaaggaaaaacatttggtaggtaacagatcagtggttgccaggggttagggtacggggagcataagggagattttaggggtgatgaggctcttctacatcttgcttgtgattatagttatttgaatctataaatgtgttaaaatgaggacaccaaaaatgtcaattttaccatatgccaatttgtttaaaataaaacaaaataaaagaaacaaatgtcaatgggaagcataagtactttttatagtaaataaggcaaaaggggaaaatgttggccgggcacggtggctcatgtctgtaatcccagcaccttgggagactgaggcgggtggatcacctgaggtcaggagttcgagaccagcctggccaacatgttgaaaccgcatccctactaaaaatacaaaaaaaaaaaaaaaaaaaaatagccaggaattgtggtgggtgcctgtaatcccagctactcagaaggctgaggcaggagaatcacttgaacccgggaagcggaggttgcagtgagccgagatctcaccactgcactccagcctgggcaacaatagtgaaactccatctcaaaaaaaaaaaaaaaaaaaaggttgggtgggaaagtttatagacagtgtaaaattgctgccttctttcttacatataacactgtcatcatcaaattgaagaaaccttattaaatatatttattctttcctttaacaaatattcattgaatcctaatggtgtgtcaagtactgtgctaagccttgccagtagacaagaacttgatgtgttctagatgttaaaagaagcccttattccaagataggccagcatatactattaaaaagttattgcatgaagtcagggtgtagacatatcgggggttaaacagacatgaaatatttacatgatatttcaagataatgttggtactctattaaacaaaatgaattatgatgacataagttaagaggagacttaagacagccttggatgtataaagaatttttgtgaaggaggtacagagaacttgcagagttttcttgtctgtaatgtaagactattatatttagaaaaggaacattgaaatttaaacaatgtaatgtttttagttcaaaagtatattaaaatacccaacactaatgagcatttagcataagtaaaacactattgtaaggactttacatatgttaacctacatgattctcgtaagaattttagaagatagatactattatttcccctgttttatagataaagaaactgacaccaagcatgtaatgtgcctaagatcatacagccagtaagtaagaaagccagaatttgagtccaggtatttgactccaaagcacacactccaccatactaaatacatggcatctatagtgatggttatttaactttcccagctggaaatagcattaagtgtttcaaatatccaaggaaccgtgtttttttttttttttttttttttttctgattgaaaatacaactggttataacatttgtttttttctggaagcagatagcctttgccatgccttccagttggcaccttgccccttgctaatatgcatggatgggtgccttttgctttgcagcctgccagtagaacgtgaccttggcagcccggtgtgccagccaagattccagaagagcgaaagtagctcttaacttcttgaagaaactctttgaatcaccaactatgccttgccatatctgtccacatggtactagtcctttcacaaggggctcccaagctaatgactctaattggggctcaactgtctctctaatacattctttccttaattttatgtttttctctggttggaatttcctaatgtctaaaatattccattctgtgttactcagcaacgatcttatttgcttgcaagcattgtggtgacaaacataataattaattatgtggaattttgtttagaaatatttttgttggaacagaaacaggaattctatatctgtacagtgactgaaatacaagggccctctctaaatgaattatgtgtttaaatgttcagattttatagtctatttaatcctgtaaatcttaataataaatttgatggcaagcagactgtgagtggaattttagataacaacatatgttcatagtgattcatgaaaatgtaatcctttatggtaaatctgtattatttataccaaatctttctctctggcctagaccgcttttttaaattccagacttcctacagatatatccatttagatcagggtttttgagatttgatgctgttaacattttggactggccagttctttgttgtggggtgccatccttcccattgcaggatgtttagcagcgtctctggcctctacgccctagatgccagtagcacaacactccactctgtggtgacaatcaaaaatgtcttcagaagttgccataagaccccggggcaataaaatcatctctattcacgaaccactgatctcgatgttctataggcttatgaaaaatgacatatacaaaattaaactcattttccccttagagcttctcctacagaggggttaggagcatatctgaagcaaactctgcctccctgctttgatagctgtggaacttgatcaaattaccaacttctctatacctcaatttcctcatctctaatataaataccttaataaaacctccttcatatgactgttaggaggattgaatgaactaatatgtataaaacatttaaagcagttcctggcacataggatgcctaagttaatatttgaataatcaattaatactattaaatgttagcaatagtcctacagtacaggaaaattctaagatttttctttgtatagaatatgtgcagatacttttttaaaaagattaataagtgacagtaaatacatgcaacaaagctcaacatcattaataatcaagaaaacacaaaataacatcatgatatataaatctattaaatttggaaatatttttaaaaatacttcatattaataagattgtggcaaaaggccctgtactgtactgatgggagaatatgtgtctgttttctttctggaggatcagttaccactatgtatcagagcattaaaatatttatagtctttcacagagttaatctagctctagaaatttatcctaagtgtgtaatatgttaaaaattaatgaagtatattaattactgttatttataatggcaaaattagaagctacctaaaatctcaataacgggaatgaagaaatagctcatggtatatttatgtcatgcaatatgtagatatcacattttacaaataataaattaggagaatgctccgactatggtaattcttagttcaaaatgcctccatcactttcaagataataatagaaatatttaagtgtgcattatcatgcacacataaacatacaccttttaaagttattttttgacagaccctgtgtatttatcgagtcattttttctctctaggtttccttccaaattctctacccacacaccttaagagattctgatacatcataaatagagggacatacatctttacatgaaaacgacatggaagattttctgagggacatgtgaatggtgaatttgcatgatgtggagacccaaaatggctgaggactgctgctcagtgccccagctctgttcactcgcctagagtttcctcaacaagccctgctgcttctgtcttctgagctctgacccaccaagccatttcctctacttggagtgctttccttccctttctgcttttcccttctcaaaaccaagctaaaacattgcctgctctatgaaacttatcctatcaccctgttcagatgcacatgcctttcttctctacttttgtgacaccacatgcagatctgttcatcatattttctggtattcatttgtttaaaaatatgaattgagataccactaaatgccagatgctatattaagtgctaactacagtcttggtgaacaaaaaggtaaaattttcctgctctcgtggggcctgcattcttatggaggagatggaatatattttttaaaacataaaatctaaatttattttgaggtgattttgatcagcacctcaaagaagcaagagggtgaacagcagtaatatctgagggacaagcattctaattatagggaacagcatatttaaaagtcctggactcgttcagtgtattttaggaaaaaaaaaaaaaaaagaaaagtggcttacaaggttgagactagcagaagtgcagcaagaaatgtgaccaggaagacaccaagatgctgtatgataaagtcctgaggccactgtaagatctttggattttaatttaagtgtgtagaataacatgatcttatttacgtagtaaaatactaagaggcaaccttctggctgctctgtaagaagggattgtaggacccaaagtgaaagcaggatggtcagctagaggctgtcatggtgatttagctaattgatgttgctggcttggatctaggtgacaacactggaggtggggagaagttatcagatttgaaggatattttgaaggtagagttgataaagatctcataggtttggtataggttaaagaaagctaagcctcaaggacaactctttaagttttgggcttcaataattggatggattttggtggcactttggtgaatgctgagtgaaggacatgtttaagaatgaaaacatgttaatagattctggctgtattattaggtgtgagatgccaaccaggcatcaatgtggagatgttgaagggacagtgtttaggaaaagggtcagaacagagatatgtatttgggcatcatcctcatatagatagtacttaaagttatgatgctgacatgcctaccagggctgtgagcatagtctgtgaagatacaagttctgaggtctgaactctgggacactccaccatttagggagcagaaagagagtctaacaacaacaacaaagatgagtatgagtggttaatgaattaagagaacaggaggatgtggactattagaaactaaggaaagacagtatttcaggaagggggagctgatcatctaggtcaaatacataaagaatttaccactggatttgcattgtggaggtcattgccaaatggctacctttgtcagagccatgatgctattccttggcaaatgttgacttacttatctgtttcttccaggaaacctgtgaacctcacataggagtgattttgccctccaggaaacctttggcgatatctggagacatttttggttgtcaaaactgagcggtggtggagtgatgctactggcatctaatggatggaggcacaggatgctgctgaacatcctgcaatgcacagagcagctcccccacaacaaaataatgatctggctccaaacgtcaatggttccaaagttgagaaatcctgcactaaacgtatggttcccaaagtgtgtgcttagacaccccagggtggacataggagtgccgtaggacattttaaagtgtgaatggaaacacagtggcatctgtcaagcactaaatgaactactaactcaagatagttcacagtttcaacattagctttctttttttttttttaaataatgtctctttgtaaaacttggttttggaagttgctgtgataagaatcaaatacttggtgaatatcactgtggaataagaagtgagaatggcagtttccaatctgacttcaaggtttgtgaagttgggtagtgaccagaagttgttgagtttttaggacgtaaatagttattaaattgtttggacttgacaactcaagaaactcaattattaggtatatcttttggcctagggggtgtagtaaaaaattatggatatgccacgggcaccataaagcagaaggcttgaaactgctgggcttgactttaagttccttgggaataggcattgtgtattagtactttatatctgcagcacccaaaacagtgcctgctacaagtgtgaggtgcgagaatgccaaacagatatccataaggagattgagggaaatttaataaatttaagaaataaaatggcaggtatgaaatgaatgaaagggcacatgtgcactgtagtgtcaagagaattatatgttaagtggcaaaattcgacctactggttcactatgcactacaacatccctaaatacctccctacttatataggataaaataagagaggggaaaagaataaagcttgactttcttattctttggcctgtgaatctctagactaaaatttcttgagtttggtgcaagtttacttcctcagattacattattttttcccaatacaaatttctattctcacttatattatgcatattgacaaaactgtgatcttattctgcaggaatatgtgaacgggagtaatttgaatatctcctaaatttttggctgcttttcttcctgccccttttgccaagcactacatgccctagcctaatgattgcatagatgttggaaagagatgttctttttagagttagtgattctattttgtttttgaaaaaaatcttttcagtgtaagaatatgatttcagaatataaacttgtggaaatattcttggtatagtggcaagaagtcagcttttagaatgggatatatagtcccatgcatctcactctcactgggtcacatctggatcaaggcataaggtttctttgactcttagatttgtcacctgtaaactcggaatacgaactctccaagttcttatgaggattagactagttagctgatgacaagtacctatcacagtgcttgacacaaggagatactcaataaattatagcttctccttatatttcaacctgacctatcctgacaccttctttctccttctcattctcttagtcttttgtttgactttaacacctaggatgaagcttatagaacttattaccattttaaaataggcaagttgtttgctttgttggtattttgtgttgtatagtgatggggtggtattttccctattaataatgtagtgcatcaacaaatgtaaatatattcatagaaagttctccagcagggacagagttggagaatcgctgagtcaccagtctcccctcacctgagagtgttcacagtgaaacttctctccgttgtgtgttttgtggccttgcttatttgcaatggtctgtcctgaagaatttgagattagagaccccgtggataatcatattccaaggtcaccagtaaaactaaatttctgtaatagttataacttctactaaatatttttgctagagcagctaaaatgcagtctgcctgtgaaatctggctgacttaccttattcagcctataaaagttatgtttactctacagtgtagtcatttaagtatgtaacagcattagcctaaaaactatacatactttaattaaaaattactttattgcttaaaattgctaatgatcatcttcactgagtcacaaccttttttgctggctgagggtcttgcctcaatgtcgatggctgctgaccaatcagggtggtggttgctgaaggatagggtgactctgacactttctttttttttctttgagacggagtctcgctctgttgcccaggctggagtgcagtggcacgatctccgctcactgcaagctctgcctcccgggttcaggccattctcctgcctcagcctcccgagtagctgggactacaggcacctgcaaccccgcccggctaatcttttgtatttttagtggagacggggtttcaccatgttagccaggacagtcttgatctcctgaccttgtgatctgccctcctcggcctcccaaagtgctgggattacaggcgtgagccaccatgcccggccgactgtggcactttcttaaaataagacaacaatgaagttggctgcatcgattgacttttcctttcatgaaagatttatctacagcaagtaatgctgatgtggtttcatagcatttgacctacactagaacttctttcaaaattgaagtcaatgcttctcaaaccctgcttctgctttatcagctaagtttatgtaatattctgaatcctttgtcatcatttccacagtgttcacagcatcttcaccaggagtagattccatttcaagaaaccccttccttccttccttccttccttccttccttccttccttccttccttcctaccctccctccctccctccctccctctctccctctctccctctctccctttctccctccctctctccctccctccatttgcattcacaattttgtggtttggttcaagaggccttgctctccacctgtcttggctgtcaacatgccttcctaactcagcttaatcatttctagctcttgattgaaagagagatgtgcaactctttctctttcacttgaacacttagaggccattgtagggttattaattgccctaatttcaatattcttgtgtctctgtgaatagggagacctgaggagaggcagagagtcagagactgactgctggtcagtgaagtcggaacaccacacacaacatttacagattaagttcgccgtcttatatgggtgtggttcgtggtgctccaaaacaattacactagtaacatcaaagatcactgattacagattaccctaacagatataataataatgaaaaaaaattgaactattgcaagaattacaaaaatttgatagagacataaagtgagcacatgctgctggaaaaatgacactgacacacttgctcaaagccgagttgccacaaaacatcaatttgtaagaggaaaaatatctacaaagcacaataaagcaaagcaaaataaaatgagatatgtctgtagttgtatctggtatgtaattagctcttggatttattgctttaataagtgtatgtgagtctattggtgtaaccttcactatgtaaaaaaagcaacacttttgtaacacatttatgacaaaggactcatatctaaaatgtataaataactcaacactcaacagtaaaataaacaaccagagcaataaggaaatgggcaaaaatattaaaagactgttcactgaggaggatatacaaatatcaagtaagcacacaaaaatgtaataaatatcagtgggtaaatatatatatctctatgataatagctggaattcaaattataatgtcaaatgctagtgaggatgtggataaattggagcgctcatacattggtattgggaatgtaaaatgatactgctattctggaaaatagtttggctgattctttaaagatataaaaaataggccaggtgtggtggctcatgcctgtaatctcagcactttgggaggccaaggcgggaggatcgcgaggtcaagagatcgagactatcctgaccaatatggtgaaaccccatctctactaaaaatacaaaaattagctgggtgtggtggtgcgtgcctgtagtcccagctactcaggaagctgaggcaggagaatcgcttggacctgggaggtgggggttgcagtgagctgagattgcaccactgcactccagcctggtgacagagcaagactctgtctgaaataaataaataaacaaacaaacaaatttaccatataagccagcaattgcacttctggaaatttgtcctacaaaaattaaaacttatgttcgcacagaatattgtgcacagttgttcactgcagctgttttcatttgaaataactcaaaacaataaacattcacagtgtccctcaatagctgaatagttaaacaaactgtgtggtacatccatgccatggaatactgcattgcaataaaaatgaatgtactgttgatacagacaacagcttggatggacctctagggcattatattgaaggaaaaaaagccaatttcaacagtttacatatggtatgcttcaatttattaacattttaaggatgttaacttcctgattttgatattgtactattattatataagatgtaaccattggggaaaactaggtgaagctttcacaggattcctctttgtactacttttgcaactctccaagaatctataattatttcaaaataaaaaggtggttttttttttttggtaaagtcatattttatgcacacgcacacccacacccacacatacacacagtttcttatggggaaatgttattttgaagtaaattgggaatgtaggcatttcatttattctttccaaaatcatttgtttctacttttgcaggattttttttcttcttcctcctctttctctcccttctccctagttcttttttttttgtaggatactgagatagcttacttttcttgcttaggaatgccttcattttttggaaaggcattctttattttttttttaccattttcaactcaattttagttatttaattttcctgtcattataatttggatatataacttctttgagaagtgcagatcatttcatagctatctcattctttataactcaatctttttgttttttaacagattagaacctaaagcagagaaagttagtgatagaaagcatgaagtagagtaacaaaactgaaaacagccagttgccctaccaacctgttctgctctattcttctattttttactgtactatattcgatcccatttttttcgttccattctatgttatgatttcccaacctatatgtattccattcatcctgttctgttccattctatgcaataaatatttaatgagtgtttagtatgtggcaggtgttagtctatgtggcttggcatgtaccagtcaacacaacagataaaaaaattgctgctcttctaaagcttacattacaagaggaggagacagaaacaaaacagacttaattcgtaagtaaattttagaagttagtgagtgctatggaataaagaaagagttaagtaggtgggggatatcaggtgggaatggagggaaagttacaattttcaaacagggtaaggtgtgagaaactgtaaggaattttgccataaattgatctgagcgatgcattttctgatcactaagaatagcaaggccaaaggcactaggatgtgagatgcctggaatgtttaagaaacagcagggagatcagagtggctggagtagagtggtgagaggagagtaggtgcaggtgaggtcagataggaaagaaagatctgactacaaagggcttttgaaggtgttggtttttactctgagcaaaatagtcagccatggcagggctttcagcagaagaccacatgatctcaattatagtttaggaccctagcaatcctgttgagaaagacattggcttattctatactcttagctgtgaaggtagagagaattattattcatattattaacaacaaccacatacatcaaaaaaccctcaggatattttgaagatagagtcaaagggatttcctgatgaatttaatacagattgtgagagaatggaaggggtaaaacatgattccaaggatttgggcatgagcatctggaaggttagtgttgccaacaaccaatatggagaagatggcatatggagcaggtttgagggggaatgtcaggagatctttttttagatatggtaactttgatatatcttttagacatacaagtagacattgcttgtaggcaggtgggtatatgagtctggagttcatgaaagagatccagggcagagatacatatctgagagttgccaacacatagtgatatttatcatgagattagatgaggttaccgaggaagtgactataggtggagaagaagaccaagaactaaaccccggggaaccagagttaagaagtcagggaatagacaaggaaccagaaaatgagacaagaagcaactagtgagatagaaaccctgacaatgtgtgtcctctcagccaaaagaagaataagtatcaaaagcgatccaattactaaactgtgtctcttacctcagtgcaaatgtgtatgatgtgattcaatatcttcctgtatccctaattttatttttattctatttttatactggaaaacaggatcattttttgtttgaaatttagcctgctaagaaaaagtagactttgttgttattgttgcttaagtttcaaacagaatcaacattgtttaaaattgttttaagaactagatttggtgttaacagtttttctgtggtgagtctgaatttccttgagccgttatttacagcagaaggtaaccactacacttattctaggaggctggattgaaatgtattttatgtattattatcttaggaaaaagatattaagcatcttatctttattatgatcacatttgttattatcagcatcttctatagatagtactttttgaggctacatgttattgtggacttgtgcatttttaaaagattaagcatttggcttggaattatcaagtaatcctgtgtagtaactgtgattaaaattatacaggaattcatttcaaactgtgacaaatatattgtagcttacactcttattgaatttgttcatatattttatcaagaatgtcaagtatttttacattaggtttatgtaggtttataggtggaaatataaattattagtaatgcaaattatgatcttgaaaaagtagctagattttcaggttttccttttttttgagcctgcagactatttggaaattaatttgcatttttttggtgtgtatttatattgtcttttgcttatattctgcattacaggattctgagtttccacttaatgagtaggctttacagtacccacaaattactgcaacaaagttaaaaaaaaaagcactagaagcctaatgaaatggactgctgagaacagagctgaataaacacaagcttccctttttgcagtgactgttccaaactaagcagaagctgcttctttatttcagggaaggaaaaataatgacccggttttctttatttttctggtgagcaatttaactgctacctccatttggcatattctcccacttcttttactggaatgggctataactgtaggtatggcattctttgccacaatgtatattttccttactgcagtgtatattttgagccatatttaccaacacagatatttactttttctctgagatgtggtctagaagcaattgttcagagagaaattcaacactgactctagaggtaaacctgtacccggcatttcagtgtgtatgtgtgtttgtagaattatcatcaaagagagaagattattcttccagatggcatttaccttaataaaaactgctaatatgcacaagcttgaaaaccatttctaatccaagtgtactggcagcgtgttattttcaggagtagttgcattaactctttgaaccttttaaaaaaattatcttctacttttgaactaggtcttttgaaagataatagctatcctaagtaagttatcctttgagtactgtgcgtgtgcacctttgtgtgtatttgtgctgtgcgtaaaccattgtgtattttggcatggcccaagtcagcaggaaggctccagggctgaggctgctttcatcctctgatacaccctcacaaccttcctgttttacgataattctgaaacctaacgctcctgctacttttaactcagaactgtgtttatttgcctgtggcctgttttattgtaaaataaaaaccttaagaaccctatgtttttagggtgcttttcccccctcaagaacactgtggttgtcttaaagcctaaatgactgtgttttaatgatgtgtaaagattcagtaaaaaataaatcatggcaattttgttttaagaagaaacttttaaaggcaatacgtgctgcagacttcaaaaagtctaatcaaacaattaagaacaaacagtacttgtgtgaacttatcattttattctgcacttttcataacatattaggtgttaagcttcgaaagattctgctttaattccgggtaactattggtaggggatttaagtcacaattatttaaacataagtttttcacagatcttgaatgtctctgggaattttctccccgaggcaaataatagagggaattaaagctgatttgttttctttgccaattgaaattatgagataggtggctgccactgattttatcttacctacgagcatcctacagccccttatgttctggtaatgcccctgatggtgatgcatagtaaatagtggagtaaattagaagagagttataggtgtgatgggagtaatggataagttaaatgccgtctttatcctcaagggacttacagtctggctcagtatttcttatgaagggagggtgggacactattggcattttaggtagggcagttcttttcttgtatggaaatgttccacacattgtaggaagttaagtttctctggctcctgcctagtaattattagtagcaccgttagttactgtgacagtaaaaaataagtccatatatttatcagatgtcctctagagaaggtattaattctaatccttcttccttagaacagttggaagatctgaaatatacactatatgcataagaagtgattatagaactgtattgtctatattgtcgaaactatgttaaaggaatgatgcataccataaaagcgaagaaaagacaggaaaaaaaaaggctggttagttgcctctgtgtacaccaactggtattacagatcactttttttttttttttttttttttttttgagacggagtctctgtcatcacccaggctggcgtgcagtggcgcgatctcggctcactgcaagctccacctcctgggttcacgccattctcctgcctcagcctccggagtagctgggactacaggcgcccgccaccacgcccggctaattttttgtatttttggtagagacggggtttcaccgtgttagccaggatggtctctatctcctaaccttgtgatccacctgcctcggcctcccaaagtgctgggattacaggcgtgagccaccgcgcccagcccagatcactcttgaagatcatgctgattcttctgctgtgactatcctcttctgtctccctccttcttttttttctgccctggataactcctacttaaccatcaagataaactaaattgttataccttccaagaagccctcatgagctttctctcttcttagactgggtgggatgactatgaacctggttcttacaaatcattgggtgcatctctgtcactgtcttctagaattctattgacatcatctgttaagggtcctttctatcttctcagtagcttctatgtgtatattgcaggcaggaactatatactacatctttcttacctagttaaattctatgtgtgaagtgcatattcaattaactgacctgaacttggcagaaacatataaaattgtgtagttgtatagttgatgaaaacatataaaatgtagtttcattattttttgacatcaaattaaaattctgttcaaaagtctcctttaatataactttgctcatttaaaaaagattcttatgccccactgttggaaatataatttggtacaatgcttttggaaagacatttggcagtaggtatcaagagatttacaagttcatggtatttgattcattaattccatttctgggaacctctcctaaggaaacaattctaattatagaaaaagcctgatactcaaaagtctgcatttcaaaactgttactaacagcaaaaaattccgaagtcttcaagaagtctggggaatgggagcttggttaattattgacaatccaattctaatggataattttgggacaattgtggggaattgtgtgtgaatatgatctggcttttagatgtgatgaaattattctgaaatagatggagattgttgaccccccaaaataatatagctacaatacaatatgactatattacctcattttagtatacacacggagacagacacaaacacacagatgtgtgtatatgaaaaagatccaagaggatatactggatcttagcaatgctaacatctgggtattaggaattggtgttgatattttctgtattttattatttcctaatttctacaatacccatttacagatgtaataataaacgatatttttaaaaaacaaggaatcgaaaataatttaaatgttcattagtaacatatggctaaattaattattgtaggtctgtattctaagttatttcattatattcaaagacaatatgagaaatttttataacatggcaaaatagttgtattgtagtattcagtgaaaagagcaagatgaaaacctttttacataggttggtctacactccaaaagtagatctcacagtgatttttttctacatggtaaaatcttgggattttctttttattttcttgaattatttttctttagtaaatatatctttttaattggaaaaataaatatatcatcaaaaattctgttaaaaatgttcatgcttcaaaagtttcaggttattgttggaggcagttcaaaaatgttatagctgtgaatcatggctgtatttaaatacaggtagcacttcgtgttagaaatatgtgttgggaggggtttatattgtgtgtttatgtaaagatagggtaagatttcacaaacttcttatagacaaaaacagttacaaagatttgtgtcattttagcataaaggtgagttccttaatattactttttattaaatcatttattcattccttcattcaataattatccattgagcaagggcttgggtgcccaagattcagaaataagaaatgtagtaggaaacaacacctaaaattgacttttctctcaccttttgggcaaaaattggaagacagttaaattcttttacgatagcagtatcctatgtgatcaaaaattcaaagcgtctttactatctaaataatgtctattgaattttcagatgttctctcagctctttaattaagttcactaatttctgtctcaatccagtgttgaagtcagcagccaaatgccacatatggaaaaatgttcctctggaagtaaattgaatattttaaaaattactgtcacttatcttaatatttaactcaataaaacttctgtttctcagtgtttccccacacattttcatgtgtctgttaaattgttggtaatgctgcatacataattccttggaaaactaaatggattctctatcatttagaagagttttgggggtaatgtggtaaatcattttttgagttgggtaaataattcttttgagtaattaagtaaatctaatgagtgctgtttaattgcttattggtttattcagtcttttatttgcttcctgtatggcaagttcagaaacctattaatattgctatttattgagagggcttcttaatatcttttaatgagaaaaatacctggtgacagtttattagggaattcagtagattcaagaggaatttttaaatgatctcatttgtattttagctataagttaggagacaaggttctgtgctcagattcccagctactgcaggaattgtatgattgtggttatttttaaagccagaagacgctcttttggagttctgttatttcaacaatctagatctattctccatgtgatattgacttaaaatttaaaaagcagatgtaggtcaaaggagattctgcaaacacttttgctgttttatcctggggctttgacaactttaaagcaatgatgagtttttttttttttttttatatctaaccttaatcctcctggtatactttaaagtcacctctccctaagttttctttattacaaatgtaaataaaaatgggattgttatgtgtgttctttattttagttatgttatctgtttcatctataatatatagagatataaacataatatttcatgaaagatagactttatggagaatacacagaatctgttactagggatttctactagtagtagtagtagaaggggtgagaaaagggaatttttgacctttttttctcttgtatggttaaaatgtcttgccatgaacattgcaaattatatattataaattacttttataatttaaaaatatattttatattgtaaaatattaacaattataatgatattaagtattataaattatttttataatttaaaacaaaaatgaaatattatttatatacaaattgttggtttgtattaggcttttggcatattaggggcttaataaatatttaattgaatttcagcatgtactaacatatatttttctttttacaagtgagcctactacctgctgaacttgaaagaatctagcatttaaaagttctttaacaatataggaaacctagaataaacaagcataaagactttaaacatttttaaaagctgtttaaagaatgttcttatattggttagcctttgggccccaaatacagaaagcatttattttcattttaaaaagggcccccaaacaagacagggctaataaaccagttataggatacagctttttttccatttagaactttatgcaatctgtcatcttctctgatccatcattattaatggttagtcttctcatgttttacatactttattcttagaatcctcagaaaacacactcatttttcctgctactaaaataaataaacattgcaatttattcctaaatatagtgtatttccggttattggtgtttctttcataggccattggtaagtgaaggaactacagagaaataaggggtaagaggaaataaaaatgctatctcaaggtctttgttctgccaaggtcatctaaaagctacacagcagggttcatttcaagactacatttcagggttagctcactaaatgtatccaccatactctacagatggggaaactcaggttgtgcttagcctaacatacttggttctgataatgcttggttctgataatgccaagatgataaatagatttagtccctctattgtaacatttgtattgaatatatgggttttgtaggataccaccagaaaaccaactttaattgctttctcttctacccattcaaactagcactgaaagagaagtctgactcactgaccaccacttgagcacgaacttttctggcaacattcagataattaaaagtcatcaaagcactttagcctcaaatggtctcgattcagtaattatcaatgtaatgacgttttcttcacagtaaaggtttctcagattcactagctcaaccagctgcatggatacacctgaaacagaaaagaatggcatggtcagctttgctgtttgccccagcttttgtgttccatagctgctttgccagcttgttaagagtggtgacattgggaagtgaggggaacaggtaaggcagggaaatgccttccatgttgggtgaggtgacatccctgttttggactgatgattaaagctgcctctttttctggtggatgcttacccagggttcactcatctacagttccctgaactaagtgaagcatcccccgactgacaagttacaacttgttcttcacactttggacattagtctgtacacctccagaatattccttctgaattccaactaggtgtccttcatgggcagattctaagacagcaaagcccaatagtcttgttctccctctctcccggcccagatctgacccacacaatacatacacacaccttcgtcctgctgattaggtgggtcatctttgcccaagtgtgttcaatcaccttcttatccttgatgtttatactttagatttctcaggcttgagtgagaaaccaatcgatcgtatctccaaaacttctggaaacatatcaatctctctaaatgaattctctgaagtcctttttactaatgttaaggtgagggacaagcaagcctgaaccatccctgaggaggagggggtagggacatggaagatactgacaactctctctcaagacattccccatctcttttttccatctctttgaccggttttactgcagcccttttatacgttggagtttaaggagctaaggcccctacactggtgttcagttattcccttttcagcctgcataggtggtctggaatgtgggagtagttgacacctactttcctggggtctcagccaaatgaaaataattatttagtaacagctttgggaatataactttttcacccttttctgtggtctctgagatactttttaatcctcaaatattatattctaaggtcttttaaaaatgtctgtatgttagaagcagtaatgctggctataccacctaaatataagtcttacactaaatgtgagtcaaattgacccaaatcctaaagtcttcctatatttgttttgattactcattcacttgaatagataatacatgacatgatatgaaagctaagataagcaaaagactatataatgaaaagtcttttcttctgttgtaaatcttagtcatgtttctctttccaagaggcaatttttttattatttttaagattcttatttcaaacatttctggagatctcaagattcatgtggagaatataaaaaataattgggctcagactgatctgacataatattaggtatatgttatctgtcagcagagagatattgagcatggaccataactgggctcactcctgctattctacctgtgagttagaaataatactaaagacctctaggagttgtgagaattaactgagaaaaatggatttaaaggaaatagtagtttctgttgtagaatattcactctatacatattaatttcttaaagtcccaacctctttgtgatgtcgtattagtttctgcttactccccaccctcaacactaaccattgtgctaccaacatcccctgtatgcctctgtgacagctgcttggtttcctgcatatactcacttccaaaaccttgttgtgtaaagtgtgcctgttgtgccccgtgctcatctctgacatagcacttcttcactacagtgtagtggaatatgcgtttttctcttcaacttagtgccttgttttgtcactcagcacagtgattggcacctagtaaacagtatgtatttgttggacgagtgagtgcacaaattaagcaccctcattaaaggcctgttctgttttgatagagggaacgtggacagaggtgaagcattttgatgtggggaattgtggggaccatagagctagctcccctggaatcagagagggagcattagcttggtagagagagagaatatgttaaggaaaaggcaaggggcaaagtcagaaggccatgaaggtcagataacacatctggaagtttgcttggacctcaccttgtcccgtgctctcctcctggcattaggaaatgactatcttattaagacactggcgcctttgaaggataccaccgatattcttacatactgtatcagtcagccccagaaagcctttggtgtcaggggataaaaagaaacaacaacaaaaaaatgaatcatttttctctcactttcaagtgattagaatagaagaaatagaaagatccattgccttgattaaaagaagtcagttatttgtggtggcattttaagtggatgctttcgcatgtgcttctccaaaagaagctggtaatagtatgtattgaatttaaatgtaacctgaacggctagagtgagcacactaatatggcattggcaacttcactgagcatactttaaaaattctaaaggaatatgccaattccccagagattatcttcatttctgaatgaagaaatattttgttctgtatattaaccttttgttatgcctagagctcagtatatctaaacaatttaattagattattttaactgctttattgagataacatgaaattcacccatttaaaatgtacaattgagtatattttagtctattcacatggttgtgcaaccatcaccacaatctaacatagaatactttttaccctttaaaagaaaccccagacccattagcatcaattcccattctcttttccatactaccagccataattaatcactaatctatttttttatctctataaatgtgcccattttttggacatttgatataaatgaaacgataccaaatatgtggtcgcttctgactgccttcctttactcagcatggtttcaaggtttacccatattgtagcatgtaactcagtacttgtttttattattgctgaataatactccattgtttcgatataccacattttatttatcagtgaatcagcagatgtgtatttggattgtttcgccttttggctactatgaagaatactgctaagagcattcatgtacaagttttcgtgtggatgtctttttgtttgcatatatctagcagtggagttttgctggctcgtaagtacttgccaacacttcttataatacatctttttgattatagccattctagtgcatgtgaagtggtatcttatttcagttttgatttgcattgccctgaagactaaaaatgttgagtgattttcaaggacttattggctatttgtatatcttctctggagaaatgtcttttcaagttctttgtctgttttttaattgggtcatttttattttgattattgagtcgtaagattttattttatacactctgagtattaaagatatatagtttgcaataattttcttccattctgtggattgatggtattattttcagcaacaattttaattttgatgtagtccaatttatgtgtttttctcttattgcttctgcttctgattttgttacctaataaaccatagcttaatccaaagtcacaaagatttactcacgtattttcttgtagttttaactcttaacattttaatacgtgatccattttgaggttttctgtgtgtatgtgattagttgtcccagcaccatttgttgaaaaactgttattttccccattgaaataacattcttgtctaaaattgattaaccataaatgtaatggtttctttctggattctaatttctataccattcatctgtacatctgtccttctgccagtacttctttgttgtattattataactttgtaataagttttgagattggaaagtgtgagtcctctatattgttcttccattctaaggttattttagctatactgggtctcttccatttccatattaactttaagattagtatgtcaattgccaggaaaaaagatggaattttggtagggatttcatggaatttgtggatgaatttgggtcatattgctatcttaataatattaaatatttaacctatgaaaatgaaatgtttttcattcgtttagatctcctttaatttccttccatacagtgttgtaatttcgatgtacaaggtttgcacttttgttaaatttatgcccaacaattttgttcttcttgatgtaggtcatgttttattgattagttatttattttggttgtatttactgatcaaattttccaagatttcataaatatattatgatatattttgacagaaaacttttgtgatggctaagaaaggtttattccatttatgtgctcccatttttgctctcaaatgatgttgcccactgactttaaaattaatttcaaaaagttcaatgtggccgtaatagtgctattataatctcagtatatcagtgatttttaaaaacggatttctacttgttttatacaattggtcttcaaatcctgctattataccttgaaaatgtctctcaaagtcatctttttttttccatcctgtgttaagcatttgaaatataaaatatataagcctcctccaaaaatatataagctccagttattcaatggttatgtttttgttatcttcttttgttgttattgttagcttattttagttatttccccattttccatcccctaatatcttttactcagaaaattttcttataacccctacaggcagaattaatttttcctgtttctgtgattacacaatgtatttaaggtgtttagcacaatattcgttatagagaatagtctcaaaacatggcacctgtcaccatctctagttatctattcaaatcatcagtatttgcccatatcatactctatatctttggtatgttttcttgccatcaattccctcagaaccacccaaccccccccatgaacttagattatttttttttattatactttaagttctagggtacatgtgcacaacatgcaggtttgttacataggtatacatgtaccatgttgatttgctgcttttttttttttttttgagacggattcttgctgtgtctccaggctggagtgcaatgccacaatcttggctgactgcaaccctgctgtcctaggttcaagcaattctcctgccttagcctccaaaatagctgggactacaggtgtgtgccaccacgcccagctaattgtttgtatttttagtagagacaggatttcaccatgttggccaggatggtctcgagctcctgacctcatgatccgcccgccccggcctcccaaagtgctgggattacaggtgtgagccaccgcactcggccagattgtaaattttttgacaacaatgactattctcctcatctttctatgttcaaggcctgcatagtttagaaacaaggaaacagtacagttgcaaccatacaattgaaaaaaaaaaattgtccatggctataaattaattaatctgtcctgattttatgtctgtcaaattataggtagtactaacccagtaagagctttattgataaataaatgagaaattacagttttatcaagtgtgaggtaatccctttttttggggcttgcttatttctattaagcttccaagtattttttaaaagacaatttgtattcctggctttattttacagtttggttttatctattctatttgcatactgagaggaagctggtatatagcagtctaagctaaatgaaaaataagtgcgcaattctaatattcaaaaacaggatagaagatgtccatttttatttttttattctaaataggaataatatgcactataatgtttatatttcttccaagtatcttgtaccacatgcttatgattgacattgggcctctatacctattccttttcgttaagagactacttttgtattaacattttaccattagattttattgaaacactattcaaagtcctcaaaatttcaattttatacctttttatttttctgtaagatgaagcaatgtctttagaatgttattttaagctcatctttgggcttccactgtttcctctacttgcccttattttaaactggaaaatccatgaatgtaatgaccacatcttaggctctttcatatttcaaatgcctaagccagcatcaaataaatgtattttatttatttatttatttatttatttatttatttatttatttatttattattttgaggcggagtttcactcttgttgcccaggctggagtgcagtggcacaatttggctcaccgcaacctctgcctcccgggttcaagggattctcctgccttggccttccgagtagcttggattacagccatgcgccaccacacccagctaattttgtatttttagtacagacggggtttctccacgttggtcaggctgatctcaaactgccaacctcaggtggtccgcccgcctcagcctcccaaagtgttgggattacaggcgtgagccactgtgctcagccaaataaatgtattttttaaaaaatatcccatggtttgtttatcatataatgtaaaatcaagaatccaaatatttttcaaagggtagagaatttctgtgagtaattttttcctcagcatcttaatatccaaactctacttgctcacaagattacttaatcagcatcatatcagagacagcttgctgtgtttaccattgttagttgggccagcatatgtccaaaacagttggaatgagaaaaacagccttgacttgaagccaaattagagagggaggaggagaagagttctttagctgttgaacaggactacatattttggacagtgtagggtacttctgtagaaaaaaagaaaaaaaagggtggggaattctttcagccaaaaaacaaaggtgcattttgaaatatctaaatgcactgaaataataaaagcaaattggtgatgttgttttaattttatttatataagcctttgcaagtaatgaaatctttttatgttaaccaaaaaaagaaagaaagaaagaaaagtattctaagatatttataatgtggataatttttttttttttcagttttaccctggcaactttaattggcttagtggtttctaattctgggcaattttctgtttctttattaagcaatgtgggagctgttgaataaccatcacatttcataggatcagaataatatttctgatttttctcaaactgggtattatattactgtatagtaaaaactttttaagtgaggaaaatgtctattcttgttttgctaagtaacattacaaaaagtagatatttttgtgcattccacccccttaagaagcaactattgtagaaagtggtgttttcattgagagagaaaatggaaagtaatattttgctatttattatggaaagttagaggagaggtttccaaataccacaatcaaggaataaaacaattttgaccacaactgaattttatatatcaggcaaagcctgtcctagggtagtttttaattagataaagctttcttcagagttcctgctttcaattctctatcatttcttatctggtagggatcccgcttgcttcctagtacctctccctttctttacatcagaatctattatgtatggtggttattgatttacccaaagaagtcaatgaaggccaacagcagttgccttttgcatgagatatactttctgataaagactaaaaaagtaaatcacacacacatacacacaatttttaggtggggagggaatagctttggcagtagaggaagccttgggaatcactgttttacctccctggttttatttgttttatacatgagaaacccaggatccatagacgtggactaatcaagactagaactggagacgcagtgttctttctgccaaattctgtttctttacattgacaaggtattgggcattagcaagcaattgagagtagactgatagagatgttaatttattcattacttgttctttaaaacaactgtatcccatgcttgtgagaatcaagcaagatgacaaaggtttgttaccaacgagtttggtaaagcattttcagaggagtgtagtggatgtagtaggtttgtactctaggacctggaggtgagagaagacagaggaaggatgtaccataccgtatgttcagaatcaaaccttccctcaggtcctgaggttatcaggtcaagtgtgtcgcaaggcctagcttcctctttgctaaagatgagtttttcttaggtggtgccttagtcattcatgcaaatagacatctgcagtgccagccccacctgctctccagacatgcccagtagtttttgaaccttggctttgagtatgtcctgcagcatgccaaatttatctcgaggggaataagcccaagtgaaccgcctacgtaaatctaaccaagacaggcctgatgtggcgggttgaatttctatgttgaactaaggaatcgcatggggttctatggctatacttctcccccctaactgggcaaggcgaggaaacctgaataacaacccctatacaagagcatttaccttagcatagagacaaattgcactgtttgttgttctctcatttcttttgtttaaccatgataatacttacctttttagcttcaagatttataaattccaagcaattcatttaaagcatttttttaaaagcttgaacttaaaattttgtataatgtgttctctagctactgaatattctactggtctaatctaagttatattataaattttgtggaaaataagcagaagccatttgattcagaatgcctttgctaagctctatgattagcaatgtatttcctatgattttgggttatataaatttaaatttgcattaatatctggaacaacatttgggtaaatatttttcccatagtttttaaacaatacctaactaccagaactatcttgcatgaagcacaaaatttctgtagtggtttgactacagatctattactagggtgatagccaaacttgtagtattattattgcagctttgaggtgtataagatgtttctttaaaacctcaaggttttaaaacattcagaataaactatatcaacccacacattaacaaacatttaaatgtcaaataagcagaatatcctttaatttctaaccatccctttgcaaaacccattccaatgttggtttctataaaatatactggggccttgttagtttatacatacaggatatatgtatatgtatatatatatatatatatatatatatgtaagcttagaattatgtagcaactgctgcacagattggaacagtctatgtatgtctttcgctataatttattaaaagaaatttcaattcaataagtatttgttctatttgtagcttattgaagggtatacaatctctgtctcatggaaaaagagataatttaggagaacactcctgaatcttttactatggaatattatacaggatctttcattaggaccattctaaattaatatttaccatattattaaatatgcaagataaaaaacactgaaaaataatattgtatatgtgacaatggcaaagctaactgtaacctgtctagtgctcattattctcgtctgtgaaatggggataatagtaaagctgtgtattcaaagagaaagtccatccaaaagtcatagctagcgctcagcatatgttgctcattttaaagtgccatcattcttatttatatttttgttttccagttgactgcgtattgtgaagagcaagcaacaaagtctaaaattagtatatcaatctagtgaaaatacttagaacttgttttatatggtgttctcctgtcatgttctatttcctaattatgttttattttagatgaaatacactatgataatttttaacctaattcattcaaccattatagcagagaggtagcttggaaatttgtttgtcacagggacatcccaccatgtgagaataaaaattgggccgggcgcagtggctcacacctgtaatcccagaactttgggaggccgaggcgggtggatcacctgaggttgggagttcgagaccagcctgaccaatatagagaaacctcctctctactaaaaatacaaaattagctgggcgtggtggcacatacctgtaataccagctactcaggaggctgaggcaggagaatcgcttgaacccgggaggcgaaagttgcaatgagccgagatcacgccattgcactccagcctgggcaacaagagcaaaattctgtctcaaaaaaataaataaataaataaaataaaataaaatttggctatagattgattctcaggagttcgcaaactttctgttaggggcagataataaatatttgagattttgcagcctgtactatctctgtggcattcaattctgactttttagtgcaaaagcagctatacacagtaagtcaatgaatgagagtggctgtgttccaattaattttatttgtaaacactgaaatttgaatttcatatatttttatgtcacaaaatattttcctttaaaaaattgttttcccaaccattaaaaatgtaacaatcattcttaggttgcaggccataaaaaattaggcaggctggatttgacccatgagccacagtttcctaactcctgttctgcatagttaccttcattataaatattttcaataatttcttatacttttgattgtacaaagaggtatggcttcaaattacagactgatatctcagagctgtgcttaaagtattgagaagcattctgtaatgctgatggttttctcaatattggctaattctataaacagatactatgagttctgccagaaatagaaattctaatgacagtctaattaaatagaagccatggagaagaattattacattttcttatgccaaattataaatgtcttcaattaatgcacagatatttatttatttatgtatatgtaaaaagtggattttctgacagcctcaggctcctctttgtggtagaaccttctgtttctctaattagttgtgccttaatggccagtaattgtcttttataatgcacagggaacctaaaaaaaaactgaaggaaaaaaaatagaccatcacagtctatcttttcaaatcttttctcatgctgtcaaaaaacagctgcctcttactttttgttactactttcttcaattaaaaagtaatctcaaaatttatgaataatacacccaaacctcattaacactgtttacagttaattatgatttagtatctctctctgtctgatataacccaatgggatttagttaatcaagtaccgaagatgacttcattaccaggcagtctttacctgtgaatcagtagattcacagattggagagtacagccatagtgaatttaagaaaaacaaaaacaaaaacaaaaaaaaatgctaattgcctagactcaatagaattttgtatagctaaaagaaaagggtgaaatattaaatttggaattcttaagtacagaattgttccttaaaaagagtgctgaaatacacactttaagaaagatgctttagacttacctgaaaatacacaagtgtgtcaaaatatgaagaaatatattcaattacacatatctctgtggaatatattgacaattatgaacaaatgtttttcttcacctttaaaaacaaaaatatgtaatattattttaacaaaaacttttcagtctcatctgtatcaaggcatactccagaatgaaatgtgtagaaataaaatgaaatgcctattttgtagaagtcaaatagaatcagaatggagtggttgagatcatggactctggagctggacggtgtgtgttctaattcctgttgtacctgttagtgggtgtgtgaccttggccaagctcctctgtggcctccattttcctcatttgtaagtaagaatcccaagcacgtctactccataggttactagatattgcaacctcataatgttgtaaagaacaaatgaatgaatatttactttataaagcattcagaacgatgtttgttatacagtaagtgctgtaattagtgttggttccataatttaaattagaataagagaaactcgggagactggccaaaattatgctgttactctttgtgcttacccatgtttgtaaagccaaacttggaatcagtacatttagggaagtcacattttattagaatgcttaggacctcaaaactcacctattttaaaactcacatatccaaagtgcttcctgacaaaggatactggatatttctctttaggagcaaaagtggtgccaccatgtggcaataacataaatatagctgccaatccatttagcttggcaaggcttatatgagcacattacatgaatttttaaaatgttttaacgttcaatttttttctaaattgtatgtacaaagtataactttattatttttaattcagcattttaaaattcccataatttcagttctcataaaacaagagtggcattttctttgaaaaaacagtaatgtaatttgcctgtgatttgaatttggcaaaataaacaaataatgcccttataacactgattttcaaactgagttccatggagcctgcattccctgggggaaaggaatagcggaggaagtgagtggatagaaccttggttcctcctctccgtcttttctaaaacatttccacttttgctggttttatatgttggaactgttcgtaagattttatttgaagaaaataagaaaatatccagccgtttaaagaaatgtttttcttttctaaaagccagtgcagtcctatattaggagtttcagtggggctttaaaactttattttattttttattttttatttttttttttggtaataaagatttactcagaactagaaaacagctaaattctggagaagaggtaagatgcattggttgaaaccctattcctgttatgcaggactgaaaagattagagcagagaaaaggcaaagacatggtctgaatcgcagaagaaaagaaggaaggtatatcacacatggcatttcagctttgtttctcctacttttcccgcatattttcatgtatgttgttgtcttaaacatattaagcattgaggctttcagaaaatattcaactgttttgtgctggctaaaggtaattgtttcctggtggcaggaggcatgaaccaatgaaacttttttttttttttctgtcaaaatagcacataatgatgtactttttgtaagcaagaattcctgatagaagagtgggaacacatttttgaaaaagtttatttgctgagtaatatgtttagaaagaatgttgttagagaaggatatttgctaagaaaaatcatttattcaactaatatttattaaacttacagtataagctacataatatactaggttccggagttataagggaatcccttgcctcaaatattagggtttcataatgagagggaagttttgttagtcatttgaaatagctatttgaaatagtcaaatttgaaatttgactattttgtcatattcataaatatgtcatattcacaaatatgactatttgtcatattcaaatatgacaaatagctatttcaaatgactaacaaaacttccctctcattatgaaaccctatatttgaggcagaggatttccttataactccaagtatttgtctgtgacctagaagaatatataagttgtagaaaaaaatacgggaaaggggacggtttgcaccatcttcctcgtagttcctttagaagtgaatttactttagatcccagaggaagagtattagatctggccacagaagtaactcttttatattattacctatattttctattttaaaacattaaaattttgaatcttctcaagatttcatttttaggtacatttatatcaaattgaattttaatctcaaattacaaaataatatggattacaaactaatatataggttcttagcttctattaccttggagtcccataaattggcttgattttgtttccgtagtgcaaggagctgaataaagcttttactcagttcttaaatagtaaagaactagcaaacattgcgatactttagaactaagtggccattacagattagttagcagttcatgtttgtgttatggtttgttatgactgcttaattcaaaagcatatttgcagacagggagtttggattaagtaaatcaaaatagtaaaggctttgattaagaagttagcttgctttaacttaaatgttgatatttcaaggcctactgatattttagtcatttgcggttatttttgtttcctgttcagacccctgggaaataagagaatagtaaatcaaagcccaggttgctttttgcatttttttccttttcatttatgccatgtagtagttgactttaagaaactaaagacatggataacttgaacagaatcactgtgagggagaattgtatttctggattaatcaatttaaataattcttgttataaaatgattcttttcatgtttgataatttagtaattctttttattccacgataatgttatcgtaactagtggaaaagcagctaaaaatatctgcattactaaagtccaatttgggcagtattgttatcaaactgaggctatgttgtttgtgtctagggatcgctagggcgttgcttcatcagccagaaacctctgtgacaggtggtgccttctgcctgagtattgctagtgcccgtttctttccacccactcggctcaacaggctgcactcggctcgtgctgccagcccagaacccacacctgccaagtacgagcaaggcgtggagcggtgaggggtgtgtgtgtgattgagtgcagggtctagccactgcacacagctgggcacactggctgctgtggtggggcaggcagctccaggcaacaacacaggtgccagctccatgtgaggaggctgaggctggagcacatgtactgcacgcggcttctgctatgggcatccgtgtctggatgaggggaacatggtggcacccagaagcttggagatgcctggaaccactgaaccccaaagagagtgtcacagccccctggctcagggagcccctgggcctgggctccccaaagggccacagctcttctccccttctcatcgcccacaacatggcaagcgggagggtgtgtttcagccctgttcgtgttaacagctcttttagtcccaccatttgatgtgtcccgagttcttgtttcatacccaggaagaatgaggtatgcggacagctggaggctgagcaaagcgaagaggagcttcactgattggcagaacagttctcaagagacccaaagtgggcagctcctttctgcaagcaggtcatcctgacgagtgtccagctctcagtggagaggagacccacagtggttagctcctttctccaggcaggtcatcccaacacgtgtccagctttcagtggagaggagacccacagtgggtagctccttcccccagtcagtagtccagacatctgtgcagccctcagtggagaggtgacctagaacgggtagcttctatcggcaagcaggtcgtcccatcctctgcctcagtctggctgagtccagggtcgttatgcgcttcagaggaggggaagtatgtgctaattggtccatggacggccatgggtgggcctggataaagcaccataagttctcactctggtccacggaactgacagcctggcccccaggattttggctgtccctggcttgaaggtggggcttcaccaggtaccctcccctttctgcccaggagcttgtctgcctcctgccgccatcagtcatgttgttcacggttcccaggctgttgccgaagggcgcctgcaggcccctgttgagctgccctcaatctcccactcatgctctttggtgcccaagtccaaaggaggccaagacgacagggggctggcgtgtcagtgctgccctgagcatgcacatacccagccgggttgcgacagtgcctgggcttggcctgaactttgcttcaaaatcagagcgagtgctgggagcatggagaggccaggcagcgacagcaggcacttccaagcctgtggggagcagaggacctaccaggtccccgactgtgcgcagggatgcctgggtccatagctgcagctgcaccccggagggtggggcttctgcccctcaactcgaaagcgggtgaggctcccgcctgttcccagctcctgcgggctccatggagtgggcagcccccgcccccactgcagctggtgtcatggcagcagcccttctggacaggccagccactgccatcacatgttttcccattttctatttttggtgatagcaaattcaaacttcttaatttacttttcctgaaaaaagttgcctttcaagactacacattttaatgaagagccttcagtaataagcatttcagcatgtctcaaaaaagattcaactgttggttattttagctaaaatgtcaaggaattttgattaactttaaaaggatttaccttttatatttacatttattaatttaatttttatctttaaaatggaagatttgaaaaaaaatcttagcttagcttgcagcttaccagttctggtgtaattttcagtaatataacatggagtattcaatcatgaattagccattattatttaaataattcacggtgtgacctatactgggttatccctactgaagcaaacagcatgaatgggtaagttttattttcctcagtgttcacttactccatgttgtcacgtgtcagcacattgaattttaagagatacagtggagtctaggaaatgcaaaatgacaccttgggtggaaaaacttttcagattgttttcaaatacttacgcagtgttgccagaaatgtgttaacttagaaatttaactagtaaaacagcatatatttgtaattcaaacagtcaaaaagcccagtaagtaattgctttaggattttaatcgggtatgtgtgtatgtgaacatatacatgcagatgtgcacatgtgttactaattttattcccataatcttgtgactattattcattcattcattcattcacaccacacatgcactgaggccttactatgttttcatgttgtactaagcactgaaaacatagtctctgccctcatgaaatttggaatagtggtaaagatagacaaatgaatgttatgaaaagaactgagaaatttaatgggaaaattaaataaaactcagaaaaacatctatattaaatcatgttttagctaagatatgaaggataggactaatctagagaaatgtgttggtattgggggaaaggttttaggaagagagaacacatatggaaaatctctgagaccctggagtgcataacatgtttaaggaactgaaaaatcagtgtggcttgagtgagtggaggacaggtattattgaggctggaaatatacagagaaagcacactatggagaaacaggccagccatgttagagacggaggctccactgatgagtgttagccaggaacgtaacagaagtgctttaataaaacaggcagcagtggcagagagaccttgatggcttcaaaaactatttaggagtaggggccagtcgggctgactcatccctgtaatcccagcactttgggaggcagaggtgggaggatcacttgaggtcaggagttcaaaaccagcttggcaaatgtagtaaaaccccatctccactaaaaatacaaaaattagccaggcatgctggtgcacacctgtagtcccagctactcgggaggctgatgcaggagaatgacttaaacccggcaggcagaggttgcagtgagccgagatcgcgccactgcactccagctgtcagagtgagacttcatgtcaaaaaaaaaaaaaaaaatcaggagtaggaaagataatttctatcaattagataataaaagagagaggagtcactatcacttctctgtttctcttgtgtctgcaatgataaaaaaaaatacagggatactggagaaaagaacagtaagagacagctaaagagaatcccagtagtacctgtacatatgagttgcacatttggtggaatagatgtttaagctggagatagaattgtcaacatagaggaagcaaagccctaggaatggaagggatctgcagtgagagagaaaaagagagagagagagagactcttttccattagtttcccattccatgacatacttccaccagacataaactgttccttcatgcctttattctactttaaatcatttgatgtcagtatgtcaattagcattcacagaataagataagggaaactttttttagtctcatttacatctcacaactaaataggccagattttgtaagggaataaactcagaggctgctgaggggttgaataacttgtctctctgacagtggtggccatggcttctgccacactgcttgttttgtgaaacaaccaagtctcctgcctacctttctgacctttcattccacctgtgccttgtagagtccaatcacaagtcatttgcagtttcctttttcttttcctgttcctgtgtacatgctcttctgctctgagttcacgtctctgtgtttttggtggcatagggagggttaggcaaacatgctttctttgtgaagccttttctgactcgacctgaaataatcagtggtttctctttttcaaaatttctctgtaacaaataacataggacattatttttcagttggatgcctgtctcatgcctttctcctattctcagaacctgattaccttgccctaccctgcccaaccccattttatatgtactttatgtgagctttggcaagcagggaccacattatactttttatttttatttccattgtatttagcagagtaatagcatatgctcaaaaaatgtttgttgaattaagttgataaagaaggaagacatgggcaagaaacatagtgtaaaaggcaggaaggaaactatgtgttaagagacagtggtttagccccccaaaaaggtagcaagagataagtctagagaggtgtcggtgaaactcgtctgtggtaaaatttgttggggcaaacagtatttatgaaacccaatccataatacataacatggatagaaagaatgagactgaaaaaaaggacttgttaaaaaaaatttaaaaaccttggcagctgtcccctctccccaaaacacacacatcctccccactcacgcccccacttctgcctccacctccatctctatctccatccccaccagcttagcttgacttttgggagctagaatcccaaagatccctttcccagagtgctctgctccagacctagcagctgcagggaactgtgggtattttatgattttggagccagagaaacaagatggtgagtgacctccacaaactgagggaaaatgtttgggctttggctgggcttcttctgagcagtagtgcagccctaattcattcttctcttttccacacaatgacatcgaaggtgttttggcctgctattcgtaacgaccccttcacacatgttagcctgcggaaagaagctctactgagcagaggcgatcagctttccccaggtggattttgggccatgttacccaaagaaaacttctgttttctgttttgtgtcactcttctcagtagctttgctctgtaggccagccctggaggccccttctctgcagagggttagaggcctgtccccagtccctcatcatcatatttcaggatggctggaagcagtggttccaaggccaaattcatcatcagtgggaaatacaaactggtatggaagatcacatctggcttttttggggacatttatcaggcaaagaacataaccaatagtaaagaagtggcgctagcatccttgaattctggaaagctaggtatttctcattgcagtcccagagaaaactttttagattcttcagggcgggttagtatttcaacatgagatggtatgattagagcaaagactgcaatgtgctactcttggatcttcagccctcaagacctcttcattttcttttggagaaggctcccagtgaaaaccgtagttaggttagcagaccagatgactggtagaattgcatatgtgcatgcaaagaatttgagtcacagtttaaaccagataacttcctaatcagtattgagtattgctataggaagttattccttattgattttgatttgctgaaaaagtacagaaacaataggataaggcagcacatatcatagaggagatagtaatctctagcaccacttgctaagttagcatcagtgcacatcttggtattgatcagagttttagagatgacatgttatcatcatgatacatgtaaatgtaatttaatagaaccagcctgccatggcaaagattaaagtctgcaacaaagaacagaaaaatgaaaatgttaatgagagaatgataaaatgaaaaggagttgatggaaggtatctactcctgttgaaattttgtataaggggttttctgcagaatttgcagtaaactattgttatggatcacacattaaggaagccttgagacagctattccacaatattttctggaccctgaactgctgatattaaatacatatttggttgaatattgttaaagcagaaaacagtacagaaggcagcctcttcccatggagttagcatgcccaaactctcacaggtttccatgcatgaagggaggaacagaagaagcagaatagataatcagagtaacatttgtatatcgccaaatccagaatttttagttcatatgtcgcattgccagtgttgtgaacaaccatttcccaggtaaaaataacgtaggaataaaatggctctgggcagcattgctgatataaccaagttgtggcctctgtaattatgtatattaactgaagttgttaaacatgctttcaatttttatagcacctttttcagtggaaaacttaactaaataattggcatataccaatttgtgttgagagtttttccatgcctgtgtgtgtgtgtgtgtatgtgtgtgtgtgaaaacctattattttgaactctactgctttgagaagggccatatggttgtatatgcacaaaattgcgcattcttaaagttttttcatacgtaaggcttgcaagttgtttacttaaaacattaaaatggttggcatcttgcttaaggcagctgataaagtagcaacgaaagagtccggtttttgaacatatgaaaattctgtttgttatactatgaatagcagcatctaaagtgaagaagtaagaaatactctgtggtaactagattatccttagtactctgaatgaactctttaacgacccttgaattaaaaaatatttgttacagaaattgaaagctaaacgtgaatgttcatgttcatgctcaaataaatgtaattattatgaacacctacatgatttgggattttggttttattttgaaatgagagctctttcatttacaagttcactaaaaactcaaatgtttcttgaaaatcacaggagcttatgaacattaaaaagaaggaataactattgaacaaataagacagacactgtcaagaacgggcaggactttgcaaggtgataattaagactagttaatatttatgtggaaaagttctgactgggcatttggaacataataatatgaacaatataatataataaatatagcatacatttgcatttatttgcaacctcagacaagcaagatgagtccaaataaagctagcttcatcgtagtcctttcttacatgtgtcacaaggtcttgagatcagtttaaaaaacatgttttatttacaactaatgtgaatactaatatttgctgtcatcagattccttcgaaaataacatatgcatcactggccacctgttctaagtaatttttgaggaatttgcatgttcccagacaaggaatgttgtgaacagagatgattctatttatccactgttaaaaatggcagttaatttttccttgtaagttgatttctaattatgataatatggcagctatggacaatgccctttcttaaacatactgggatgtaaaagtgaccataacttgttgaaactcagtcctggtattgtgttactattatttctcctggggaggcttattagcctgtcacaaaagatgtaagaaaaatccaacattccttttggaatatgatgagcctttgtcacccacaatgcaattaatgttaaaaatagaaagaatggctatgatatgattatgattaggcagagatgagctattgtccaagtaacaggaactaatctagcaggccaaagatgacctacacagaaccatcagtgtgctgattgccatttctctctgagtttgatgaaatattcatgcctttgctctcctctctgcaagcactattgatttcttgtataaacgctgctatatttagtctagacaaatggaatgtggattgctgctgaataaattggatgaaagactgggatcttgcctgccactttctctcagtcttgggcaattatttataatcaagagcagtttttgtaagttgagggtgatttttcacaatttagtgattagtctctgaacaaaggcaagcagttagacgcaatcatttctgttgggatagcaggttaagaagtcaaattaccctttgaggtttacaataactgtttcagagacttgtaggactttttttcttatctttttaaaaaagcttttttagaggtttgatgtttgtagttcatggataacaagaatgccagcaagaagagactccagggtctcttgaatttttacattttgtctttatagggttaagttctgacctttgttttttgagatttccatgtaaaagctgaaggctatagcttggcctttttaatgtaaaaatgaaatatatcattaactgccattgcttttggttggaattatgccaagtcttttagttaatattcaaaatctcatgttactccagagccttgactaaaagttctacattgggtgctacaattaagagatcttacaggccatcattctaatttgcatctgaacttgtcatgattaatttctttcctttcacaaatatcatctttgagaagtcaatgtccaccaaactatagttcatttataaattattttcccattttcattaaagtgacacataaagtaccatcaatgcaaacttctggtcaatccatggcaaaataaccaatgtaagcaacccaagattgatatcagtctgcatgcacaggcacaggcacatgcacatggacattcaactcagatgaccagcaaggacatttaagtatatgaagccttaacatctgtagacaggatttctgttagcctttttttactcactgaaaataactcttaaattcacatggaaaattaactttgtagttcccaaactggaatctgcaaatttaagttagttacttatagtaatagagcattagatgcaatttggaaaaatacagaaaagtaaagggagaatcattcatatttccgtctaaaatacagccatcttctgttctctacatcaccagtcattgctattagaatttaaaaactaatatgatttaaaaaccgtggtagaatatgtgctcgataagggctggaatttttgtctttctttaaaataccaaaccccaacatctagaatgaagcctgggactttaagaggcttgataaatctattttgactacattgcttatatatatatatattttttaaatggttatcatagtgtaaatatcacttttttcacttaatgtgacaacttttttaatgttcccacaaacattatttttaatgaatgcgtagcttttctaccaaatggatgcgacatattttgctgagacatttccttgtagttggtgatttcaataacaatactagaactctagtaaataatacgacattgaactgtttttttccctattcagtattgtctcctggagatataatcctagagttggcaaacctgaatcaaatggtagaaatatgtaacacttcttgatacgtattaccaaattggttttgcataagttttgtaccaattgacagctccacttgccataaataatcgtctctttggtcatacgcttagcctatacaatggggcattgtacacatatatgtatacacgtgggtcatatatatgataataatcaatgatgctctattttgattcataatttgcaattctttactagtgaaggtgattttcagttgttgcattcttttatttgttttgatctagatgttttagtatttttattttctaatgtttagtagaaattgtgtgccattttatttttatatttgtttctaatatgtttgttttgttagctacttactattgatggtttattttaatatataagaaatttccatttcatataataaaaaagcaaaaacaaacatctgttaagggctgtgctacatgctattagtacttactgttactatctccaagttacggatgagggaacagaggcctagggaaattaataacatcttcaatgttacacacatgaaagagtcaaataagcatttagattatagaacagaatttgaaaactggtacatgtaaagactgaagcattttgtttggttcctggagtatttaaagcttttgaagagcctggtgctgtgactcatgcctataatctcagaacttgggagctcaggcaggaggatcacttgaggtcaggaattcaagaccagccttcgcgacatagcaagataataccccagctcccactgccctgaccccagctataaaaaaaaaaaaaagaaagaaaaatttagctggtcatggtgatatgcacctaaagtcccagatacttgggaggctgaggcagaaggatcccttgagccaggaagttctagactgcagtgagctatgattgcaccactgcactacagcctggacgaaaaagtgagccctccagcagcctaaaaaatctttcagtttaattttcagttaacagttatttctgtctacactggatctgtattttctttttctcccacaactcccacaaatagttggttttatctgagtagtgactggcctcttttgaaaagccatgcaatccagtttgccacagtttcccctccaaaattcctgttgtctttagcttaaccttttacactgaactacagaattttcccgattcttgtgggtaagggtcatactcaaaatatttaacaaccagtttggcatggatgctggtcattcaaaatgtcagaatggacaccaacaataaataaatggtacacctggatatcctgtctgtgagttttcctgcttaaactattcctttagaaagcagcattcttttttttttttttttttttgagacagtctcgctctgtcacccaggctggagtgcagtagcgagatctcggctcactgcaagctccgcctcccaggttcacgccattctcctgcctcagctgggactacaggcacccgccaccacacccggctaattttttgtatttttagtagagaaggggtttcaccgtgttggccaggatggtctcgatctcctgacctcgtgatctgcctgccttggcctcccaaagtgctgtgattacaggcgtgagccaccgcgccgggccctgaaagcagcattcttatctactaagagtttttgctaagaattttatatctattatctaatttaatttgtataaatttaaatattatcatctgtagttattctcagatcatcaaatcttttttactccagtggtttgattaaatacttgttttaagtttcctcatactttttccaccttgtttattttaggaatgaggtagctgagatacagattattaccaattcaacatcaggacttagaaacttggctactttcactccttgttgtttggatctggcaccattgctgtggttaattaccattttccacattttagcatgcagttgtctattctgtctttggtacatccaatagtgctgcaaatacgttatattacaacctttactttgtaaagttgaagatatcttctgacgctgattacaaaggaagatgttcttaagtgtacaaatgtagtcatggtggaagttctctcttagggcatcttttcctcaacataattccatttttttttttgtcctcgttgacttgatttttgttagtggttcagtagaataagttttatgaatgactgataccagtaaacaattgaagtcacctgtttgtaaaaggaaattgtggaggattcatggcagagtgcaaattgctgaatgaaaattagcctatggcccatttatcaaaactaatgtacaaatgactttatatcatcattgtaaagaaatggctagagtcattggcataaaatttgttgtacagggtcttatactttttatttgtttccaaatcaatgtgctaatttccaatcttctattaccctcccccaccccatttccctttttttctggttctttagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggtagcaaatgcttctttgtctgtgaccttactcaggagtctgcaccgtggtgggcatgaacagtgcccatgggaacactttgcgggtagattcactgtgattaagacatggatatatggcttgaagggaattgtgattttactagtgaaaactttgggtaagtacctgttaaaaacctgttttgcttctcagagggaccttctttatcctttagcacatagaatcaatagcagggaatagtaacttcctatcctaattttagattctctcctacgtgattttgttcatttgccccatctgctctccaccaagaagaagcatgagcctagaagacccatttcatatttcatttctgaagagtctacatgtactatttgtgagaaaggataaattagtcaccttatatgaagagagctgtttttaaaaaacaaacatggtgtataagtagatgttctgagtatgtccgactcttccttatagaaaagatctcataatgtacacattcaaaataatagtataataaaaagcttaagggagttataaatggagaaactggtgcaaatgtttttatagactgtagataagaatttattgaaagtatttgggagtagttgacaatttgagactaaagttgtttaaattattttagcacaaatatatccatattccagaatttttaataataacttattttattatctaataatattagatgtgtctgtttttttaaattttgtatcttcagagataaatattactttagctttatttgtaaaacatcttgcaacttcttgacaaagacagttgaaacaaggctatttaatttgaatttattgtgacagaaaagcagcaaagatttacaacaaaaattttatttttatatctaactttcaaagatgacaaacacttgctaatttgtgaatgtaataaattatgttatctcatactttattgttttgtattataggaactttattacttgcatatcaagtacaagcacattgatagagggttgatacagataactgatgttactagtatgtaattttaccacattaatatgacagtttctaaggaagtaaaaatgctatcttcttctctatattacttggtttacaagatgtttcttaatcctaaaagaactttattatcgtatattcctaaaaaggctctttgacaagtgatataaaatatatttatttcttttagtagtgaactttccaaaaagaactcttgtatattattgatgtacaaaataccttaaagtgagagtattttcttttgtcccaaatggaatcagtagctcatggctacattttgaagtatgggtagcctttctttagtttttagacttatttttgaatgaatactgaagctttatttaaatttgacctttgaaacaataatagaaacattgatatctagatctgtttctttccttccagcatgttaagatggcaaagagaaatgagtaaaatgtacatttttcaccatactttaagatgtaagggactgtgtagttcattttgctgctttaagtgagacatgtttccctaaatacagggcaatactgataagttactgctttagatacttcttttcatttatattgctgcctttgatagctataaagttaatataaattgtttagaaagaaatttattgcttaattttactcaaaaggtaatagtagcaagtagataattaattgttcatttggcacaagcaaaacaatagtgttggtttattgacatctggaaaatattggaaaagtggctcctgtgagaaaaaagaattatgagatagctaaaaggaaaatttagcttttaaaatgattttccaaaataataatttgttttcttagaaaccaaagacataattaatattactttttcagattaggaagttttttgatttttagaatttttattttgttttgtcttgtattttttatggataaagctaaaagttgatgcttttcattaagattttatttttatgagaaagatgcattacatgatgctttatttatattagctttttgaatcgttagcttctgtaataatcaacatttgttgagttagatgctgttattccatttttccacctagtgaactgaggtagagaaaaataatgatacctttccaaggctacatagccaataaattgttgctccaagatttacagtcttgccctgtctgcctccaaagctcttaagttgccctgcctctctcatgggccagaacatctagcaatagagggctaaagttttatttctttctattgttttaaacctcattcatgcaatctttgataatgaatagtagtggtaattaaattgtgtgcttttctagattcctatgaaagattaaagttcaaatacattggggctttgggtgaagcaccaaattaatttgaccaacccaagtatctatatagaatttaacagtaaggcagaatttaagcattccttctgctaccatggaatattatttcattacaatggaataataacacccattaagggagtgtattgaagccaaaacaccaaagattttaatatgaagagtaaccagaaatgcttctaactatgtccttctgggagtaataaggctattatggttgatatacagagttagcttcctgttgctccagagtgactctgatgccattccatataatagctttttatttttgttctattactttttggtgtaaaatcaagagttttaggcacctaatgtaaaaaacaaaatttactaatttcattagtattgaaagttacaaacacatgttgggtatcccttatctgaaatgcccgggaccagaaatatatcagattttggatttttttttctggattttggaatatttacatatctgtacataatgagagtcttggagatgggactcaagtcaaaaatataaaattcatttatatttcatatacaccttatacacatagcctgaaggtaattttatacaatatttccaatagttttgtgcttcaaacaaagtttgggtacattgaaccatcagaaaggaaaggtgtcattgtctcagccacccatgtggacaatctctggttgtttggcatcactgttgttgctgagtctgaatgtgaggaacatgccattggcatgtcttgcccacacacacaccattttgttatcttttgtgggtgtgcttatgtgggggaatctgggcgtgtgtgaaaaaaatatattgcagctgaaagggggctggaagggtcttttttcccatggtgaagctgactaaactttgtgctgtgtgcctgcattttgactggaactcatcacatgaggtcaggtatggaattctccacttgtggcatcatgtcagtgctcaaactatttcagatgctggagcatttaggattttggattttcagattagggatgcccaacctataataataataattaaaatcagtagggttcaaacttaaaaactaaattttatgtacgttatgaatatgcggctgaagagagatattctctctcttacatatgaggaagtatggctccgagtagtttagtaacttgtccggatttcatatctactaatgtcagaacctaaggagaactcaaggtctttagttactcctcagtgtgcacatttactatagttcatagatatatatttctcagtctgagtggaaatagacatctcaagatggctattaaaaaagaatgcttcaggctgggcaaggtggctcacacccgtaatcccggcagttagagaggccaaggttggagcatcacttgaggccaggagtttgagactagcctggggaacatggcaagactttgtctccactaaaaatgataattttaaaaaattagccaggagtggttgtatatgcctgtaatcctagcaacttaagaggctaaggtgggagtatcgcttgagcccaggagattgaggctgcagtgagctataatggtgccactgcaatccagcctgggcaacagagtgagaccctgtctcaagaataaaaataaaaataaaaaagagtgcaagaatgcatcatattcatgtcattcattgtttgagagtgaattcaagggattcagaaagctaaacaatagtgcattaaaatgaagttttgtggaagtggtttcttcttgaccagtgtctttaatctaaaagcttttatgtgctgaatgaaagaataaagcttctgctattttgatattttgagagactatatgtatataatatattctacatattatgaatatatacattgcattagtctattgagaacttgctctgtaagattttgaaatttttagcatttgtttacttcaggtaaacttcccccaaattaatttaatatctcaccattctgtatttgcgttgattatttttacaccattttttaggctaagaatggaagatttcagttgttcatttataatgtgagggactttgtaaaataggcttctgggcagtccctaccttttcctgtttgtatgttcaaagaaaagtcattaagggaactaaagatttaattaaaggaaatgggaagacctgagtgaatttaacagttagttttgatagggatgcacagataatggagctacctaaaacttgcctgttgatgacgttaagaccttcactgcattagttgcttgtccttagatttcaatgatttacagaaaaagtgggtacaaatatgaactaaatacaaacaagttccaaaagctcataacatttcagttttggtcagtgatgactatgaagcctaaagaaattgcacactctcatgtctttctcttctcgcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagtaagaggcaccagggtaaacgatggactctctttcctcatcgttagctgatcattattcagaacaaagcctgataaagagtgcggttagactcgtcaaaattatctgtgtttaattaaaagcatagattacagacccaactgtaaagttttgacatttacataccagctcacatcattgagtctgcagagcgtctcaagaagcaaacgtaacattatctggcaaaggtgctgatttctgttgttttgaaccttaaaaataatgtaattctaaagcagtctaatatatgccatcttgtttaataatcagcttgtatccacatctcctgactatgccttccttactcctggccaagtaataattgctctctaagtaaagccttgcctccatttagttttggcatactcaaactttgagaagatttaagacataacacatgcaaaagaactatccacaagagggagacagatccaaataattcccctgtattaggtcagttcaaaatcaggtcgtagcaaagtttaaaatttgatgacttgaactggaattgtcagcaatatttatttgtttaatgctcaaagggtttttttaaaaactaaggttttcaaactagcaactcagaaaagattattttaatgtgtttaagggatttaatatggatctaatccctcaagataacttgattattaaaatacagtgttttgttcctctgcagtattttttaaacttaaaaaagttgattttgggaattccctctttgcaaaagtaattaaagaaatagctgaaagtcttttgaaaatttgcaatttaagtagtatttataaagcattactgtactattttctaaagcatatttggactgtggtttcttcttttaataggaaaactttatgtgctgtgaccagcgattttacttcttaatctttgtcaaatattctagaggcatgagaggacaaaactcaccatcaacatctgtttctgtgtgtgtatgtgtgtgtgtgtgtgtgtgtgtgtgtgtgtgtatttcaggggcagtggcaagtacagaagtaaagcagaagcttcaagagttcctactgagtaaatcagcaacgaaagacactccaactaatggaaaaaatcattccgtgagccgccatcccaagctctggtacacgtatgttcagtgtttggctgttttcattcctggggtaaagaacacaggttctgtatttagccgacctgggtacacatccttagcctgccatttctcagctgtctggctgtgggcaagttccttcagttctctaaggatcagtttccttctccataaaaagaggaaaataatagtgcatgccctctagggttgctggcacggtcctataaaataacatggtaaggtacataacagagagaagtgctaaataaatggtagcatttatcaacttgagggcaaggaagtatatatgttctttgatgaatgaataactgacaaatgtgaggtgggcaaagaaatttgtattttgcatttttccattctcaactggtgcatttggtatctatatagtaatttcaaaaggtttagcagattgtgattttattacacttgacttggtgtaagatggaggtcagagctattttcaaaaatctagtagaattttgtctcaaatgaagaaaaaaggaaggaagaaaggaagataagggagggtagggaagggaagttgagaggttgctaaataaataactctaagtcttcagtgaatagtttacccctgcccacctcacttcatttcttcccagacagcaaaataatagcttggctcctgacacacaacctgacaacataatacactgtggtattgtggtttttatagaactgtatttctgtaagtccaatacacaaatatttcaataaaatatagaggatgtggtgattttaaaactcagggcaaagaactgataggcaaatcatatatggataataaactaatagataatagtttcatttctttcttagaagtgtttgccaaatgaccatatatttttacacttatatatttttcaatccctcacaccattaaagataggaatagtacttgattactctgttatattaatattgtaagcagcctgggagttctatttaaagagttaatgtacttataaggctattttataggtatccgcccttctctgcatcccaaaacaggtaacagacagataccataatgttttataaatactttttaatgattttcataatttctgtcatgtatatcagttgacatgaaaaacaaatctctgaaaaacaatttcaaatattcaatcaatatcacgaatgatttaaaaagaaacacgattttgttacctaaaactacacacataatttatagctaattcataattcaaaattaaagtctgttctaagaaaagataatagcattaaatgagaaacagctacatgcaaagaatttgtcggttaaagttcattagctgttctcttaggtaatattaagcatagctctcacatgttacttagcagtatttaccttgtttttatgaaattgaacttcagtagagtccaactgcagataaccacaaacgattaatttatagaatctgaatttaatgccatttttgccagttatagctagaagaaatatccttaaaccaataaagtcttaagaatatatgatttaaataaataatactggtagaacaatcattgtgatggtgatactatgtcctgttcattgttttcattacatatgtaattatagatatttatatctactagatagtcaatattcagtcctataaactattctccagcagcacagttgcatctcttagattgtattcacccaggaaaaagaaaacatttaaaaaaattggtttcatattaaagaatgtgatccccattctttactactgaaactgccccagaagtcaggagatgggagtccgttggcacaatcctgtcttttcagtaaaaaaggctactctcatgtactcacatgtactatctagcaattttttaaaatgaagtccttgcgtatgtttactattaccttgattgttttatactgttgactagaaaggattgagatgatgacttttcccctagggtggctcttaagagaacataggcagtaatctcaaattgtcaaaagctcagactcttggtaaattattttagtgaagcaaactttctatgtgactgtatgaccaaacacatgctggacatccttaggatccctgcatcattccatagcatactgctacagtgaacttggttatgtgaggctatggtttgtatacactaaggagaaagagcataaacatagctgaggcacgtgtacagcgtgtgcagctgattattgctgaccaatatgcagtaaaaactaccaagtaaatagtgaaacttccttgtcttttctagggctgcccaccacacatcattggatcaaagctctccaccccttagtggaacatctccatcctacaagtacacattaccaggagcacaagatgcaaaggatgatttcccccttcgaaaaactggtaagttggtttaacaggaactctgtttgctcttctgtaacacacctgtaagtttcattttgccacacctctagaagaaagtcaaaggatttgagtcgtagataatatacctccccacccctgcccccagcataagcaaacaatgcacacacataccctacttatttctgcatcagttgattcatgacataatcaaaatatctctttttcagtttaaaagtttatcatatttgaactttagccaaattattttcttactaggaataaataaaaataaaaatttcgtatctcggaaaatctaactcttctccattagatagggcctctgtaatatctttcattgtcctgtttttctgctgtacctcaaccatttaccacaaaaacgagaataataaagtttaatttttccaataaatattttacaaaccttaaattttaattgtttttgtggtgaaagcaggtaaggccaaagctaccttctgagtaagtgactagcctaatatctcatggattataatagaactcagagtgaaattatatctgataatctcatgaagttaggggaaatagcgcaattaagcttttatttagaatttagtaaacagttctgtggctctaaggattgtatttgctgttccatcttcatctcctttctgagcattctgatatgtatatatttaatgtcttatatgcttttactgctataataaatgtttaactagatatacatataaatagcatttgtgtacattctattctaaatctcaacgttgtttgccaaatatagttctttagagacagtagtaaatttaaaaatgtttatctccacaactgatctgaaaagatattcatgtaagatagcttggtctattgtatttgactcagatctacttgaagaagtatagatttatttgttttatatatgaaatctgcagagtgaaaatgatttcaaataattatattcattttcccaagcaattttgagaaattaaaatgaatatagattgtaaaaacacatgccgaagctattttttgtcatataatttacctgtggcataatgaagattttaaaataaaatcagttatgaataagaatttattattcgccatctagcatatattgaaggcactaggaaaggatgtttaactattgcaaaacaacctgtggctttttaatttaaatagcccaaatatttttgcatttctactaaaagatgataagtattataaaataccttaatagaaggctatgcaaaggcaaggataattgagttttatgtattgcatcagaattccaccctattatctgcaaatcagagtgtcttataaataaacttttctaggatgaaagaaagcaaaatgtgagcctctatgttatttctaaaacatgagtatagtttatgaaaagtgatccataaaggacaggagttttagaatgtggggactttgatctgcaggcttgacatttatttgtgagtagcatgagtaggagctatttactgagattatgcagatactaccccaggtcttagggcagtgaatggcattcaagaatctaaggagttactaaaaggaaagaaaaatatggattccccttatggcaggaggttactgatgagtgatatagttacattcacagagaaagacttctatcctgctgagcacagagcctttgaatatatccttaccactgggagattgaaaactgactgcagaactgataactgactttgaaaagaagtggcatttgggaacattaagcacccagtgagaaaatctgatatttttaatacttaaggagaagtactaaaaacccatactttgtgtcccactgttgccatgcgaacagcttaaggtttttcctctgtgaagaataaataacaagctgttaatttattctcatagatttttttcaatccacaacacaatttaaaaagaaatccttctcaggatatatatgttacaaaccctatttagatttgtacaaatatgcaagacattttctgtgccttattatgtgctatataataatagtgaaaaatccctggtcttttctagaggtattttttctgtatttgatcagtatttcatgtttcttccttttatgttgaaaatctgatatttatgaagtgtctggctgttgatctgtaaaaccaaacattttcaagcatcgtagcaataaagttcttgaacagccattaatactttagtatctctatagaggttttaaaatattccttaattcaattccaattgtctgtttaagaaaaataagatgtaattaaatacagatgctttctatactctatctaaaatacttagagatgcccttcattaattacaaaataggtggaacactcagcttttataaatataatccatttggtgtatttccaattccattatgagaaaatttagacatatatttgcactaaaagaataacactgaaatgttgtcaaataatttttacttcaatgtttattgtatttcagtgactcaaaagtatttacaaacaaagcgaacaataaaattttaccataataaaacatatgtgatgattggggaaactgtttaagatagcttgtgtaaagctacatcatactaaatgaaatctggaagagtgtcattgatcatagagtgtaaacaccagcccagctactgtagagtgacgctttgttattagagccagattctaaacctctcttgtctgcttggatttcattgaactcaatcttagagttaaaagaagttgttaaatgagtgtatcctatcgtttgatctatgtatgatactattttagtttcttttaaatctacatcagcaatatgtattagcaagcaagatttacgagagtaaaactggaatcagagttagaaaagtcctaatgatcttacattgattgagatagccctaggatgtcccttaagcagtgagcacaatttgaaacctctcttgaccttttaggaccttccccagacagtgataacccgggaacagttaactacagaaacctcatttgcctgcagaaatctgacctttgtcacgcaaagtggacctttacttccttccccttaggagaatgatagttgctcctagaatttgggcattttagaaacatggaattatattaaaagttggctctaatcatgcccattccaattcacttttctttaaaatgtaagaatggagtgacttctcctcctttcacaacaacatcaaaggctttacataacttattttgaagtggaaaataacaattgtttttaatttttatatgcattgcccacacttaaagtagtacttccttctagaattatacattgtaattaattttgttctataacacaaggataggttgataggaaaatttggaatattttactaaacttatactttggctgaaaatagtatcattgctgtagtagatgactttattgtttttatatagtacactgctgaactgataataaactatgaagtagggaaaggaagttttggaaatagtacatatttcctggcactttggaaatggtacatgtttctcacagagattctacatatgtggtgattttgaactgaccttcaaaaccatttgattggattctgttccagtgagtgtgtgcatatgtttcataaaatattgtgataaaatttctagaagttttaccctccattatattattgaggttttacccaatgaactttgcctttctttgaatattacagtctttccatttaatacttctgaacaaagtgagttagctggctagattaacctcttaaagtgcacaagccatgtaaagcttggcttgggctgataagagacttttccagccccactgaaatatttattttaatggtcagcaacactagaataagactcaaagatggaaagagtccaaacataagtgaaggttttggaaggccagtatcattttccacactgagtaaactggaacgaaggcagagattagatatgtagctttataaattgccttttggtatagcagtcagcagttatgttctagtaccttgatgacctattcaagtcattataataaaaaacacaataattatttttaatagtttagaatatctcttcctctctctctccctctttctgtgtctttcagaatacacttgtgcatgtgtgaattgcatacatgaacattatacacatttctgcaaagatatcattaaagatggcttaggcttataacgatatttgctcaaaatcttattcaagattgacgaacactggagcatttttatatagcttagtactctatcttggttacattgttttgactaaacttgtcaaagtttatttttattgaaatatacttcttttaatgaatcttatactagttttctcagaattgagaagtaatatggccattgtaattcaggctttgaatccacacataccacttggaaatttgggtcctcaatcttgagcgattaatttaacctctctaggccacgattccctcatctgtcaaatgaggataataattgcacttggtttgcacagttatttttagaattcaattaaataatgcatgtaaagcacttaggatcatacctaggatttaaggagtgcttactcttgactgtatgcttgtataaggaaatgttatttatttctattatgccaaaactaaatctctttttgttgtagaaggtctttttaatgtcttacattcttctacctttattaatagaacaaccaaactaataaaaaggtgatcaatattttctttttaagctatgggcaactcacaaggctactgtcaaaatgagggtaaagttatttgttaattttgcatattctctggtatttcagagctcactatggtatccaaaagaagcagcaggctgcatgcctatagtcctagcgactcaggaggctgaggagggaggattgcttggcccaggaatttgagtccaacctgggtaacatagggagaccctgtctcttaacaaataaaataaaaaacggagcagcaggcttgtttttgttgttcatcgtaggaggaagtctgattgatgttctgtgctcactagggccagagttttaatttctgctgttaacttcatttttaaagtagcagactttaattttaagaaaagttttatatttacagaaaaattgagcagatattgttgagttcccatattgttgcctcctcctaacccctaggtttctgctttttaaatatcttgcatcaatgtggtacatttgttgcaattaaggaacaactattgatacattattgttaatgcagtccatagtttatattaaggtttactctgtgttgtaagattctatgagatttaacaaatgtgtcatatcatgtcatatatccaccattacagcatgatatagaatagttttaccaccctaaaaatctcctgtgccccacctattcatcctccccccacccaacttttggtaaccactaatttttttattgtctctatagttttgccttctgcagaatgtcatagggctacgatatgtggccttttcaaactggcttcttgtatttggcagtatgcatttaagattcttccatgtattttggtagattgaagcttttttggttactgaataatattccattgtatggctgaaccactgtttatccatttaccttttgaaggacatttttgttgcttccaaattttggtgattatgaataagctgctataagcattcatatgcagtctttgtgtggacatgttttcagctcaattgggtaaatacctaggagtacattaactggatcatgtggtaagacttgtttgttaaaaaaagaacaacaaacaacaaaaaactgtcaaactgtcttccaaagtggctgtactattttgcatgaccactagcaatataacagagttcctgttgctccacatacttgttagcactttgtattttaagttttttttttttaattttagccattctaatacgtatgtagtggtttctcattgtggttttaatttgtaattccctaatgacaagtggtgccaagcatcttttcatatgtcatttgctatctctgtatcatctttggtggtgtctttttagatattttacattttttaaattggtttttttctcattgttgagatttaataattatttgtgtattttgggtacaaattctttttttgctgtttgtcttacaaatatttttcctcaatcagtggtttatcttttaattcttgtatcattgtctttcacagaacagaagattctaattttattaaacatcaatatttcctttcatcgatcatgcttttagttttatatccaaaaattttttgccaaacccagcgttaactagattttctcctgttttcttctagaagttttacaatatttcatttagatctataattcgttttgagaaactttcaatgaaaagataaggtccttgtctagattcattgttttccatatcggtgtccaattttgctggcaacatttgttgaagagactatcatcctttctccaaagaattgccttagctcctttgtcaaagatatatttgtgtgggtttatttctgggctctctattctacttcactgatctacttgtctgttcttttgccgataccacactgtcttgattactgtaacttcatagtaattcttaaagttgggtactgtcagtcctcttaactcttcttccatattgtgttggctatcctgagtcttttgcctctgggtataaagtttagaatctgtttgtcaataaccaccaaataacttactggaattttgttttgttttgttttgttttgagacagggtctcactctgtctcccaggctgcagtgcagtggtgcaatctcctgggctcaagtgatcttcccgcctcagcctcctgagtagcttggcagcataggcacacaccaacatgcctggctaatttttgtatttttcgtagagatggagttttgctatgttgaccaagttacttactgggactttaactgggattatgctgaatctaaaggtcaagttgagaatagccatctgaacaatactgagtttttctatccatgaatacgaataattctttcatttagattttctttgatttctttcatcaaagttttctagtttttctcatttacatcctctacataatttgtttgatttatactttcctaatttttttggtattgatgtaaatgttactgtgttttaaatttcaaattcaaatggttcattgctggcatataggaaagcagctgacttttgtatattaactttctatcttgccaattggtataacagcttattcattgccagagttgtttgttgtcattggttctttgggattttctgcatagacgatgtgatttgtggacaaaaacgttactttatttcttcattcccaatctgtatgccttttttttttctttttcatgtcttattgcactagctaggacattcagaatgatgttgagatgtcgagcaggagaagtaaaaggggacatcctcaccttgttcccaatgtcaggggaaagcattttgtttctcaccatcaagtgtgatattagctgtagattttgtgtttgtgttgtcaaattcaggagttccctctattcctaattttctgagagtcctcacaaattaatgttgggttttgtcaagtctcttttctgtatcaactgatataatcgtacgattttttaaaaagccatttgatgtgatggtttacattagccaattttcaaatagtgaaccaacctcatataccaggaaatcctacttgcttgtgttatacaacactttttgtacatcattggatttgatttgctagtattttgtggaagattttaaaatctatattcaggagagataattgatcaatggctatctattcctataatgtctgtatctgattttggcagtatggtaatgctgtcctcatagaaagagttaggaagtagtcctcctattttctggaagagattagagtattgataccatttacactttaagtatttggtaaaatttactagtgaaaccatttggacctggtgctttcctttttggaaggttattaattattgattcattttctttcattagatataggcctatttaaattatgtttttctccacttgtgagttttagtaatttgtgtttttcaaataattcatgtgacttttcaaacttgtcagtatagagttattcataatattgctttattatccttctaacatccacagcatcaatagttatgacccctctttcatttctaatattagttattagtttcttctctcttactttttttttcctgacagcctgactgtagtttcatcagttgatctttcaaaggaccagttttttgttttgttgagttttctctcttgatttcctggttataattgtcttgaatttcccattaatttttactttttttttctgcctactttaagcttagattgttatttttcctctattttttttaaagtggaagctcagattattcaatttttatcttttcttctaatatatacacaatgctataaatttgcctctaggcactgcttttacagcatcccacagattttgataagttgtattttcattttcatttagttgaaaatattttgaaatttatcctgagagtttttttaagtcatgttttatttagagtcatgttatttaatttctaattacttgagtatttgctagctgtctttctgttatttattttaatctttctgttattgatttctattgtgggctgagaaaatactgtgtacacattctgttcctttagatttgttgaggtacatcttatgcctcagaatgtattctgttttggtcagtagtactaaagtctccaaccgtaataggtttgtctatttgtccttccagttctaacaggttttgcctcatgtattttgatgtgacattattaggagcatacatattaaggattgttatatcttcttggagaactgtgactattttatcaatatgtaacaaacaccacttttatcttcgataatcttcttggctttgaaatctgctctgtctgaaattaatatagctcttccaacatccttctgtttagtgtgaacatgttatatctttctccattgctttacttttgatctgtgtcttatatttaaagtgggtttcttttaggtaatatgtagttagaacgtcttgttttttaaatttactgacagcctctcttcgtgtattgagacaattcacatttaaaatgatcattaatataattagattaatatctagaatgtttgtaactgttttcttcattatatttacttttttaaaaaaatattcacttctctctgactcctctgctattcagaactttatataattcagtgctctctactctcttaacatatcaattttacctcttttaaaaatatgtttcagtggtttctctagagtttgatgaatccatttatagtgaatccatgtccactttcaaataacagtataccactttacaggtcatacaggtaccttataaaagtgtatttctaatctctcccttttattctttatattgctgtcatttatttctgttttccaaaagctacaattatccagtattttgttcctattattattgtgcacagttaactattagatcaattgataataaaaataaaagattttcttttaccttcatatgctccttcctttatataggtctgagtttctgacctatatccttttccttctcactgaaaaacttttaacatttcttgtatggcaggcctacaggcaataaatgtccttagtttttgtttgtccaagaaagtgctttatttctccttcttgtttgggataatttgtgttctttttaaaatttttttggcaacattttgtactatactttcttttttattctacagcttatgacaggacatctgatctaaatcttatccttgttgctctatagataaagtttttctttttttctatggtttctttgaagatctctttatcttttatcttctgcaatttgaacatgatatgtctcgatactgagtttttggtatttatattgtttcatattctctgagattcctgtatctatggattggtgtctgtcattaattttggataattcccagccattattatgtcaaatatttattctttctctctttcttgttattttgctattcccattaggaatatgttataccttttgcaattttcttagagtattggggaattctgttccatttaaaaaaattgttttttgcctttctttttagggagtttctattgacatatcttcaaagttattgattccttccttagctgtgtccagtctactgatgagcacatttggaccttttttttttttcttgagacggagtcttgctctgtcgcccaggctggagtgcagtggcgtgatcttggctcactgcaagctctgcctcctgggttcacgccattctcctgcctcagcctcccgagaagctgggaccaccaccacgcccagctaatttttttttttaatttttagtagagacgggtttcaccatgttagccaggatggtcttgatctcctgacctcatgatccgcctgtctcggcttcccaaagtgctgggattacaggcgtgagccaccgcgcccggataagaccttttttaaatttctactgctgtgcttttgatctccagcattcccttttcaatctttcctagagtttccatttctctgtttatattatccatctgttgttgcatgttgccaacttcccattagaacccttaacatactacttttagttcctttaagttccctttctgttaattccaaaatttgtgtcataactgagtctggtctgatgtttgctttgtctcttctgattgtttttcttgccttttaggatgctttataattttttgttaaaagcttgacatgatatattggacaatagaaattgagtaattatacttttgatgtgaggttttatgttaatctggctggggctgggctttgtttaatatctgttgtagtggtaaatgtcagagtcttcagttttctctagtttcctttgatttttttccttctcctattgctttggggtttccctaagagctccttcttaaatagaatttgtgtcctgtagctccctcagttttaattcactgttataatacagaacctggttgatgtgatggtaaggcgttggacaggagaaatgttctataaccttacaactaaatttcatttttttaagtgggcctgactttgtatgctgtgatcccttgaactacttcttagcctgtttcctccccttaagtaagataggaagctgagatttactaattgccttctcccttaggtcagataaggctctgtaaaatattttcccttggagagtaggctgttgttatgaagaatccttcgtgtgtatttcaaaattgttactttttcattagacaagtattacaaaatggttacttttcttccctctcccacgcctactccctaccttcacttaaacagaaagggatttttttctcatatattcactgagagaaactggttgggttcctggaagtaaaacccatgaaaatgtaggattcttctgagactgggcccctggagttttgtttgtttgtttgttttttgagacagagtcttgttctgtcgcccaggctggaatgcagtggcatgatctcggctcactgcaagctccgcctcccaggttcacgctattctcctgcctcagcctcccgagtagctgggactacaggcgccctccaccatgcccagctaattttttgtattttcagtagagatgggatttcatcgtgttagccaggatggtctccatctcctgaccttgtgatctgcccacctcggcctccgaaagtgctgggattacaggtgtgagccaccatgcctggctgcccctggagtttttaactctcaagctggttcacattcagcctccagcaattcatgcctccaacacctcattaaaattacctcatttaaatatttcttcgttactgactccattggcttctgctcactgtaagctgaactcagctgtgattttctgtattttcctatttctccagattttagcatggcagtttgccctgcaaccttaattctctgatagatctacgaaaataattttaatttttactttgttcagctttttacttgtggtgaggttgggagtgaaaatttcccagttcttcacatgtggaaatgaaaccagaagactaccacttacttttaaatctgtaaaacattaaaaatactttttaaaactcaactttttcattttttgaggtgacaaattcatatttgagcaatattattcttacaaattaatgattatatttattttaaagattaacatcagtgtccagcttgctcatgattaacaagttcatatgctaaaaactgagagagagaaaataggttgaaattattttaagtcacattttgtaagcaagacttgggaattgtaaggactttttgtcgatttttgtcttactgttttcataacattaaaccatttagcaaggtatgaaaatcaaaccaatttttgacctgtatcaaattagaaaattttagcttcttttcaaaataagactcacttttaaagtaatatttttttctagataataatttactttttaagcattcattttgatagatgtaatcatttagattatgaaaagttggcaatttcaaaagaacatatttagttgattttaagatactcattttttaaactaacatatctgaaatctgaattgctctcatggatgtttatagtttagtagtgctttctggtggcagggagttagtggtatacaaggtacttgtaaatgttgtaattgattaattaccatagtatttacccaacaattaaatggtccagaatactaagattcctcatgataaagaaataatacaaatgtataatttatacattttttactttaaaataacaaacatagtagaaattaataatcctaaaaattttttatgaaaaagttaagtatgttagtttcaaatcaatgaacaaaatgatttaaatttcacagttcagtaagtgagaagctggtttcattgattgcatatgcaatttgtatgacaagtagttggagctaagagcaagtatcaaatgacaattgtgtgataatgagtcagccttgtaagaacttcgaaaatctaactcaaatattttgcttgcagaaaagctaaggtagcctagaaagacaaagcatggaaaataatttcatggcttggcattagatgaacaaagctgagaattctagcttggcacttttgatgagagctgtgtgacctgcacatagtgcaggatttctctgagcctcagtttcttcaaatagcaaatatggaaaatatttgccttccagtgttattgtaagcaaaaatatactgcccagtacagtgtgtgacatgggtctcagtacatattgccagtatgaattattaagaataatagtatggcattagtgacaggaaatattagtagtagccatataatgtaattattgaagaactagaatggcaaaaggagacttaagttttaatcttaaccttgtcactaatacatgactatgagcatagtgcttcatgattttagatttctgttttttcagttaagtgcaaatggaccaaatgattcctaagattgtatatgaaactaagaaggaaatatataattgcatttcataaagaggtgtgataaaaatatattaatgatttgaagaatatataagaaataaatgaccatgcttttgcacagtggtatctcaaattaatcataactggtaagtgcagaaaagtctaatgacatatttttcactcctcatgaaatgctcatttagaacaggcaggacattttagataagattggaatgagaaaatggcaaaaaataataattaagactttaaaagcatttagccatctgttgtataatcatgagatttattgaaaaatgattcctaatttatagtattcacaactatagaactgagaacactgaggaaatattccatgcaaatgcatgcatttatatgtctttagacttacctaatgaagtaaattaagagatagaaaataaatgatgaaatatttgggattgtattttccttaaattttcagcctctaactcagttactttaaaatggaagtgttctttatggcaaagaaattggagagaggagtgggaggggagggggactggcttaagaaccatgttattattaaaagcagcacataataacagtttgacgtgacatgtaagattttttatcaagtgactttattttgctttatgtgtatcagcctcctgttttatagatttatttgctttttagcctcttatttgcatttttatttcaatattcacagtgattcctccattatttcccacttattcatatacaagataaattctaaagttatttttcatagaaccttcattctaacacttcccttatctgtattctcatatcattgtaatttttgctataaaagctggtaattttgtcaattatgagatattaaattttataatgttgtttttatcctgttcatcccaattagatgataaaaatatctgagaatataatgcttgtaacatcttcctcctttatttgacaaaccacactttgtgctgggcctggacataaatattaaataaaccagtataagtaaaaaaggatttctgacattaaggagctcacagtcttcatagtgaggcacatgtaataggttcctaatagattgattgatactttaattcagcagttgaacagttgaaccaccgtacttcttgaggaactactatttcatattttcagattataggcattcttgagtgaaagcaaagatccaagccacccgaggaatatagctgggaaaagacattaagatgttattattattatttttttggttgtaagccttcaatatctttatttcaaaatgcatattttaatgtcattatatatattttgaagtaggtaatacagaggtaattaagagaaattcttggagagaatgcattagcctattgtagctgtacatatgtggttctttgaaaatagtatggaccagcactgccaaatataatttgatggaagagttctatattggcatggttcaattcagtaggcactagctgcatgttgccacttgaaattgaacacttgaaatgtggctagtatgacttaggagctaaatttttgttaactaatgtattagttagctcataactaattttgttaactaattcatttgaatctaagtttaaaaagccacctgtgtctagtgattatcatgtaggacagcacaagtatacaccaaggcaggcacatgtgtggcataagcatcatggtgaaaccgtttcggtgtccaagacagagttcactaatcagtcacagcaaactcttccctctgagtttgaacacaagtcttagtaaaagcattctaagtcacatcacctaaagaagatacagtgtctaaacagaattatattttcagaactcgttaattttttaaatatatatatatttttattttactttaagttgtagggtacatgtgcacaacgtgcaggtttgttacatatgtatacatgtgccatgttggtgtgctgcacccattaacttgtcatttacattaagtatttctcctaatgctatccctcccccctcccccaactccgtgacaggccccggtgtgtgatgttccgtttcctgtgtccaagtgttctcattgttcagttcccacctatgagtgagaacatgcggtgtttgggtttttgtccttgcgagtttgctgagaatgatggtttccagcttcatccatgtccctacaaaggacatgaactcatcattttttatggctgctggaagacagtgtggcgattcctcaaggatctagaactagaaataccatttgacccagccatcccattactggatatgtacccaaagggtaataaatcatgctgctataaagacacacgcacacatatgtttattgcggcactattcacaatagcaaagacttggaaccaaccccaatgtccatcagtgatagactggattaagaactcgttaatttttaagaagcaagcaccaaatacaaattagtttagtttaaaaagtgggaggtgtttggagggggtcatttaaatgaattttcctagtgtccagctgcttagatgatgttatcaattcagtgtatttaaactttgttattggaagtatgagttccagtcttgcctcttctgggttttatgtgcagtaatgctctccctccaaattttgacaataacccagagcaagcctaggctcaccttttcacagtttaacaacgatagcaaaaacaaacactctttccccggtcattctgataaattcccaggaccatctcattcggacagcttatctcacttgcgccctctagacgtttagatggagtttgcagtttacctctcaaataacctggactaagagcaaaaccctaaccagcattcatccatctaatgggcagctttgatgtataaacttttctgtttagagttttgtgtggattttcactaatgcgcttggcctttcctaagtggacttttcaagtataaattgtctaccctttcttcacaagccatcgtaagcacttcaactcaaaggaaacttttcccaatcctctatgttttctgccccaaaacagtgatgttgaaatcttacaattccgttcctttaatttgcctttgctgctgtgctattcccatgtacacattgcacctccataataatcaagtttattcagaagcaggatttgtgttttattttgggggcctcaacagtgcaaatgatatattctttcctattacattctttcctgtttatttaaaaaccgctgctaacaacacaatagagtcatgtgaaatccttcgttttttgaaacattataataggtgatcatgtaagatttatgagatgaaagctgtattttccagagaaatgcattgagacctttgtaatataaatcatatttggagaataaagaatgtaatagcaagaagagcataatgatttattacatgacagtgatgtttaacctactttagacaccacactgtgtttttccatagtaaaacactgataagggaacagcacattactttagggtattatttggtcaggaataaatgggtaatcagtggattctgagatcacaactagcaagaataatatatatttgttcaataataattttgaagaaaattaatgttaacagacttatatagtagaatagataactttggtgactatgtgctagatccattttaggcatcttacctatatcttattaactctatgcaataatcctagaaatagattttattatttctcaccagttttatagatgagagaaccgtcacagagaggtttactaactttcctaaggtctgattttctttattatggcagtatgtacaatgccaggtttgaagacagcgagttttgtttcagaatctggtctcttaacccttaacacttattctttgaacacgaataagtgatatctaatatcattgagaatggcaattttgctaaaattaagtaccatgtagcatctatcctgataaaagtagtgacttataacagtttaggtggtgtcatttgtaagttaacttcagtccaatgatgaataaagttcaaaatctttttagaaatagcatatgtttgggatattctttgtaaaagcaatgatgagagatattttcaatggaaaacaaattattaaaatcacaaatttttgttttctttctgcatcgaaatatttaacaagtttttcaaataaggtatttcaaaggtgaaacctgtttcaagttgggctttccaaatatgtttgccataaacaaactttcagaactaatttgctgattattgacagaattctgagaaattgtaaatgtcatagtagtgccaaaatatgttaatttgctaatcctataaaggaaaatacaatttttcaaatctcctgtatttcttaagggaaatagataaacttacaggcccataaataatagacatactttaattacatgggtttaaatattccatatagaggctattacaaaagggatcttttgtttgtagtacagttataagaaaacaatgaatatatctccagcttttataaaatgttttttaaagacacatcaattgtgtttgccactaccactacatatacatatgtagaaaatcatttctctttggatttattactaggataatatttatctttttttaagaattaatatacttacttattgttattacagtgatgttatgagtcctctagaagtgaaagatgactgtcagatagagaaggggtggggaaggacagataatatgcatattaatgttagagaattagagaactgaggagtctcactgaagactccagggttggaaaagaagatgagtagacacagaattcaatgatgaagaactctgtgatacggaaggcaggaagaggaataaaatgttggctatttcataggtaagcattggaaacattttaatcctttccattgtttaaaataagtaaatcagataatccagatatagtgttgagtaaatcctagagatgagtgacatgagaccacaggaaaatatttagtcagaaagagaatggagaagctgccacatgaagaaagaccatgactgttaaggtctcatctctcttttaaggggcagatactaagaggagaatatgaaagacaaaaatcaggaagtttatgtttacagaaagtttctgagttttaaaaataggtatgttaaaatttgaaactttaggctgactagcaggaaatattttaaaattttgttggaagaaattttattaaagtttatagtctaagaagttgtacatgtttataattagatatatttatatatctaattatgtatttataatagactgaataatagatatatttatatttctcttttatatataaatatatataagtataatataatagatatatttataatagactgaatacagtcagtctattacttcatagaataaagattagaaggaactgaatatattggaaagaacagtccattagttttgtcatttttttaagagtttcattagcaatcttctaattcaagctgttccaaagaaataggtcgttttcacagttgtcccttttaattttgggaaatgagacaggagagaaggaaaaggaggcgagcaaatttttactcacacttaacactgggctggaagttgtggtcactctgagcacatagagcggattaagggacatttttgctttcaaggagctcagagtctggttctaagagatttttctcaactacccctaatgtaagcgtcttctagattttataatgcttacactcaaaatctatccctctcctaaacaatgaaatagaaaaaaacaaaaattcattgaaatttactactatgtgttgtggctataatttttttctttctccttttcttgtcaaactgtgatatcattacctatatgattgagtttagaataacttttattgagcatttattctaaagtagttattatgctaggttatgatgttataaaaatgtgtatcatctgattcagcgtttggtctcttctaaatcagtgttctgaaacaataccagggactcccaaatcctgaaatctgtgcatttttctcaggcttcctttttctctgtggcttttgaccccattgtccaacccatgctccttaaaattttaacctcatgggctgccctttcattcatctgctttacctctctatttttaccaccgcgtcctttaaatatgaagctcatgaaacctgaggttcctgaggttcctaaagttgcattgtctcttctatttttttaacttttctatttcaattgtcaccatcttaaagactttgatcctacttcttattcattctaaccagtagtcgtttctgatagtagggtttaacccagctttctcatctataaaatgaataggttgatcaggactgccttcattttttttcctctaagttcttttatttgggatctaactccacatctctaaacttcaaccttttcatagacttcaggctaacatttccaaggtatcttgcaactatttaagtgtaacagatttggaagttgaccctccaatccgccacaccgcaagacttcctcctcctcctgagtttctcagttctgccaatgcctctctcccaaacatgcaagcttgacttttgggttcagttctgtctctgttgtcttctttgttgtgttcttttgtccactctgtcaccaagttctgtcttttcccccacctactttttctcatttttaaagtaggaagcatcttttcagatgtatttttttttcttccataatgcctagtgtaaacgttgcacagagtaagtgcttggtaaatatttgttgaatggagtctctcttcttctcttcttgtctgatgcttagtacttgttaagaaatggtgaatcccaattaaagtcaacaaaatgtgaatcagagcaacattctcttttttcgacccatcttaagtacaacattttttctacccatcataagtacaacatttaaaccatctgaaatagaataaactggttagaaaaatagtgttcttctttgagcccctccagaatctgaattcagtgaaaatctgttcaaaccataattctaattaagggttttagctgccaaataatatgttctggttaaagccaagttagtattatggagtgtttcatgaataacagcacaagctttaaacttgctgttgattttctcatgggaaactcaagtaaaggagaatgatacctccctgttgactttaacttttagaaatgcaaagcatgctgaaattgtacataattctcttctaaagaaaaggaaatagcatttcaatggttttcctcagtgtcttattgagttatggtggggcacaattgtgtctgttaaactgatttaccagatggaaggttacattttatatttagctgattaagttgtaagagactggaattgtatctcatactataaaggtcatatataaaattaaaaaatattttgattaactattttgaagcaattaaaaggtttaaactgttccccctcctcttttacttacattaaactaaaaatgaagttattcttagaaataggcctatcacagagttggtatttggcttaataatatctcaaatggaatgtgtaaaacaacagcaacaaaaaaagggaaatactcccattcaagttttggaaattgcttttcttggctatttaatgtattcttagtattttatggttaaattaaataatccttaatttatatacttataccctatggaacttttacagaaatatttaaaggaaataaattatactttttgtcttttttctcttttggatcttctgcaagtaaacaaatacattaataaaacctttaccgtagaaaattaaatgtggcaaagtgctaagtaaatttttgtcctggcatttttgctgtgtgatcatatatcattaatactactctttaattcctactacattacctaaaaataatgcattaaaaatacagcccagtaaaatctgatctagtcagaaccagtatttcagaatattcagacttccaaaatagcaccaatcttggaattcattcaactactgtattattttcctgtggatgctgtaacaaattactgcaaacttagttgcctaaaccaatctatatttattactttacactgctggaggtcatatgtccaaaatggctttgcctgggctaaaatgaaggcatcaccctggcgtgttcttttctggggactctgggaatgaatccctctccttgtttattctggcttccggaggctgcctgcaagctctagctgtgggctgtcccatcctcgtggccactaggaccaaccaagcctttctcaaatggcattgcactgacacttctctgcctccctcttccttattttttaaggaccccttggataatccaagttaatcttttttaagtcagttgattggcaaccttaaatccatttgtaagtttacctttaccacctaatgtgatacagtcacaaattctggggaatagaacatggacatctttggagtggggcattattctgcctaccccaagtgcttagagttttcgttaagatggtgttttctgcagtgtactttgacttactacccctttactattttatgtgaaatttgtttgcgatgcctttatccgggcagtcatccagagaaagttgactaaatagaaggtgtttaactgatgatctgtctagaaaaggattcaggggaggcctgaatgaatctagaggtgaaattttgccttttatatccattcaagataggtaatagtgtttccttataaatatatattataaagagaatgtatgatatagttcagtaaagttataaatgctattgaggtagaattgaattaccaataacgttccaaaaccataaaggttgtctaaaggttataaaatcaaaacttgcaaagcaaaataaataataacagatgcccaggtgacttggaaggttctgaaacaggacaagagcaggaagcaaagtggtatttgaactggggagaggacagtctcctgttggccagaagtcactgctgaccccttgtcagtggtgctgctgatccatggtacctgaatgtatctgaggggctgtgaagagttgaatagacttagaggttacacctaaagacttaaaattatattgtgagagataacaattattagtaacagtaattagacgtttaaaaaatgtacgtgcatctctttattaagctgaacaatgtgattccctaaagaaataaatggaaccatgttctgtccagaaatctcagaaccacaccaggtgcctagttttcctttatttcatccagtactaacttctgttattgcttgctgttaaatctcccctttcttatcgtgcctactgttttagttcattccctattttgttcagcctccattccagttattaaccactgattccatcatactcctgtccagtcaatcctttgactttctaaagtttaagtctagtcttcctaccctctaaaagagccatttactgcctcttctgttatgtacaaggctaaagctcctccatcgcaagcatgatctctgtctccttattccctctctgacctctctcaactctccccagtccactacctcatacccctttgccctagcagtaatgaaaaaattgaaattccatgaacaaatctttctgtttcccattcacacaagccattctcatctggttttccagatgctccttgctcttaaagtgccctcttcaatagttcatactcatctttaaatgctcagatgatatatatacttcctctctgttaagctttacctggtaccttcctacccaccaggccaccccagatagtcacttcatattttatgccaaatgtatatgcccaaatatgccctgacatatctctgtgcatatatctctatattaaaattacattctactcagttgaggaatccttgaggacagtatctttagcctatttattattgtatccccagcatcttcagagagctcataattggcactgaataaatttctgttatatgagtaaatgaatatatgcactaaaataggaactaatacacatttatttgggtatttaaaattctagaagttgttttgctaaataatttttaagaatttaatttgcaataacattttggaggtaggagactaactgcttccggatgactgtaactgggtaaatcagaagaaaacaaggaaacaaaatttttcatgttagcaagttgatgttatagtcttttaaatattattttattttaattcttgtggaatgaaatgacttgctagaggatgattttgcaatttaatgggaattggctaaaaattttcagataaacatcagagagacaaaaacctaaagtaatatatttgaagaagataattgtatggcatttcaaattagacagtgatttactatacttattgtagtcaatgtattccatttattacttctgaactctttaaggtcaggaatggctgttattgtccacatttgcaggcaagaaaattgaagcacagcgacattaaatattttactcagatgttatggtggtagagtcaagactggaaaacaactccagactcttaggagggtaacaagatgaggttcatgctgagagaaccaataagtacaataaagtttaggtttatgatgatacccaggatattatcaggggataggtattgcctttctggaccatgaaatcctgacctataacgttttctgggagtaattccatgctgtctccatgtgtgtccctatcaagcactgggatgcaccctaaatagatctcacctactaaaatggccccactctctcacgcagtcagttcacatgtagctcttatgaactgtctgagtaggagggacattaaaacattatatatccacaataaaattacttttcatgccatttctatttgaatggtatataaaagatatatctagtacagaattttgtatatatatatatatatatatatatatatatatatgtaggaattcgtttgttacagaaagattcatagcagaataattacacagaattttagagtgaacaggacttgtttacaagaaaaaatacataaacacatgtatgaattcagatttcccccaaagtagcatgttatttgtgaaataccaattcagaagtatactttataataaaactttgggattcaggtagaaaagaaaattattttagaaactggattgaagactgaaacatgtttataatctagttcgatttattgaaatgataattcaaaatgatgctagatagatttttaaatttgtcttaggtaaataaaatatatttgaaaaattaaagcatataaaggagttagcatatgaaggcattctggcctgtatgagatatggatttccttgactccaaaatgtagtatttgtgatgcttgccagaaaagagaaattccttctgcattccacatctgatctatgagacctcttgccatgacattcagcatcaagaaattcttagaaattagggtagttgaggttcatctagttctcttctcaacaatatttgagactcagccttttaatgtaagtttccttcatgcttggatgtatacaggcatgtattattcattcagcaactgtttatggagacccatcgagcctatgttcttgctaagtactggaaatagacacaagatcaatgattacattatatttctgctaagcatcaagggctggagccatattgcagtgttttgaggttaggaagtggtagtggcaagtataggctatttctttaacttgactatgaaagtgcaatcacaggaagtagctcataagatctgtgtctatgggggcttatttttatttgaatgggaaatatttgagcctgtctacattctgagaaggagccagaagagagagggaatttgaagatacatgttgcataacctctataagtatctcatagattaactaaaatgtgtttgatatttatctttgaagttttattttttatttagtattccttccctcaccagcatacttaatctccattctttgaatgtgtgggctctgtgcccttggacgtggttatttcctctgcatagaactgcacttctcccacctttacctgtcaacatctcactaagccctggaggatcctctttcaaagcaaatgaatgtctgcctttcagccacaacactctgcttatacctatcacgtggcactgatcccagttagtatattattcattcttgagaccatgagcacctaggagaaaaagactctctgtcttttctctgggggagttgcctcagcacttaacatgcactttttcccattccttgattccttgtttgaataaatagctaaaggatttattccatgtagttggcactgtataggtacctgaacaatgaaaatatggctacacatgcttccagtctgcatgaaacttgcaaccttgtttctcaatattattattcaatagctgttaatcgaatgtaattaaacaatagatctaattaaatagtaggttttaattttaactataaaataattagaattttataacttactattaaaatttatttttaaactgaatcacactgattaaagtatttttatgttaaaaatgataatttgttaaaatgtcataaaaattttaggaagttattttttcctgtttgtcctagtattaaaaaaacagtaatgagtagtactaaaagtagtactaaaaaccagtgttactactgagtggtactttttttttttttttaatactagaacaaacaggaaaaaatagcaaatttgtacattcattcattcactccgtaaacttttactgagtttcacctgagccagccgagtgccaggcactcttgaggcacattggtgaggaggaggaaaagtgctgctcttagagggaactgagtgcactgtcatgagctttagatgctaaggaaaaatgcccacctttccccttctagaccatgctcctgttacttacggccccgatattgtcttcccatcctactctgcgatgcttccaatgacttggtagttctctttcccatgtatgaccattttttttcccgatatgtaaagaggttatcattgttgtttccatctgtgataaacgttaagaattaaatttctatttacattgatagaaggaaatacaacttcctagaaaactcacacaatgatgtacataacagtgctgtctttcgaagcaaaacaatgtgtagtacacccaagtgtccaacattgtcttattcttaagtgaaatattgtgtattcacatgtaagtgtggatatataatatatagtatatcctcataatgtatttttaaaagaatatataattgcttggggaaaaacataatagatttttaagtgaaaaacataataaatgcaataattttaaggaatacgtaattacctgggaaaagacccataatatattattaaatgaacaaataagatataatcataaatataatgattctcattttcaaataattttacctacataacacaaagggaacattttagagtatacacaaattttcccattcttaaaaatctcaaatatgtatgacttacataatcggaagcaagcaataaaatttattataaaattagcacttttcaaaagatcatattgtaaattgattaacatttacaaatatggattttgaaaaatggtaatcttaacaagtagacaaaattggtatatttgcaataagagaatggatagatgcagtagtatttctcaaaaacaaatagtattataatgtctttaggaaattgcattcatgtattaccatacatgtgcctagaaattcccccaaaattattttttgaaaactttatatatgaattacatactgttaagtggttataattagaaatagttacattagaaattttgctccttagtgtcaaaatatataaaatctaattcataacattaaaggttcattttatcccagccagaagaggcatacattgtattatttattgtagtatgccaagtagtacttttgaaaatatgtaccttttgtataattatgaaacttttaattagagtaacctgtgtattttgattaactagactggaggatctactgtgttcccaaagtgtctttcataactgtagtgattactgatttgaacagtttctagatttctacaatgccagcctgggttataggagagatttgggcaggaactgtgccaggaaatctaaccttcagaaagaacagagagtgaatgaataggtgatagattataataagtatttggttccaagtaacaaaacatttaaatatggcagctcctaagggatccctgagaggaggagatagcaggagaaacccaggggagggagaaactgtgtggagaagttgacagatatccagtactgcagggaagaatagacaatgccagaaagggatctgaagctggtggtgaagacttgaccttcacctatgattacagagctaaatgttcactacaggtggaatcattgtatatcccaaatattcattattttaaaaacatgtatgtatgtatttatttatttagagagggagtctcgccctgtcacccaggctggagtgcaatggcatgatctcgactcactgcaacatctgcctcccaggttcaagcaattctgctgcctcagctcccaagtagctgggattacagggacgtgccaccacacccggctaattttttgtatttttaatagagatgggttttcaccatgttggacaggctggtctcaaattcctgacttcatgatctgcccgccttggcctcccagagtgctgggattacgggtgtgagccaccgtgcccggcctaaagaaacatttattaatctagtactcaatcttggttaataattaatcatcttaatatatgaaatatgttaaaatatttatataatattaacacaatggaaaattttccattttttccttatgataattttcaataagaatgaagaacttctacataccacacaatgtggtattgaaattttttaatctaaattattgttgtaaagaatattcacaacctaggattaagagtgaacagaggccgggtacagtggctcacatctgtaatcccagcactttgggaggccaaggcaagcagaacgcttgagcccaggaatttgagaccagcttggacaatgtggcaaaaccccatctgtataaaaaatacaaaaattagctgggtttggtggcatgtgcctatggtcccagctacccaggaggctgaggtaggaggatctcttgagcccaggaagttgaggctgtagtgagctgagatcatcccactgcactccagcctgggtgacagagtgagacccggtctctggaaaaaaaaaaaaaaaagtgagcagaggcaaaatacacatagtaggtggtccttcttaagtggatgatgatctagttaagacttagaactaaacagaatacaatttataagcaggcaaattagaaagtgagaaaaatatgtgaagtcagttattaaccaaaagttattttaagtacactgagtcaaagttcagaaaagggctattgttatggttatggtgttttcaaacattacactaggcaaaggagtgtaccaattgcagccatctctctctctacttattttttattttgtttaattttaacataacttcatcttacatctgcacttcatgaaacattcattcaacatctatgtaatgaacaattttttttttatgatagacaaccaggtgagccaagaaccaggatgtgtggtaggcattgttaccattcttttgtagatgataaaatgattcacagagatgaaatcactcatttggggttacagttagtacatcaaagagttagcattggtggctgggtgcagtggctcacgcttgtaatcccaacactttggcaggccaaggcgggcggattacaaggtcaggagctccagaccacccttgccaacatggtgaaaccctgtctccactaaaaatacaaaaattagccaggtgtggtggcacgcccctataatcccagctacttgggaggctgaggcagaattgcttgaacccaggagggggaggttacagtgagccaagatcacggcactgcattccagcatgggcgacagagcaagactccattgcagggggggtaaaaaaagcattgggatgagaggtctggtctatttgtgtcagagtcctgtgtgcttctacacaagatagtttgtgtgcctgtctgcatgcatgtgtatacaaaaatcacgccccgcaattatgtacacagtcacacatatcaatctcttagtaaaatgacaagtctgggcagtgtcactcactgtaccttggaatcctaattttttaacctttgcttccgccacctaggtttactattcctctcccatgttttattctcatacctgccaccctaagtttattgtgtaccatggagactagtatgagaatgaagatttgaaatacctttagttcatgaggcattcttcagatattttctgtttccttttattgaggatattttcttttaggtgagaagagaaaaaggtattgggtctgttctgttttactattgattgttttcacttaaataatgatagccaatttttatacaaagttttcatctcagcaggcaaatgtattcagatgagcacacacactaaaaagcttgccttctgtttctatgattaattgagatgtagagaatgatgggtgtggggtaaaaatggaaaggtaattagtgtaactaggcatgaaatacattcatatacaagcagaacctctccccagctagtgatctttttctgggctctgaggatttgcatcccattagtaagtcactggcatggaaatcttcagcctttggggagaccagagcattaaaaatagaattaactctaactgcaaacggagtcagcacactaggccattaattcttctgcttgggtatatatcatgctgagcttctgtgtgtgggcttctgaaatgttaggagtgagttttatagagcattgccaggactaaatgatagttatctatcatctcatctctcaccctcactactgagattttaatatctctcatgacccaaaacctgaaatacaggcagaaggttttgctagaaacattaagtaggggcctttctttagagaagttgtatactgtatattttgttaacataaatctatgttgtgctttacagtatgtcagagattccttattttcaaaaccttatgtcctcagatcatcacaatgcctcaaatgttatcctttctaaaactgagaattatgcctttttgcataactccaccaactaatgataaaagttgcctagtgttattatttttagaaatattagtggtattggaaacattttaaaatcaacttccaagtataaaatttattgaaacatttaatatatacaagctacatagagtactctcaatttctaataatctctcttttcttttcttcccttacccttctccagcttctttgggaatctctgacagatattattttctttagtcatcccagagcagtacaattattaacagctgccattgactgattgcctgtcccagggtttctcatacttcgcactattaacatttgggtaaagataatactttgtcatgggatgctgtcctgtgctttgtaggatgtttggcagtacccctggcctgtacccataccagatgcctgtagcagctctccatactgatgaccaaaaatgtgtccagatattgccaaatgtcccctggaagagaaatcttccctggttgtgaaccactggcctattctctactagtcactatttcatttgatcctatagtagctgcaagatatgtgggactggctgggtgcagtggctcacacctgtaatcccagcactttgggaggccgaggcgagtggatcacctgaggtcaggagttcgagaccatcctggccaacatggtgaaaccctgtctttactaagaatacaaaattagccaggcatggtggcacatgcctgtagtctcagctacctgggaggctgaggcaggagaatctctggaacccaggaggcggaggttgcagcagtgagccaagatcgtaccactacactccagcctgggcaacagagcgagactccatctcaaaaaaaaaaaaaaaaaaaaaaaaaaaagatatgtaggactatattaatcaggatcctggcagggaacagatctttgcagcgtgggtcatagacttttatgaagggactacttaacaaggaagttagtaaggttaaatgaactgcttagggaagtgggggtacccagaaaatagcaatagtgggaggtcattcccacaaagaagagaggggaggaaatttttcctggagtgctggagagctggagccctggaatagtggcttccagagggagatgaagtcaggaagagacatagccatggccagttatgcagcactgtgacagggagagtgtaggacagcctggcctctccctcctccttaattctttggccaccagcctgtcctgccagtagattaagcccaagtgaaatccaaccagcaaagaactagagtgttgcagctccaggattcagcccccatgggcttagagaaggaaggacaattgaatctgttggggggaaaatgaagaaaatccctccaacatccccattttaacatgagaaatcgaggtttaatgatataaagtaattcatccaggcatctatttgactccaggcacaatgaaggtatcatcttagttggtctgtgtgaatgaactgatgttcagcaagactgtgaattattcaaggttactgattttagtaggtggtagatacaagactaaaacccagttctcattcctcttctggtgtttgcttttttatgttgaccattgaaagaaatctgagagctctatatctggctgattctcaagtagacaaacaggagtgaaagctatctgctgaccttaaaaatcatttctttctgaaaatcttggaaaattctaggtttcatctagaatgtttaaatggcatatgctatttttccaatctgtcagcacatttttatcttgattgcagacactcagccccagctgatgcaatatattaggagagggaggaggacaagactgagaataaggagatttggggcccagttctggatcagcccctcttagctgtataactagccttcagaaatagtaccaataatatgtttcataaacccttcccttctacattcacccagatcttcacagttattctcaggtatctaattggaaaggctttaagctatgtttcacaaatgaagaatcaggcttagaaagcactataatctcactgcaaatttcataacaggaaagttgtcccatgcagactgaattcacatccctcaatgaaaatgcatggtcttttctagtccacccactgccttttgaagtgatcaattgatttactccctatggactgccagtttgcagcatttaatccattaggttgcattataaaatcatatctccatctaagttctgagaatctatgatttcctatggttattagcaaggctacagaggataccaatgtagttagcacctagggattcatggttctttatttttcctttctaggttttagataaatatatttattatctataactttttggaggcaagatcaatatttttgaagtaatttaaaaatacatgtgtacatgaaaacatatctaagtacattaatacagtcccagtatctcactttattcctgggtaagttgggggttagaaactgagatagattcctacactaaggtgaagtgtgttgccactactggaagatctggcaagaatcctaatcctttcccaaattggttggtttgtttgccttcatgtgggagtcccggcaagtgatacatttcagatctctatcactttgagcttgtgctcacccctgatctctgccccaccttttgacaccctacttttacagcattttcgggcttttggtttttttatcttttcagtattttcaagcataaaatcaggtttacaatacaaaaaaagtagctttattttttgtatctgaacttcatttttaagttcctatttcaccaagccaattccaagaaaacatataatgcaagagttctccatcgaagcttaaagcaaaaagtatagatatttgaagactaaaacaacaaaaaaagtggagaagaattgtaagttctacctttgatatcccttgtggtctgtcaaaaatataaattccctcaaaaatattttcactgataaaatctggctacattataacattgtgtctgctctagatgattagtggtgctttgggaaaaactattttataatttttatgatgataatacataaggaaagctggaagagcaacattttcagtatttagaatagacttatgccagactacctgggtacagagcctggcttcatctccttttacctctgtaaccttgggcaagatacttaccctgtctgtctgttttggtttcctcattgatctaatcaaattataaataggcataggctttccagatgtttttatggttaaacaagttgatattgataaaacatttagaatagtactggaacataaaaaagactatataaatgttaattgttatgagaaatatccttttcatgatgatcattaccaccaccatcaccaccatccacttctgctgcacagagatgcaatccaatgtttccattcttctaaagtataattattttgaaataagtggtattattttaaaaatagtgaagctctgtaataagcttcactgtttagaatatgaaataaatggtaacatacatgtgaataatgtgcatttgtattatggaatatataacctaactcagaaccttcaattcgaagacttagccaccttttctttccagctgatagtatactgcatgtatagaatgtcttatttgcattgattctagttggtttggtgtcattacactgagtatgtttccccaaggttttagattagaaactactgacaaagaaatattccaggagtcagaattagacataaattatatgctgcagaggtgtcttcttattaccacaagccaggtcagagtctctaaaatcacattcagttactcttttagtggttattaagtttcacccttgagagaattaagaggcctgacaatgaagtataataaatcttactgtgacccaaacacaattagtaattaaacttcccattaacaatcccaaatctgctagataaaataagtagaaaacttatatttttgtttactttttactttcatatttagagaagttgaaaaaagtttcacagatttcataaaaataattgcaatatttgcctgtttcattaatgtagagtcaatgcctcatttatgtgcttgggtttttcatttgagaatgagaatggaccaagaaaagggtgagactttttttttttttaacacatgagcaattggctctctatttttttaatttttatctatttttttttttttgtctcaatccccagcctctgagcccaacttgaaggtgcggtccaggttaaaacagaaagtggcagagaggagaagcagccccttactcaggcggaaggatggaaatgttgtcacttcattcaagaagcgaatgtttgaggtgacaggtaattgaggactgggcagacctatgaatgctgggagtaggaatgaaaaaaaaatagtttagaataaatatacctgctgcatattaaaagttattttgagaagaaatatttcttgaaaggaaattatattgaaaactcacaagtagttcaataaaccttgctatgcattcaccaactgtgttaaacaggaaatgaatgaaaaaacagaagtatgtgtcaatcaaggcataactagggaacaccaaagctcaccttattcttttcaggaacaggcagtccattttgggaatgccaaccaggagaatataatttttaatgaaatttgatcagaaatgagcagagggaggtccaagaagaacactttcccctgtactcagacatgaatgtacaaaatacatctgggaaaattaaactacatggaacagcaaaaccttgacttttcaacaaatttacagaactcataaatgactttatgtgtttactagtgaagtgggacttatggcaggagggggatatattgctttttatgaaggggaagaaactgtcattttcatgggtctcaaatggaagagttatttttttagctgcctgttttagtagaggggttaggaaattcaacctgaggtcttacaacacccctagttccagttgtacctggtttgaaatgaaagacctaaggctgtaagaaccaaaaatactagccaaaatacttctacttactactgttttttgagtacctacttagagtcaggtactgtatctagttgtttcctttggttgcatgaagaaagaagtggtaatctgcaaccccttttttttcccattctcaaggaaaactgtgcttataccaatgtgggcagttggtattagttctccaagatcagatcttatttttagtaagttttaaaaaaattctttattttctgtataactcttttggccatgacagtgtctacaggaaggcaatatagaggaagactgtggaagtggtggtagaaacgtgtatttaggttctaatgcaacctgaaagtttggccgataatttttggaaaataatatttagtctcctattcaatctggacaactttatatgcttatctgaagaaaagtgttagtgatttcaatggaaagtatttccttgggataagaaatattaaatctgaataataaatacaattattttactagagtttatatgtattatccaacattaaatataatcactaatttagacgaattgaattctaagtttggagttacagacttttttcccaggaaatactattgtatgtaagtaaataaaaatcttaggtttttctaatagaggtctttgatgggggtgggcagttgaggagtgaatttgttttaatgaatgtgaagaattataaacctatcaggtgtctaatgtaaatgtagataggtggtttttctaactgcagaaagtaagccccttctaacagcaaaacttctagaaaagacaaaactgaatataatgctattttattttgcttcatagtcttaatgtctgaagtcatatttatttatcccaatgtgcttttctgtgttcctgtagtctgttttcttgatcatagctttttctacacagtcactttttcttccgtaccaaattgcagtggcatttagctcaatacctatctcagtaatgattggttcttatttataaggattatgatttaccagagttttactcgaatttccttaaatttaaaatatatttctcttcttaatttcgtgagataagcactcgccctttcacctcaggaaacaatatgtattggaagagagacttgtacatttattagaaagacatttctggtgagtggacttacggatgctttggtagatatttttaactggtataccgcacttactcgaaatgtctttggaggctccggactactgacacacagctgtcttcacctgtactccttcccattgctctgccaactttcatctagtttggatgagatttgtttggatcttaatactaaatatttttagtatctagtcagagactatcataacatcagagcagttcagttgcttttgctgttatcctcttacctctatgtcttttctctcttccccatttcatagattaaagtgtaagctcttttcaaactcattccactcattgacatgggaacccacttgccatctttttttttcaaattcaagtattttctgccccctacaaaaagtcctgttcttttcaaatgttaaaattgactccccctgtgcctgcaatgccttctctgccattctccctactccaacatccttatttcattggctacccttcttcaagctccagttccaatatcatacactgagatcagagatctcagaaaatcagttgctatcttctcccagatcccatccagtgtcatgtcatagaatcctctggtacagtagttgttgccctgaattctagtgcttatcacagtgatttctacataaggaaatacttcagtcttaatatcataaaataatataaatattataatttaaaattggtaagacagaatgtttaagaaagtagtttttaaaaaatatggaaatggaaatgatatggaaatgagacattaatgagaaatcagtcatattgtaaagacgagagttaggagttgggaaaaagaagctcctgtaagaatttttaaattctacatttcctttgttaaagtaaaaccagaggtgatgattaaaaaaaattaatcaaaatataaaccagatatatagacagaaaggcagtgagcaaaatgtgtttaagtattttattatactaataatttgctcaaatcccacagtaaataagtggcaggattagaattcttacattaacctcacattctttccagtggtactgcatttctgagtagagatttaattataatacaagttgagagttataggtgttctgagagagggtaagaaaatattgcttggaaactgggtgttccctttctctgagggacatacgttatatgagccaggcttggaccttataggtgggattcggcctgcaatgaaatggaaagaaaggaggatacaaaagcatgaactggaaaagtatttggcatgaaaggagaataggtgatttaatttgactgagtgtagagtacagaaagggcaatggtgggaaataatattaggctctattttggagcagagggacatggtgtgagttatctctgtctgatccttttgcaagagtttgaaagaaaggtttgagagactactgtagtgactcagaaatatgagcagacttttgctatagttcttgacagaataacaaggccttaaactgaaatgattgtagtcagacatagatggagagatagtgtaaagatcacattaaaagggcctagtaactaattagatttgcagtaaagagagagtgaggatgactctagggtgatgaaaaaatagagatatgcaggaaacagttaatattaaaatacatacattgagttttacacatatgtaggggagcttggaaggtccagctttcagaggaatttgggctggaatttatgagttaaaggcaagaaatgtgactttcctgagataattctgccccaaaatgacatatgaagtcatgatactgagtgattttgacaagggaaatagaaaagggataaagtcacaaacttaggtgaatgtctgaatttaggaattggtaggaggaagaaaagtcaaagagatgggaagacaaacatggatgtagagaatgccactgtagaaaggatgtggaaaggaatgttttctctgaggccttcaagtgtggtggcatttgagagaacagttgcagttaatagtgggtaagctatattgccaaggcttgaagaagtgagtggacattgtgagagcacaccatttctcaagaattactagcatgctgtcagactagaggggcaattccagtgtaggaggagggcctgaagattccacctaactaatccttttaggatttttttaaggggatgggatcatgggtaagactaaatgtgtgagcgttagagaggaagagaaatgccttatatttgaaatgggaaaagagaatgtagataacataatcatgagtagaaagaaaagatgctggtggaaatcatatcaaaaatcctgtctctgaaaagcatgaggcaagatcatttgtgcagagttgggttgacaaggtgtaatgatgaggcagctaggaagattttgaaatgagtgaagtgtagaaggtggtagggaattaattagagctgaataaataatttgccaaagcttgataagatgacttctctagctatatttctaggaaatggaaatttatatttttgattaaatgttttaataaatgcattagtttctgcataagttgaggtacatgtgaatttcatatctgaagaggaaaggatgggttaaataaagaatctgtcttgttgttgcctgacttttgctaaaaggaatttcttgttatattggtatttacaaatctacatgttaaatttaggcaacttctcattttctggaaaataagttgagtagagttaaagtcagatggtcttgtacaaggtcatcagtgcaatgttgagattttacattctattgtattttcttcatataacttgaactagtatatgcaataataaggtatagccttagtatattaaataaaaaacaatttacagcacagcatttgaacaatttttttcagacctaatggaatgggtctgaacctcatgggttaacgacttgtcttttgatgtgcacaagttcattgtcttcattactgttattttctgtaatagcataagagcaagtaagaaaagattcctttcttcagttttttttttttttctcattcaaagctcctgtgaccctctctaactggatatctttacttctctagaaactgttgaacactatttagtatgttttgccatgaaaacaaaggaggaataagtggtatgaaaattcagagttactgcagaaatttttagttctttctattttgtgaaatagtgcttgcatttacatagggggaaaataacatgcccaatgttacatgttacagtaactaaagttcatctatgtatgttcctcatgaacacatttgtacttcacaatatttttcagaatcctcagtcagtagcagttctccaggctctggtcccagttcaccaaacaatgggccaactggaagtgttactgaaaatgagacttcggttttgccccctacccctcatgccgaggtaagacccttattattttgtttcttttaaaaactgaatttctgattagctacctaatacaaagtgatatttctgagttgaccttcaatatccaaatgatatttatgaattgaagtttactcagttccacatattgtaaaccaattgaaaaaaattgatatttactaactaatgtaaatattataaacctataagaaatgaactgatatttattagctgacataaataaatatcaatttttttcttacagattttttcttatttatggaattcagtaaaattgatcttatttataaatcagacaaccaaagatgtttggaaggcaatctgggcttgaaatgtaatcctcagtcaaacattcttagtgatcctccgtgcacactgcctgacaattatgtaacttactagtccctctgcttggttattggttgtgccgatgtgagtagacacatcagtaagtaaaaacaactcgtacaggcctctcagaggaagaacctagcgaggtggatttttatccatttgaactgaaaagtgatgaaaaataattgcagtattatagttgaagggtgtgaagcttcactgagcaaacattttttgagcacctgctatattcaagtcattttgcctcacagtagggatataaacatggacaagatatgaactctatgtttgaagaatgacatattaaaggatattagtttaaagtaacacatgatttagtgtaaccaatgatacaagactaagaggaaagttaatgtaaaagtcagcaagaatttgtctatgtagtttctgtataaggctatcaaaggcaagagtctgaaaatagccactcatgaaatcacctgttttgaagtcatcaacaattgactgaaagccttatttttgtttctgttattatgccttcttcactgtgcattgctctgtgcaaggagagctggtgcgttaacttctaatatataacatacttcttttgttatattttatagagtcatggtaccttgagacagaaagggactggtcaagtctcttattcttggatcatctccatagcttttctaccatgtggttatccagcctctgttagaacacttctgcttatagggagctcacttcactgtctcctgaggcaacccagttgattttaaatagttattttgactgatatgtctctgtacagctattgctctgtaatttcatatattttatacacacaaacacaatatgatatgtataataaattatttataagttatgaaattatcaggtcagaatataataagtgaaggcagaaatccagaagttgtctctgatgagcaaaggactgaagccagtaaagtcagttttgctctaggcacatttgcacacttgagttttgagctttggttttcagggcctcagaaactcaagagatagaagataaagcctagtaccaaccagggaggataatctaataggagatcctgcaaacactaagctgacaccccagaggcctgtatctatgttacattgattagttgactgcccctcttactgctgtgtcccctgccagccccccctgccctgggctgtctgatgtggaacagagcagagggcagatcctctctctcagatgtcgtaaccacaagctagtccttgtgtagatctgtagcccaaatcatataacctcaagctgttaacttgacttatcatggcaccacatttgtagttcccacgttaggagtctgcacaaagcaaacaaaaactcccctggaggaatataccttccttctagatttcaaaaatttccctcaaataagtttccaagaaacatgagcaaaatatctagatgctgtcgtttgaccattttcagctatttaaagaatagtaattctggcctctacatggtcttcaggtcccgcatctatttcttacttactatcctgttacccctctttatctttttctttatcctttcaaaaacatgatagcagatggaataaatactttgtttatatttgcagccagagacataagtggagttattgggttattagttgtagatagcatctttttgttagtgcagttatatctggatattggtccattctctgcaactatttagtaaatttccaggaaaagaacaacttggttacaattttttttttcaaaaaattttagattgttgttatctctcagtatgaagagtgtaattcttagtaactgcaaaaacagcaaaggatctgggttctaatcagtccctggatggattttgtgccattgaaaaatgaaaacaacacactagactacattcagcagcatgtatgattctgagaaatgcattgtcattgcaatgtttcagaagaccacttacaacatgggaggattttattaggttcagaaatggtaataccatactttgataatatgtagtaatagtatatttttaagaggcgagagagtgatgaacacaaaatttagcatgatgattacctttcaggggggaagaagggggaaaacatgatttgatagttactaaagaagatacatatattccttcattgtaaatacatatgtatgtgcatatagtatttagtacaacatattggaacaaccagtaagtatacatcagtgaagaaagtaaataaaagattttgcttatactgttttaatctgttttatatttctaaagccataacttggcacaaatcatctgtttaggtaccctagcttttcagctaattgttgaacatattctctcactgcaaacctttcctttcacccccaccattaaaaaaagaaaaacaaaacaaaacagagggaaatgtgatttaatggagtttaaaagggtagaggtatttcttcaggtcagtgacaggacattcacctccaaatctggaaagacgagttcaaaagcaagcagtgacttacctcataatgaattaattgtgtgcctgaactatgatccaaaaggccaggtgggcagacctttatgcactgatgagtagcctctctgtggcccagaacaaaaaatgcaaccctgatggctaacatgtggttttctgctgtattgcatttacagagatctatggtgtaattcattctcgataggtgaggagacagcggaatttagactaagactgtcagcaaattaatatcctagctttttagcactaaatgtttccacccaaactggagaaaagaaaaaaaaaatttcttagccatagttgagtaaccatcatttagaatttaggatgatttttacagatgtctcctaagattgatagtagtacgggatttcatagcaacaaatattttgggggtatgaattatttgcataatatattgcactctaaaaaaatggttgcatactttaccgtttacaaaattggcttattttactgtttttgcttaagcaacactggtaagttttcgtattaaagtagtgtatatttgaatgaagtctttattttatggcctgtaagtagaaaagcatgtcacctaattcagagcccatgtaaatgaatgggattctatcctattgtgctgcttcagaagtaggaaagtcaggctatatctaaagatcttgagccctagatgaaaacaaaattttctatcttgtaattcacatgtcctgcctaatttagataaagggaagacagaagtaggaggagaatttactcataaattgaggttcaggaaatagcacattgtagtagaatgtatgggtgttccattcagaagactcagcctgaacctggctccaaaaccggctaccttgtcatcattggtcaagttgtcagacttcccctgacccccagattcctgatctaggagaaggtagtaccgtaatacctacactagcagctttgttttaaggaatcagtgtttggaaggcaggtggtaaattgtgaagttcggaacaagttcattttttgttgttattatcagcgctgactcctggtagggaaaactcattagcatgtttgtcttcaagccagcagctctcatgtgagagtgagtctccatctgctctgaccacttctgttccatttcttctatttcctacatatgctcagtcccagaactcagattgttggagctacttgctttactcatttgtaaacttggttggggagctgaaacctcaggggtttctatttccaactccagtcaaggatgtctttacctatctagttactttattgttaatactgtgggcctgtgggttcaaatatgtttccatggatatcaacactattactttagattcagtagatttatttgatagctattttaacggtagccaagctgctggtttatttctagttgaacattagtggctgtctctgctatgctattttttaaaataaattttccagcagatacaaatgcttttaaaaaaggattctaataataaggttaagtgttctaaaatcatctgtaatgtcacttgttttgccccaatctcacatgactcatctgcctgttgtttcataatagttgttgtgacatttgcagtaaatgttatgctcccttctgagtgggtgtagagctgtggttttagatagcagcaaataaaacacgttccccccacccccaattcagggaaaggaggttgctatgacaaaataatcatttactaggaataacatgagtcaatattttaaagtaagatctttaacaaaacatcagtgcctttcaaatgctaaggaaactctgtcaaatgatctttctttttttgttttttgttttttgttttttggtctcacaatatgtctcaccattttatagtaacaccttctttggtgtccagtaaaatgaaaacttgagagatttctactgcttcaacaatttttttaattacgtggagattttaattttctatgagctatctgaaagaagagtagaaaataaatacaatcttgaaaaatcccatgaaaaccataggcaaatattaaatgattgaggcttttcttttttaaaacgtggctatgttctttttagatagcctggattcagggacttgggaccttgtaaagccaaagctgattgacactcataaggatgtcttcctgtatgccattctaatagacacacatgttacctgatagagctgggcagaggtgcttcagtctcaggctgaaggttctgaagtccagggaagttgggtgctgcccagggttacaagctatgagtgggagagctcaagtataagacacttaggccagacttcgtttcacaagtccaggctgctcctcaccaaaattctgtgtgtatatatatattttttctttttctgattctcatgcatattgtagataatttggaatatacagtaaactgaaaattctatatccacatttctgtgagctttttaaaatgtgagtgattactggccaggcatgggggctcacatctataatctcagcaattcgggaggctgaggtgggaggataacttgaggcctggagtttaagacgagcctgggcaacatagaaagaccctgtctctacagggagaaaaaaaaaaacctaacaaacattagccaggagtttgagcccaagagtttgaagttacagtgggccttgatcgcaccactgcactgcagcctgggcgacagagcaagatcctgtcttaaaaaaaaaaaaaaaaaaaaaaaaaaaaaggaaaagtaggtaattatttacataactagtataactagcattctgtcaagggctatcattgacttttttgtcttcttaagagtaagaaaagtatttgtttatcttcttctctttcccttcctccttttttccctgcctccctccctccttccttggttccttctctccatctcctttccccactttcattttccttgctcctggaggcatcattctctcccgtgttcttgtttatatgaatttttacatcatatatattttttactttgcatccatgagttttaatgggatataaatggcacaatgttatctgcatcattccattttcttgcttttatcactaagcctgtgtttttacatccagacaccatgtctttatggatgcagaagtccaatggtgtgctttcaatcaccacaaaaatccatcgtgggtgctgccgcgtactgatgccccgaggtagatgtcctggtgcccttcaatatataccatggcccatcatcctacagcttaatgagataatttctcgaagttagaattcccagcaaagccatcactgggtcatggtatacagaataattattttggtttaaagttcagcagaattgctgtaccagactactgtcccaccagcatcatatgagagtttttacctttctgaatccctgtggcagttgacattgtccatttttctaattatacccagtgtcccttctggaagacattctcactcttttaattgaaatcagtggcttaatttaaattccacataaatagctctattgagaggcataatgttccagtccatgtgttttgtattcatttgaattacaaatattatttatgagatgcccctcctattgacataacaggagagaaattaaataagattttgaagagccttagtaaaatgtgagtaggccacccctaccccagcacttggcccatttcatatctcatgtcccaacataatgctccttcctctaattacagtaattatcacaagtcaaagaattagctctttacttttctgtgcacctaactaccatgtgaattggtgttttataggacatctttgtacgccttgcacccaacaccattaatctaagacagagaagttacccgttaattgttttgtgaaggttaaacaatagccattcatacatttactatattcattttatctaaccacaataaaaatctttggttctgaaaaattttcagattaaaaccgtcatttccatgttctaaactgcaaagtattggcatcatagcaaagcactgatttaagggctgggccagattcaaaacttcttcttggaaaaatcttggctttgtctgaaaacacttgtgagctcactgcaatgctaaggtgggatggtcttccagccttgcaagaatgctagtcaggatctttcattgtgtcaggtgaatggtacccctcccaatctgttagtctgactttaaagtgtgtctgtactcaattagcagtgtagactatggctccaggtcttattaagagataaacgtggaacagatagactgctccgatcaaaaagcatagttgaggaaagctgtatttaaagaaaataattcaagggaaatggtttttcatttctctgaagtcatcctagaccttgaaagtctacataaatgctatgcctgtttccttatctgtaatccaaggagataagctaagcaatgtcccggtctgtaaagtttctatgaagacgacataccagttaagagtctttgggaagaaccaactatacctagtagatatgggggacacagaaccatccttgcttcatcaagaattgtctccatgacttgaagatcctgacatttataaagtcaccggagcttttttcttgtgccaagtcccctgactcccagttgcactcctttattcctgccatgagcttcagagcctgagtttgcttcctcttctcctccaaagccaccaccattctccctacttttctgtggttcccctgtcttccagcagtggctgcagagtcatactccctgtagcagcagctgtcaacaaatctcatagccttggtcagtttaaaggttttgttgctggtcccacatggaagcaaaattggggaaatgactcagtttcctcatcgacagcatgagcataatggtagcttgagagtgcctgtgaagaataggttagcctccaaaaaattctggcccaggacaccatggtaggtgctgaatatcagtacactgccagaggaaatggagccactcaagttttataggaaactacaaagatctgcaatcccagagtaagactgtccccaaatctcttcactgtagtcaaagccagtgtgaggagccagtgtgttgctgccattattacgtctgagaagataatctatttctccttttagtttaagtctggttcctgtgatgaggtgggaggatatcacagaaattctctctgggaaacaaagaaaactcttttgtgaggtctatggtattttttgtgccattctcccagtccgtgtcaaatcccctagtccatatcttagtgctgtgagaagcagatataaccttgaatgaatattatgccctatttaaaatgcttatttttccacacttattttctcttcaatgaatacagataagtgaataacatatccttttattttaaattactatttactgccaataagctagttaaaatatttttacttccttatatgttccttttgttcttgtacaggtattctatacttacaattttcgtgaaaagcttattatttgtatgagtaaaagagtagcttgcctttttgtgtacagcaagtatgcaactctgtctgatagctcataaaataaaattgcaaccccacacattgtaattttaaaatctttcccaacaatcttcatgctatgtcacttagacaactaattttttaaagggctgcatataaagtcaatgtaatgttattgctttcaacatacctcttggttttcatgcacaaatatctgacatgttcctttaagaagtaacaaaatctgaactagctttgagttccaagttgcaatgagaaaactccacatttaaccttgtgctcttattatgttaagactaagactcatctccaaacaaacgtatgattgagatgatgttttggaataacatcctgtgttttggtggtgcatcactcttcagtgacattctgaggttgcattgtatcagcacatgatattttccccggttaattgatatcccaggtttgtccaggggaaaatctacagctcccccaaacatgcttgacaagttattatatttactttagtcaaagcccgtgtgtgcaatatccctcttggaggtggtctattattggagtcccatatgctttttgtttgggaagaaagcagccactgtgtcatactgttacatggagtattctttttcagggatgttgttcccttggggaccatatcaggccagagttccttagtctaataagacctttgtaactcttattgtataaaagttctgggagggaggcaagagttaaacagaaaatgtaattcaagcaaccatattaggccacatgtgggaaaacatgactcttagtaatggattaaaaaaaaggtatttgttgtaaaaagcacagtgatgccaaaacgttcagggtatttcaatgtaaatgaagcctactgtggcataggactcataacattttaacatttactttagtttctgaatatgaatgatctaaaaatacaccacacagaattgtctattcataaatgtttataagtaaaaaagatgtgattactatggaagccctatatggtgatatttaatctaagatttttcttgggtcagttttcccatcaataaaatgacattaaatgaagaatcaggtgaagataatgactgtggtggcattatatacatatttttttcactgagtaatacaaaagaagtagacatactaatcagaattatccaattttatcattgtactttatcagcagatgacaaacatgctgaccatattttgtatagccagaattttataaatgaatttgcaaaaaatgaacatagatgccttttattcagattttataactatgtctttggaagaaattttttatttaaatttgacattataacttttggatatagaagtcataaaataaatacttaaaatcttttcttaattatggtaagacccattttctgaaatgagaacattttacagtaaaatttgtgatactgtggtattttgagactctcctctttttttaacagcaaatggtttcacagcaacgcattctaattcatgaagattccatgaacctgctaagtctttatacctctccttctttgcccaacattaccttggggcttcccgcagtgccatcccagctcaatgtaagtcattgcacagcatcagccttaatcaacctaagcaatatcttttcacaggggaactctctttcgtgttttatgtatttagactttagaaaaacttgacagagccagcatctccttcactgtttgctatttgctgtgttgttcaaagacattcagtctaatttcaagtcagaattatcctggttcacataatcatatgtaaacataataactaacatttgtataatggtttatagcttttaaaaaaaaagcactttccagatatattattttaatagctccacacagccatcctgtgaaacagagattacagcccacgtttttacagaaggagaagctgagacttggagagtttcaaagcacaagatcacagagccagtaagtggcagacctggaacacaagccagggcagtgctgagagctacagcttcgaaagcacagcagcatatgtttatagaatttattttgtgaatgagtttattttgggaatttaagttactgactctctggtactggcgaatatgtatctggaaaaactctctaagaaaaatattaaactattcccagaagattcaaagtgaatcaattagtttaaaagtcctgacaactgaaataggctctttcgggaagaaagcagtcactgtatcatactgttacatgaaggcctagaagtgattccttgttctggactctttgccttaaaatttcctagtactcagcagagaaaatggaatactagagatctctttgccaaagcagagctaaacttgaaatgttattgtcatactagcagaagatggcaataattattctaggcatattccctgaaacagtgtcaattttagttgtaaaaaatgtgtgggccttatccagaataattcatctctgaaatgttagttaattaaattgtatatatacaggggtcatatgatacattaggtttagagagaaatttattccaactctcatcaccagtttggccaatctttaccttcaagtcttccactgagttgaatgtgtcaagttcacttgtatgttcaacacatagtttcaatgcgtattttaaaatcaacctaagagatattatatctggtattgtcaatagactataatgtcattttatgtggtactgtgttcttataccaatgaggaaaaaacaaaatttggatgttgtcttatatctggggattataaaagaaagcattgaaaatacagaattcagctatgctcttaaaattccacatgaaacatttgtaaatgaaaaacaaaaaaaggaattaggaatgaaactaaaaataaatattcatggataatattttacagttatcactaattaaaaaatatttttccttctctatttcctgtctcttctaatgataagtaaataccaacccaaaaacttcttatgacacatgaataggcattttatttttacttatttttgtatgttctaagccactcctctcaataactcacacatggaccacttttaatgtggtcagggaaaattttttcccaaaggaccaagtactaaagccagaccagttaatgtttcagaggtaatacgatttggtaccattggatgaataaaccaatgtggtttggattaaagtttcatttttctttgcttccattttggtgtggatgaggccatcacaattaatttttcaagtttagcattgctttgccaacgggatttgtagtactccatttctacattgaatactgggaaattttaaggaaaagaggccaggacaaggaatcacttctagattaaacattgcattgacttactgtgtgactcagacaaaccacttacctctttgtccttcagtttctccattgctgaaaattgcttcgcctccctggtgcacagcaattttgaaagatgaaacatgagttttgaaaagaaacatgccacataattttgaggtattagagtcctgcttttgtaatagcaaaatgaccaccattcattaaatcctttgaataggataattcattattgctattgatgatataattattattgccttattactgtgttatcatacatttcaagttcttaatagcattttttgtagtttattatacaaaatatctagagtgtcattttcaatatttagagatttgggtatctgttatgaattaatataaaatgtttaaatcaaatttctgcatatttttacctcctttcattgggttattttaagaatttaatttaaaaaattaaacattggacacttacagctctgtgaaattattagaagccatgtagagaaagggtaaattgttccttttgcttgcaactccaaaattacagtccatcttatctccagcttcttaatccccatgatatagtctttgaataaattttacctctccagtatgcctttaacttaaacagtgtataaaatattttagaaatgtactttccacttattaagcctgaaataagcattttttgtttttttattgacatataaaaggtacatatatttgtggtttacaacataatgatttgacatatgtatacatcgtagagtgacttaagctaattaacatatgcattgtctcacatacttattttttatggtgagaacactgaaaatctattctctgagaaattttcacatgtacaatatattgttattaactgtagtcatcatcatgtacaacagatctcttgaatttattctttccacctaaaattgtgtatgtagcatcacttctgattttaattataaaacctttttatgttcaatacaatgacaatattaaattgtcttcagtgctccaaccctatttttattccttcttttttgaactgagttagtttaaaaagtccattttccctgctcagccattgggtaagatggggcttttgttttgggaagctacagcataggaaacttgtctaatgatttagagacccagtgacccacatggatgaaagaggattaacatctttgttatttctcaacacaggcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtaattcattatggcaccatttgcaggtcattttagggttttattttattagtgatccaggataatgtctcttttactcaagaccctgatggagatccacagtgctatacaaaagtttccctgatacctggtactgtgggaaaggctatcatctttatttattccttcagatccacttggggtaggaggactcacctcatttaacctttattcataccagactaggctgtggtgagtcgtatggtcagatgcgtacctgtccaatgccttgacatttctctcttcccacacctgacctattcttctgttgtttgcctggtagcatcactaattcactaattttcttacagtttataccatgtatctgttttctttggcttcttatcttttcttaaaattgtgtgtgtgtgtatgtgtgtgtgtgtgtgtgtgtgtatacacacatatacatgtattttttttttcaggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaagtaagcctccaagccaagtcaaaatgttctaaccgccagtttggaaattgggtatctcttcactgatatgggtgtctaagaggaatgttgatgggagtcacagcaaaaaggatgtgatcatcctaagcctgctttcttggctcaaggacaccatcacaatatcagtgttttaaccaccattatgttcataagacatttgtagcaaaattgagatgatacattcacaagatctttttatgatcaggtatatattttggtacacaagcccatacgggcatatgtatatggagcctcattttttagtgttgcagaaaaagtttgaggcagacttgaatgtggtgtgttgacatgtcaaaaagtttgtacaggtgatgacagataggccaagattagccagtaaggcacttctcagcaacttgtatgcatctacgttacatttattttgcgaatgccccacttcattccaataagcgtttggagtagtttctcggaaacttgtgatcatttcttcctggaagtcttaatgttgctaaaatagacagcggatgtctgtaccgtaccacatccttaggagctctcctgctgaggcaactacaaagaaacagtgattgcagcataatatcagacaggccagtaaaggattttctatgaattcgtaagcaaaatgatattaaagaacctggtctggacagtttttccactactttttgctgtggtaggcttaaaaaagcaccatcttctcattcctggaaaattcctggaaaatattaaggtcctgagtattaaaattctattcccttgcctttgtgctgtatcatctacaagttatgttacagaggcatgagaggcatgatattgcaaactgatactttgtttactgataaatggatagctaaaacctggcttagtaataactttgttgtactatgatgtaagaaacaaacaaaacaaaacaaaataaactctcatgggcagaggcttaatcatctttctaacggcagtaggggaaagggatcttcatcacttgctggttttatggcaagtgttgctggagtttttctcttcttttggcctccatcgtaacaagggcagagccatgaaggaagcatggattggataccatgcttccgaacagaaagttttccagcctagcccttcgctactctcaaagtagcaaaagtatgtgtgggattggggtgctagagatggggtggctggcagggacaactctctctctaaccttttagtatgcattgcagaccctttctgtgtcattagataatgcctattttattgctgtagcacttctctaaatttagcaaatatttcggtttcatatcaaattattttatatcaaatcagtatcttcaggagagagccaatttccttctctgactaatggcataatactcactgacttgtatgtgactctgcatatgttttctatattatggtagagttaggtttgtttatttgttttgtggcctttcagcacaacttaaaattattaggtattcttgaaaaattgtccactgtttagtgcaagaaatgtatgtgggagggaagattagggatcgtatttttttgccatatagtgttttgatctagaattaggtttgtttataaaaccagtattagatagtagatagacttttctgctatgcttggttctatttcctagaaacacatggatgtatatattttactatggtaaagtaggtaaattactcactttgaaattgtgatccacaaatggtttctatgaatacctttaagaatattttggaatacagttttttattaactaattgccactgtttcagattcagatggtgtgctaatatcagaatctttccttttcagtatcaaactcgagattttgacaggcgaatgctaacctcagtcacactggataaaactcagatgaaaagcaggcatttgcattttagcaatgagaaaagcaaatcttatcagagaccttttcccatgtggagctgattcctttgaatctgttaagaattcttcccagaattagaaacaaacctatacttttaggtacatgtttgtacagtggtttgattattaaatcttgtcttaattaggcaaaatgaagaccagaaaacttcaaagtccaaagctgatctttatatgttaacctctctcagcttgggtgtttagatgactcaagcaggtcgccagttggcttttctccaaggatgtattccatatgtttcatcaagttggcatattcacgttgggtattctccagattttgaaaatattttacctgccctcagttgtctaaggggacagagaggaagcttattaaagaaaatatcaaacccatgtcctatcctgaaatattcacaatagaacgcttaagaagtgagtggctactgttcacctgcttccgtgacgtgacaaggatgtttatttcacattgggtcagattcataacttagatgcccaaagctaacatgtttctgtataatatattgctgtatacttgatttaaccatttagaatgcccattagtaagaaatcaccacagaaattttatcatttttccccatttccatggatgaacctttatgaaacccattcatactgaagcgatggtccttactcttgagatacttatagcaggaaatacaggcacacatgaagatgttgacatacaaatgacatatttaaatatatcttcttttatttcctttttatgattcttttttgaggaatttagagaaacaaaaaatgaagtgggaacaagaaaatataagtaggattatttctaaacctgtatcagattaaatatgatgggcttcctggtataaaatttgtagtaatgtgtttgaattactaataatctttagaagaattagaaacaaagctatatagttttaggggcatgggtgatgcaaggattgacttattaaatttgaaagagtttttcatatcttgctattattttaatgtgtttataaaatattcatgttcagtgtaactacataatgtaactgttattaatcatacaaaataatttacctacttgttgccttatactttaatatcatatttgggatatttgtgggatagttgtgtgttctaagattatttgcctcttacagttacggtgtaagtgttcaagggcttagcagaaatatccctggaatgggcttgtatagtatttatactgttatatctgccagtaaataatggggaaagtcagaaaggagagtgctgggctggagaggaaaccctgtgagaatgatttatctctgctcatgagtttgaatattctatttttcactgaaactgttttgagaagtttaatcataaagaaatcaaggcttacaacatttgatcttttgttttctgagacattttacaaatcagaaatgcattaaacaggttctattgctaatatatggtattaatatttttgtgcaatgatgtcattgcacattcatttatatcatttttccccaataccatggaagaaccttttcaaaaaatcaagagtttctttataccagcatcaagggaagactgatgcttttgccagtacaccttgcttttctgattggaggaaaaaagagtttctaaagtagaacttccctcaaatacaaaatatcaaacaaaaagtaataaggtattggtaattttctcctgggcccatttcaagtttaaatattaccacaggattttttttctggtgaaataaaactgtaattgattaaaacagaatacgtaacagttgtttagacatactgatgattttaaagaagtattctaagcactgcctaaaaaataaaagggcaaatctctagtcacttcactatttgaatgatatatagaaaattttcaaaatctctttaggcatttttgttgtgaggtaatttgacatagatctctgccatgccccatccccttgacaacattattctttatttctctgttatagtattaatagaattgcactgattcatgcctagcagtttctattttaactagaatattaatatctttattaatatctgtttttcatattcattccattaaatccataagagcaggaattttaagaaaattcatactttgtttagtagttactttaatgaattattaatctatgtatggatgcgttaaacaaatcattaaatactgtgtgcagacacagttttaagcactaagaaaacaaccttcagtgtcctcatggagcttataggatggggagcaggaagtgaattattgaaataaacagtaatacaggccgggtgcaatggctcatgcctgtaatcccagcactctgggaggccgatgtgggtggataagctgaggtggggagttcgagaccagcctgaccaacatggagaaaccccgtctctactaaaaatacagaaaattagccgggcgtggtggtgcatgcctgtaatcccagttactcaggaggctgaggcaggagaatcgcttgaacccaggaggcagaggttgcagtgagctgagatcctgccatggtgctccaaacctgggccacaagggtgaaactccatctcaaaaaaaaaaaaaaaaaaccagtaatacagtgtgttaagtattaggaaaggagacataagaaagaaaactgatatctttaaggaaataaaatttgagttaattacttctctggattatcttgttcttattatatctcactccctttctttttctttcttgcttgctcgcttgttctcttgctttcttcctttcttatatgctctgtgataaatatcttgtgcattcctatgactggctatcagccaacacttttttaaaaacttacataaatcatgagatgatatcttatatatgccaaggttcggtctagatataagtatttattatatatttattactgtgatacttaggcattttgacatgagtgctattttatcataataaaaatatatctaagacaagaccagtaaatgtgaggtcaagcagatgtactgtgttgcccttattaaaacaggtagatgttatgtttatgttctgacaagcaaggcatgaatataattatgctcaaatgctggatctgagcaaatggagagctttcattagcttttggaagagaatttgactgtttatttgagtagtatctgtattattccttttttgacataattttctaacatgaatgttatatattctctgaaatcctcttgatttatacccattccctgtccccaaccctccatccacagtaacctaagagagtatattccttcatgcttgtggtcacatacaaacatagcatgcatgcctgtgtgtgtgttaatgtgttgccttgtgaagtgtccctgaaggcagttataatgtagaactattttgtgcactattgaaaaaagtataagttttgagaaggagattaattagaagaacaattctttacatgtgtctgtattccaaaagtttacatttttttaaagttatacttcatattctcaaacagatactttatattagctgtattctaatgtaattctatccatggcttacttgtaagcaaattaaatgttaagtataattacacaagggccatttacccacttttgactttttgctgcacctacttcttctagtgtacctcttcctccccttgttttaggcactgtgcatcttttcagcaccttctccatagataccttagggtagggtcatttaaaaactatcagctcacttttatatggaggatctactataagctggactccataccagaattcttacgtctatcttcccttcaaccttaacaactcactcttttttagttcaagaaaattaattttacagggctgaagtagattgagcaaggtggcagggctagtgcagagctgaaatcctaacataggttgtatgacacaaaagcctgtccttaatcatttgtgcttatgattacagtcttattttatgaccaagcaggaaaccggcttttcctaattttatttttgtctaaaagtagaaaattcacagttaaaaacaaggcaaacaaacattaaaaaaaatagggtgatcttatttttcttttgcaccggtttagatttgccacgatgaagaaatcccctttcccagctctgcctcccaacttcacacacattgacctccttcaagttactcacttggcagtctttgcacgtggacctgacggtgagacattcagatatcctgttggattataaggctttccaaacggtgcagagtgaatgcagtacagagccaactacagccaggccacatttcattcctttctcgcatgttgtcacattgccgttgttttagattggacaaacatcttctcacggaagttctgggcaagcctgaagctggaagttaccgacttcatcaggttcaactgaaatgcaaatgttggcatctcatctatgggtggttggaaaatgccttgttttatgttttgaaaaatggatgagtagaaactggaactgggctttcatttaggaaagtaggcattagtgttgtcaggtttaatttctctccatccatttgacagcttgtttccatgcagggtcttttaatcaccaatttaggattacattttgcccattacatggatagtatgtccaaaaactttagcaagcattgaaaggcagtcttaattttataacagtaaaaagcctcctagattatttatctatctatagaggtttataaaagaaactttgacgttacccttaaatcgatgttattctgagataattggcccaatataaatagattcttttaaatacgtagtactaggtctccaaaaaaatccacttatagaataccagcttatatcatcacaaggaattcatatagatgtatttcactatataattacaagttgatggtttctaacatacagaaagtggcttgttgctttattattagatgtgatgaaatcctgtgtttggaaaagaaacaaaatgaccatttcagtggattaatgtgcagcattcataaacattcccagtgctgctttcataacttggagaccaagggaagggacctagacctttccttttcactctgcactgttaatctagtcagagacgcttttattgaatgagaaaaacaatagttggacatgactatgaggtaagaaaacggggggaagaaaaatatctggggaattaaaccacgtgaattgtttgattgatgttgattccaggcagttcaaagggaaagggaagctaaataatttggttgtttcccaaccttgacaagtagtttcatgtgacagaatgaaaaaattaggtcttgctaaggaatttttaatatagttaagtgatttgtagacatgaaaactgccagtgggtagcagtctcttttttttttttttgcatattttggtagcttgcaagttcctggttttagttcttttttcctgtatctttcagctcttcctctaactacttatgaaatctgaggaactacagtgaccctgaaatgtcatctggtctagagtattcctcttcctgcaggcagaattgcatccagagctattctctcatatcttaaatgtactgctgctctcttgctattaacctagttgtatcagctagcaatataaagtcctgcaacagtctccggtcatggaataattgatgatgttccacaaagacttatctattaacaaccattacacttcattctggaaatgaaaataaagaaggcatgttctttcccttgagtggctcaaagacctgtaaacagatcattataatcaaatatgattctatcaaatgcatagctcacatgaattgcaaaatctatcatcttgatagatttttcaagagaagtttctgaggtcttgcacaattatttgttttgcaatattggtcaagatattcaacctttttgtttaataattccataaacagcaaatttttgaggtttacagtgaggattacatgagagaacatatctgaaaatgctttgtaaacatgataagcaccactaaaatcttatacagtatttatattcttccaaatcttagctattgtggacagtgctgtgacaaacataggagtgcagatatctctttgatatactgatttcctttcttttaggtatatgcctagcagtaggattgctggatcatatggtagctctatttttagtttcttgaggaacctccagactgttctccatagtggctgtactaatttacattcccaccaacagcgtacgacggttcccctttctccacgtgctcacctgcattcattacgggtccatcttttggataaaagcattttaactggggtgagatgatgtctcattgtaattttgattttcatttctctgatggttaatgatgttcaacattttttcatatggtgttggccatttgtatgtcttttgagaagtgtccattcatcttttgtccgttttaaaatcagattattagatttttttcctgttgtttgagttccatatatatcctggttattaatctcttgtcagaggggtaatttgcaaatattttctcccatcctgtgggttttagcttcattttgctgattgtttcctttgttggtcactgtgtttaattgggtttgccctgctttccagtttaccaaagtaaggaattgatcaatgggggaaatggcgatgtttatgagttgggagagagtgattcattggtttgagattttgtctattctgagacccattcccaaatcatcaatgattagcaaagaaaataaggatgcctttccacactgtgcctctattttctactcttaaagagaaaaggaggaaaacttgggcagaaagtatactgtcacctgaaggatcctaaagattatcagggaaagaatcctattaggtaatttttaaaaggacataaaattatgcagtgctataaaagaagggaaaactgcttatttttgtcctagttaagaacactgccccaacccctgccaagaaatcttggttaagaattccacactcttgctgaggattgtatgttttgaaaattcagtcttcctctttctacttttgctccctaaatccagtcttccatagcagccagaatgatcatttcaaatgcaaaccaaatcatgttatggttaaaacaccctacttgctccctcttgtttgtaggataaaatccaaacacttttacatggcctacaaggctgtcatgatctgattcttgcctcctcccttgccttcatcatctcctcccttccctctctctctaggctccagccacactggccccctctcttatctttgaggaatctccttccacctccaggagctgcgccagccactattttgtgtggaaggctcaacctccacgtcttctcacggtttgattgtgttttggggtctgtctcagctcaaaccttacctgttgagaggggtctttattgcccatccaaacaagagtaaacacaaacacccacctgctcaccccttctttcagctccctatcacttcgagtttcatttttcagttgctaattttctgcctcccctactgtgtgctgggatcttgcttgattgacctttcttttcctaaggcctggcatatagtaaacgctcaataaaaaattattggaagaatgaaaaaatgggtgggcaatgttctcaaactagttggaacaaaccttcagtttccttcccagaagggaacacttattgaagttactgaaatattagcaagttttgagaaccagaggaaaaaaaatttaattgcaggcattgttttggacaatcatttagagttaaaaagatgaagcagcatttattaaaaattcacttcatgctgagattaattttgaacctctttaatattgcttagaaatggtatttttcagtttagacttcaatttgtgtgaataatgaaccaatatttagaaaatctttcttctcttgttatttaattttggttcatctgattacttccctaaaatacacagaagcaaaatgacatggagtattattttggcttgaggttggagttctactccaagtagacctctcaatttgaaagccctccaagctctgcatgttgttttttgagaacagttggtccatacctaatctatttgtgaattcaaacagaattttatcattatttttaaatctagtttccttggagcttaagggaaatgttttattttccaaaggaagaatattacatttatttaaaagaaaaaaaaagcaaaaaaaaaaaaaacaaaacaacaacaacaacttctgctattgccattccccaagtacaatctgtcttaaaatctgaggcaaaataagaaagtgatgagttgcattgaagttcactttgcatagtttaataatcatattcaaacacttgtatttaatggtatgttgacaatgtcagaaaatcagatgtttatgaggaacagatttattcttacatgatcctgttcttagttgatattttgtatctgaagatatttgttgggatgcaaaggatttctgtgggaaacattaaaattatagaatttaagcatattttatttaaaagtacatatgcttatagagacttatagacttgtatcaagttatataatttacacagaggtgaacttaaagtgctaacatataaacattagtgacagtctttaattattatttagtgaatttttcatcatgtgccaatagaatatatgatgttaaacatggaatgtgagattctgaaattaaggagtttgctataattatgacctgagcagggattgataagaattgaagtttagttgtaatccttgaagacttttgaaatttggataaattacgatggtatctggcacacagaacaacatctgtttgagtatatgtaagtgtgtgtgtgttacaaactcagaatggtcataggctgcccgtggcatgcttagtgttcggcccaattgctatacagtagcacagagaatagagagacagcctgacagatgagtatgagcacacacaaaaggcaaaggagaagctgtgcagctgccctcttcttcatctctgctgggttccccactgaagtaactcacctggtgtcagacgagtggcacacggtgtgttttacagatgaggcctcagcagagattcacacaggcttgcacatttatctgtcccacagatgtttcgtcttctgttatctagccaacaaggcaacagctcgactttgctaggggatcacctccagatgttcaaccaaagagagaccctgccaccccactgagagtaagcagacatctcctcactacatctggggccactcagtgacagtacaaattagaaaagggttagcccataccagctttgcagtggtcatatttgtagttgagaaacacatagaaaacaaattccaaatactcattttcctagtaaatagtcggaaatttacaaatagcacaaagtaacttttataggaaataattcaaatctggcaggcaagaatttctctgtgacttttgtttgtaagttttccttgctgaagttaattgaaaatttttccactgtgacaaatttgactgtttaaacaaaaacagccttagtcagatacctaaaataagaagtgtagattaactccctttctgcatttatattttgcaacactggcaccggatgtcccatttgtcttttttgtattttgtgaatctttacaaagagcatattttattccagagaagatgaaaaacgggtagttattgctcttttagacattgactttgttttgtaacgtaggagaaaaagtgtcaaagcattgttactaagcattaataattttttcagaaacttatgaagctccaattaggtgttatgcaatgtatcaggtactaggatataaaatgatgaaaaacatatagcttatgccctatgagatttatattatagtctgggagataactatattgtaaacaaagatagcgatatgatgccagacaacaataaggactctaaagaaaatatattaatgagataataacagaggtaaaatatgataagaaggagccagtcaggcatgtaaagatttgagggagtagagagagcacggcgtagactcaggccttgtgggcgaacaaactctgcatgtttttattcacggggcaaccagaggccagggtagctggagcatgtgagaaagagagaacaagatcccaactaaggtcggagaagttggtggtgccaggttgtcgaaagtctatggaccatggtaggaggtttgaattttattataagcataataggaagtcagtgggggattctaagcagagaattaatgttacctaaattatattttaaaaatcattattagagctactgtaagagattgtactgttgagggccaagagggcaatcaaggagcccagagtagggcctttgggtagtttagggtgaaaatgatagtatttaggagcacagtagtagcagcagaaatggagaaacatgttaagataaagcctttatttttggaggttgaattgccagggcttgctcacaaattaaatgaaaaagatgagtgatagagaaacaaggataaatcccaaatatttggctcatgcagttgggtaaagctgtttactcaaatgagaaagattgggtgatcaatacaattgggttagatgggaataaaggttatttttgaggtgtttaatgtttatgatgcctattagatattctagatctaagaaaacaagttaagtacgcagctaactatgcaagtttggagctcaggggagagattggaattgctcctattaatccagttgtcatgagaatatatagctatttcagagcaaaatgtggagtagaatggtataaaaagttctaggtttctactctttttttttaaatcaaattcatatcttacaatcttagagatgacttgtcttttttgggcatgagattccttatttaaaaaataaggtttttaagaatgttattaaaagattttcaagtccagcattttatatctatatgttttctactcagaagttactgttttatatcaagaaacatttcttttacaaaccatgaaggaattctgctcttggaaaaagatcacaacgttatttattctggcttttttcttccccatgtttcctttgatagatcagaagtgtagatgaagccaaagaaactgaccggaacaaatagaattatttctgtattgcatatcaaaaattgttatatatactgtcatatgcatatctgtgtcagtgaggttgtaaatactgaccagatttgattaatggactgaacaatgtgatttctgggtacttcagtgacttcacaggtcagatttcagaaggtcttctgttaaaatgtacatataatacgttccatggaaactcaggggtttgttaatattagagattttccttaacttgctaacgatgggaaattatattctagtaaattaacactcagtttgtctggtctttggctgcagtggtaataccagtctcttattttcaaaaatgctatgatttttgtgttatttccctttctaaaatgtttcacctttgctgccacctattaatatcatatttaaatggccactggatttggcattattgcagtcattattgaccttaacaagagattttggttaaatggtgtagaggaaagcctaaagagaaggggaaaagagaaatgaagacagtgaagagcgataactcaagaaattttattgtgaagggaggtatgtaatggtgtggtgggggaggaggtcaaggaaagttttagttaagatggatgatattgctgaaagagtactagtgagagcattccagcagagaggggatctgtgtgatggaggacacagtggataattgcaggagtggaagggatccagagtgtaagccaaggggttgactgagataggagtgcagacatttcactcattgcaacagcaggaggggtggatgggatagcttcataaatgtgctggtagcaggaggctgagtttctcttctgatgcttccattttctcaatgaaatgagaagcaaaggtatcagcagggagtgaggaaaaggggagaatgttagagatttgaagggagaggaggtagtacgagacggtgaaagtaaattaactagaaaagtggaatagggttgctaggcagcactgagaccccattggagggtgtagtcatgaatttggagaacactcagcatgatcgtaatttgtttgtttgtttcctagctcattcagctgcttgggtttggcagagatttagtattgaccaaggttagaagtcttatttgtccagtaaaacccatattgaaaggagcaggagcactgatggtaatataaaggagtggttttcaatgaagtatggagcctagtccagaaaggagggaagtgagcaaatgaaggggacaatatgtagtgagaatgtggcttggaaaacccactagaatgaggaatggttggagtcagactattctgagaaagagccagaagaaaggaatgatgtttgaaattgagatttagagtaatgcagggttactgataaagataggtctcaggtaaggtcataatgttggggaatgaggtcaagtggaggacaaaaccattggaggttaggaggttgagacactgagaggccatgttgtggccagggattaggaaggagaagaatcgcaacagaagagtctttttacttggtgggtgatatttgtggcttcctcttagttattgaatatttcctgtagtgtcagacatccagaagctagctaggttccaagtcgcgccctccctccccctcaccccccagtaagcagggacttccgacatagcatttcctggacactggctctctggctaatctttcatccggtactcagttcctattccatgaccacacatcccgtatagttcttctgctatcctcaagaggcccttattggcaggatcctttgaacacctctccgggtatctacttgaatccttagtgtcattggtccactagctctactgagcaggttcccagtaacttttcagctgtgctgtgttagtgagagggagagtttctacagctcagtgagcatttgtccagtcttcttacatttggtttctctgatgggctcctgcagcctccttcacctggcttgtatcttttctcagataaatcccttcttcccacaagctcccctcacctgctcttatttgtagtctgaggtatgagtaagggttgcagcactgactgatagtctctgtccctctctctctctgaataatgagcggatgtttgttacccagtgtccttattcctggcatcccagccaaaactaggaatttttctttaatatcttgctcgtttctatgctgttgcatattctttcttaaacagccaattaaatgggttcctacaactttgtagtcaaaatttaggactataatatggtctcttttctccagaatctcagtagtgtccaaagtactatgtattaaagaaaagaagagctgattagtattcagaattgggacaaaagtcctgcaaatagtttcctaaaatatacttaaagtcatctaaaccatgagtaaatgaatgtcctccttctcccgactgcccagtaacaatggatgttagatggtaggcacaaaggaaattcatattcaaatttcttcattgtgatatgagttttgattggtatatgttttcttagcttgatcttgtctgacttactttggtgatatttaggtcttatatgtgtttttcctaagttatattttatttctctagattcttactcttcacccaaatatattataaattgtatcatctactttaacattatctttcggcatgttcctctggttctcaaactccactagccttttggtgacttagatgcgctggtctccttttccaatccaaagtccccacagactctgccttctaccagaaatgctccccacccttatttccgcccctgcttcccacccctcacacatgtaacttactcctttccatccttcattctttgtgtctaaacctaaatataacacttcctcagcttaactcccttaacaatccccatttccactgctatgccaagcagtatgtgctcttataacaccttgtgtttctttcttcaaagcattttgtcatacttgaaaataggaataagtatttgaagctttctaagacattcactaaaagctccatgagggcagagcagtggctatttttctaatgcttagcatggtgtcttgaacatagttggcactcagtaaatatttgttgaacaaatgaatgaaaattcctaataaatctacctacagtgaaatcaaaggactttgttagtgtgttcagggccatttgaggttgcgtggactgcaggaaagtctataagcctaaagaggctgaggtgtccatctaagtctgagtacttaagtattcacattttaaaacatgtattttgtaattatgtgtgagtgggaggtaagcatgaatttgacaaagaaaaatctgcattcatgtttatggtggtagtattataagtgtgctgctagttacaataattggcatgttgcttacataggcactgacttagcagaaaacttagcaactcttgaaaacacagttcaaggtctgcagatgatttggtccacagggccactgtgaaataaaacaaatgaccagtgtgagacaaaataatcttgagactttttccccatttattgagctttcatgttatgatattttgctattgtttaagttaggcatattgtcagttatcttttaaaatcattaagcagttaattcattgacttctgaaaactaagttcaatctaatttataaaataaataaaatgtctaaataatgatttccaaattaaaaaataatttcctgattcttttctaatatttaatttccatttgagtctgttcataaaacatcttattgttaattttttttaaatcatacacctctttaaagttcagaatatcaaaataaatatttctagttcttacaaatatatataagaagatgctttttcatttgactgtcgtttctctgtataggtacaagaaaattagacaaagactattagcatttgtgttctggctttcatagcgtttaacattcgttgaaaaatgatattgacaacattttttatcaccccctttatcttttgagaaaagtattattcccaggttcaactttcaaaacatgtccttttgaaagtttcagggtttccatggatagtttatttacctttttctacaccatgttctaactgcattaaagagtgatccattaaaaagaaaaaacaatccaacacttaaagaccttattcactgcctactggacccatacaatatggaataatgggactactttagatttagtattactgaggaaacttgttgcctacaagttcattctgaaatttatgttcaatgattagaaatcacagtgtatgagttattagaaatcaaagtgtaatttgcttctctgttaccatgaagaactactgaattttgaacccctgaacactctcttctagctgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagatcccctttcatacacttggctttgtgtaaacttgccgtatttaatcgaagttgaagcttgcacactagatctcatatatcaaaatacattgccagtctttgttgaaacaagaaaataaagacattttgagcagttacatctaataccattaaaaacaataaattcagcaataatgactttcaactatttacatccaaaattttcaaatagctaacacatgtaaaatttgtttcattttccttttgccagtgtaaactttttcatgatatgttatcatgtttggtatttaaattaaaatgtcaacttctaaatataaaactttatctaaatagatgtcagttcctaactttgctcaacttaaaaaattatttttaaaaagcttaacacaatcccttgaacataacaagcactcaataaatattaaaatgaataatattccaagtgtcgtaataattatgtctattacagtgagatcttgaaatacaagtagaaagtgacagcacataaatttaaagagaaaatagtaattaaatgatctccccttatatggtaacaattattataataccagtgtgaggaataggagcctgattcaagtaaaggcaactctgccgtattctaagtcacatcagtattgcattagagtatcaagaaatctggagctataattattgactgttacagaatggattatcattttatagtgccataaatttgagaatacagtcacaattctggaaataccattattgctaattataatttcctgaaatttgcctttgaactataaaattacaggactaacttggtaccagagatcctaaagtatgagttagagaaatcaattaaaaaatggttttatagtgtatatctgatttctgaagtgttatatagggtgagttttaaaacaaagcatcaatccagcattagaaaacttttcattagaaaaaatagttattgccaagtcttgaaataaataatcattagattttttttcttctggaagtaaaaattcaccttctcattggtgaaggtggttgatgaagtgtagactgctacttttcatagatctgagaaagatagtcttctagaaattgttatatattgttttatgctcctttttttcaaaggatgttgaaaaggaattcagacactaaaccttttgttgaaacctagtacttaacagatagatatatatagagtattgtttttaatttggtgtttcattgtgtttttttcaataattgaagtgtacaattttgaatcgctgtaatatgtataaattgtaggtgtgtgattgaaggtttacaatgataaatagtttgaggtctccaattgtaactgattatatcaggaacttggagatacaaaagaaggagtttgagactattattccctttattattgatcattgcttcatctctgttttaagaagaaaatattgaaggcaatcaaagaatttgagcaaacacaaaggaaatttggaatgtgacttttcagtcatgccaacaacatatctatgtaggcttaaaaacgtttatattcttgttgttacatctaattttataataacatctttgaggctataaactgtgtttaggcaatgcaacttttggggatcattttgatttagaaaaagatgtttacttttatctattacaaacacacagtgcgcaagcacttcatatctattagctcatttggtcctcacaataacctgatgaaggaggtattattatcatcccactgtagagatgagagcactgcaaaagagaaattaaagatttaggaggtctagctttaatttgaacctaggcactttggcaccagagtccctgttctcaacctttaccattgtgctgtgttggtgcaacgattctttatatctgcccgatatgcttacttctgtccaatttattcagttgtttctctctctctcctcattagcatttaccaaactgtcttgatcaataatctttttttaatagcttctataaattgtgagattagtgattagtactcttttttttttttctaattctaatgagggttagggttagatgaaggttctaatcctgcacacattttattcaaccatttttaatcgtgaaaatctgtagccttcttttttctgaccatagccggtcctaggagggactgaaacagagtggccacacttggttaacttttaggggaaggagaaaggatttcagcaggttcagagctctcctttacttcttagcttcattcccaaactaacgcaaagaaagtccagtttctaagccatcaggacgctgccttttacagactttttaaacctatcaaggacacgcttgataataattttgacttaagtagtctgtataaaacgttgtggaagggaaaaatagagacagttgtcacgttctagacctcctaagtggtattctaatagaaagatgcataacaatcctctcgagggaaacaggttctgaccacacccctagaggttctgagtctgttgttctgactggttgctcagtcatctacctttttcaagccttttgaagagtccgattcagaaataatgttttggagatggccaggtgccctaaccacttcctgaaatctggcctgatttttaatagcttttacctaagttcctcagattctctgattcatagttttcaaaatatcttgtctcctatttttgtatattgttctcggcttcttctgcattttaactcaagtataggcaattctcactatatttactggaattactccaatacgttttagaatattcatggtgctgtgcagccatcactagtatctaattccaaaacacttccattaaccccaactcaaaaaaaaatcttgtaccaactaagcagtcactcccactccacgctcgttcttgcccctgacaaccactcatctgctttatatctctgtggatttgcctattgtggatatttcatataaatgaagtcatgcattatgtggccttttgtgcctggcttctttccttatgcagaagattttcagggttcatccacagcatcagtacttcattccttcttatggctgagtaatattcccttgtatggctatacaacattttgcttattcattcatcagttgaacacacagttttcacttttttgtctattatgaataatgctgctgtgatcattcgtgtacaaggcttttgtgagaagatatattttcatttctcctgggtatatatctaggagtgaaatttctgggtaatatggtaactgtttaacttttcgaggaactgtcaacctgttttccatgtagctgaactattttactttcctgctagcaatgtatgagggttccagttcctccacatcttctccatttgttatttcccctgccttattgatggtagccatcctagtgagtatgcagtgctatcattgttgctttgatttatatttcattaatgactaatgatgttgagcatctttttatttgcttattggccatttctataacttcattaggagcaacatctagtcaagtcctttgcccattttctagttggcttgcttgtctttttgttgttgagttgtaagtgcttttagatatattttgtgtagtagacctttatcgggtatataagttgcaaatattttctcctattctgtcagttttcttttcattttcttaagtgttctttgatgcacaaaagttttgaattttgctgaagtccagtttatctatttttccttttgctgcttgtgctcttggtatcatattttaaaaactgtaacctagtccagggttataaagatttacacttacgttgccttcttagagtttcattaatataaatttagcacttaacattaggtctttgatccattttgtgtcatacacattgtttttaaatattcttctatgcatttaaattattttcaaagagatatgaacttcatgattattggacttcattttctcatactttatcttcattttccttattatatgagttgatgcaaaagtaattgcggtttttgcaattactagttgcaattactagttgattttggtcttgcttttctgatatttctgtggctgacccttgttgctttctaacttttgatactgttacttttttcttcccaaaatatcactgaaatgttacaatcttgatgtttattattcctttttttctggtgctctttaaaaattaaatcaattatttttcttcatgaatattacttttaaaatcctaccctcgtcactcagttttactaattacagttgaattttatgttgaagccaggtgtggaaggatgtctgtagacctagatacctgggaggttagggcaggaggattgttgagcccacgagtttgaggctacattgagctatgatcatgccacggtgctgtagcctgagtgacaaaacaacagcatgtctttaaaaaaattatgtcgaactaatgttcatgtcttagctttgatcttcatgcctctgttgacagaatttctggagaaagaaccctaaatttgctctgtccaaactagtagccacatgtacctattgaacgtttaaatgtggttggcaagaattgaggtacagcctaagtagaaaatgcacagcagatttcaaagatatagtacaaaaagtttattaatattccatgtctattgattacatgttgaaataatattttaaatatatattaagtcatataacatcattaaaattaatcttacctgttttactttttaaatgtggctattcgaaaagaatatacatggtttgcatttgtgactcacatatttttatttgtatttatgtttctgctttagatcgtcttcatctcattttgtattttgttaattgatagatctcatcacatcaatttgaaaatagatgggctataaaacttgaacagatgaatttttgctcttgccagtatctttctgttgctcttaattaacatagaggcataaaatgttagtgttagcagagatatgaggcatctgaatggtttaagggtttaaagatccttctcctttaccttaaagacaaccgaaagtctgccaaatgttttattaccaatattagttgtaaggagaattcacttaccgctccattctcatctcaaagttagtaaattcatgcataatgtgtgctggtttttcctgcttttcctttttgctgttgttgttgttgatgagaccaccatttagacagtgggatagatgatcttgtagtcatctttgattatcttcattcctttatctcctataggcagttggtcctcctgtttctgatttcacatcatcatatttctttacttcaccttcagctttgctttctccagctactagtgaacagtaaaacaaatccatggtgctctcattgcaatagcccccttttacatcagtgtgatatttatactacttcaattaacttactgtaaaatgacaataccattttcccattttctgtggtcaacctacagtaattgctttctaatatttcacttaaatgatatcagagagctacagtcttcataattcaacctttatactctaaccaggcactcacttctgccatatgccatctgtgatttctctagcccttctgaactccccaacttgaaatcagttccatagtttcccatgtaattcttatttatcattatctgtgtggcattatgtctttttggtttttgaggtcagggaaaatgtactctattgtgttcatcattgttcctagagccactcagggaacctatgaaatgttcagctgaactttattttaatggtttttgttttacattgttcttattcagatgtaaatggttaaaggcattttcttccatactatgattttattctcacttttattttcgatgtgaaatgtggagtcatattttacttgatgggctatttcttgtcctcagtgtcctccctagtaatatattttttaaactggctttagtaaaaatagctactatttttcattttcagcccatggtaaatgatggaaatatttttcttgatgaatttattatttaacagtactcacaccatattaatttttataatttatatttgtatatgaattattgactatgacttctaatatctagcatacatttttagataaaaatataatatctagattaatttgaatgacctctttatagtattaatttttctatttccacgtattctatagataattttttaaagtgagagcttggaaagaagacaaaatgattcatattaatctttcttagagagtgaatcagcctcctccttgtgcatatttaaagaaaacttactaaatgtggaaattgatgtgttgttttgactaggtatgcatcaaaccctatgtatgcatcaaaaacagtggcattttgcatcgtctttgagatctatgcatggaactgcctcgtacggtaatattgattttatagttaggctgcaggagttgcaactccaacttccccacctactagcaactccatgtgaagtaaattaccgaattctgccaagcctctgtttactggtttgttaaatgtggtcaggaattctaaatttttctgttaaggaattgtcagctttaaatgtgttaacatgtttaaatagtgtaatgagtactagcataatgggtacacagtaaaaattagctattgttatgaaaagtagcattaatatatcttggaactttagtaactttgttctccttggtaggagctgaccttacactcaatatcaatctttaataatgaataattttctcttctgtaatcaaaaaaaattatagtacagtacttcccacctttttcatgtcctagcacacatagaaaatggcaatatgtatacggcccaggtcactgcaggaggctgctcagcctctcctccctgccccaagagttgagaaccgtctagggttgattcagctgcagccctttcatgacttacagggaagttctcaggctggaatgttctttgggagaccctgtgagtacattactcctcttcttcctctccactgccttttcttctgtctcctctcacctcccataaaaagaatcctggattttttttcaccagatttcaactaatgattcactaattttaaaacaactctaggtgtgaatgattaacatgatcattgttccgaaggatgtattaagaatatgtgttgatcacggaggatctttggataagctatgtctgtgcccaggtctcctctaactttaattctcaccctattatcagcaccaaaaccatcaatcagaaagcaaaactcagaaaattggcattgtctagtagcctatagggggttctcttgtcatatttgcactggactctgcctttctttcttatttttatttttatagccagtcaaatttagcagtgcggggttgtatatggactctttctttggaatcagcatgaaataaagaatgcaaagatttttctgtctctgctttttaacaaatgttctgggaaacttcccccctcccccacctactatctctagttaggtaaatgctcaaagaacttagaatgggaaatcttgcaatgatttcttgatcttaagtaatttgactgcataattttgcatagccatttgtcctctctctattaccttcttttaacatggtgaagaataagtctactttacactatatttttagcatcttagatatattttggtcatgaagatggtgctatcaaatccttttttaaaaaacttaaactttttgaattatagcacatttaatgtttatttttctactgtaaattataaattatttgacttttgcttaattatttcaattgtctgacaaactcataaaaatatccaacttggttcctttattttatattttctttatcacctacaaatcttaaaatgtatatattttatgtctttatatgtttacagtggttagttgtatctcattataacctttttctggatatggaagcagataatattttcttccttaaaagggactctcttagggattaaaaaaattctaatttttaatgtcctggggtttttggcatgctgtttaaattaaaattttaaaatgatatttttgcttttgtttacacacaacttcctaaatcttagtgatttttagtctactttttgaactataatatccatacaaactccacttgatatatatacatagagtttaataaactttgagaaatatatatgccactatctagatagagaatatttatgtcattccagagaattccctcctgccctctttatactcagactcacatcctcactctcctcccagccccagtcaactattgatctgttattctgacactatatattagtttttatttttctagaagttcatttaggtgaatcatataaaaaagagtttgtgatattttcagtctgaattttttttcaatcagaaaatgcttctgagatccttccatgtatgtaccagtgatatggtcctgtttattgctgaatagttagccactgtacagatatgccacaatttgtttatgtatttgtctattgatggaaatgtaggttattttcaggtgtgagtaattatgaatgaaactaccatgaatatcttaaacaagtttctgtagaaatttattttatttcgtttgagtaattacttaggagtgaaaatgagttgtacactaagtataggtttaactttataggaagctgccaaattatttgtaattaattattgtttgacattctcatcaacaatgtatgagtttctattactctgcgttcttgtttacacttgatattgtcgggtttttctaactgtatgcagctaatgactgcattaggtggctcagtttttaaattgaggcatgtctttttattgttggttatcaaattatatattttggatacaatctatttctacatatgtatgttacaaataatttcacctactttgtcattggccttccattttgaagagcagaatatttaagcactaacactagcacttgatgtgttccattctatcaatttgttcttctatggttagtgctttagtgtcctttcaagaatgatttgttttcctgctttcttcctccagtttaaacatttaaatgaaagagcaattttgagttaatttttatatgatgtgaagacaggttgagtttcattatcttacaggattcgatttttcagcacctctttttttgaaaagattattcttgctcctttgaattattctggtctatttgttagaaatcaattgaacatataaatgttagcagatttctgagctctttattttattccattgatctctgtctttacaccaataccacagaatcttgattacggttgctatttagtaactcttaacattaagtagtttatttttatctgcttgtttgtaagattttttggttaatactagtttttagcaaattgattatgatgtcccttaatgtggttttctctgtgtacatccttctttggttcactgagcttcttatatctgtgggtttgcactttttaaaagtttagaaaatgtcaagtgttatttcatctgatatttttcctgctaattattttctctctctttcttttgggactccagttacacatagagtagactgcttgatactgtctcacgtatcaagtttccatatttttttcttcatgttttcttctgtacattttccattgctgtacacatcttttcttcctagtggatgaacttctgttaatcacatccagtaaatttttaatttaagatctggaggttttcacatctagaaatatagatatgttttccatttgtctctgcaacatattcacatttttctttaaatccttgagtgtatttttgtttactttaaagtccttttctgccattttggggtctgctactactgcttaatttttctcttgaatatggttcatattttcctgttctgtttaatgtctagtaaatttccattcaatgttagacaatttaaatttgctgtctttctttaaagaatgttcacttgaaacattcaaggcttgtgttaaagttttgtttgtgcaagtctatcataacctttacactcaacttggtttctctcttgctccctaatttgtgagttctctggagcatttaacaggggtggatgacaccagggaataatcaatcttagcctaggaccctggtgcaggaatgaagatggagagaaaggattggatttagtaaagatctgaaaaaataaatccagctattctggggggaatgagctgcttcaactaattcttagtcctgtattcactttagaagctagtcacttactgggtcctaccaagtcagttctccagtgtggcttggtcattttcaagcaggctttgaatttcttggattttggtactctttacattcaaatattaactttaaaggcagatatgagggaacaaccattaacaattgcctatacatatacagacaaacacagactgaatggacatttttacccaagttttttggaggacctgtgcatcctacaattacattggttaaactatgtgaaaacaataatacaatctagtttaaattttttttctaatctccatttaaagaattagactttctctttcttccttccctcccaccctctctccctttcttttcttttctttcttttctttcctttctttctttcttcctttcttcctttctttctttttcttttcatctttctttccctctttctctttcttctctctctccgtctctttctttctctctctttccttttcttctctgagtaacattgatcctactaaatttattagaccgtgttctgttaattcagttactctttaatatagtaagaaataatatgtcttatgaaaaattttaattccagtatgaagcatagataatggactatttataacatctaaatactaggtaacgtaagtgtaatttttattttaaaaattattatttacattttgtatattatattttaatgcttctatttaaagaggtaagccatggatgttctgcaatgattctacattttctatgtctctaagttaaaagtgccttgcagtcttctaatttgggatccctgttaagcagttttcttgcatttagttttccaccacagtgcttagttcctggtttctttatccaggatgacaattactatggcatagttcatgttctttgcattagaaatcagtgccaatataaaccatgactgataaaaatgaatgggacctacgaacccaggggaacttttctagaaacatgaaagtatggatatgtttaaaatgttcttgaccaaaagcctagaactgcagtggcaaacttagagaaaattgtgccattggcctaaaaattgtggggagcctactaggagagttttctcaaaagattccaaaggcttttatgccttttaaaacatttatctcttcatcttcagttgcgtaatgaggaggaagaaattaaaagtggtggaaagtgagcaatagattttattttaactttgattcagaactattcaggttttgattttagttggtatagaaatgtgttcttaaagcaatcagaatattagctgaagttagtgttagtgaaccttgatgggcagaggtgtttctttttcatcctctttaattaccatggacttttagacggcccctaaagtgaatttggaagttttcaacatttggcattcaagttcaggcccagggaggttatgtggatgtataacttctgattcttggatggtgggttgatactgtatattttttaatggttacacttttccttgactagtataaaagatttactgttacagtttgtgtgtggccaggcagtggcatatggaaaagctgtttcctgctatttaatttaattagcccaatcacgtgccagccttcgggcatgtcactctggacctctgaggctctttgtctgtcaaggagatgaacaatatcttggctttgtttggttgcttgggatgctgaagatacaaaccactgaaattttgactgtttgtttaaccaaatctttgcatttttaccatttggctttgattttgttttacaaaaaaggatgacatttggccttggggaagtgaaaaagaaatattgagtagatgaagaagagctgttgctttctatggcttaatacaggattgagatgattatcattttataatcaggaagttttagttttctactattttgttggtaaaaactgaggacaattttcattgcatcactttagccctaaacttagctgacaaactgtcattctaattcaagccttcttctttggttcatgtgtgtatttttgtgtgattttcttcatcttgccaaatctcgaaatctttcagtgaattcattgttgaaaaagaaaatattttgtttcgtttttgaattagaatattccagtttggtcttgttttcataaaaaagatggtgattaatacatttaggcaccttcagaattgttctcaatattttagcctttcttttaaagttaaagtacttttaaaacttttttcttttatagtcaatatgttcagtttttaaaaattatctttaacaatatttgttattattatatttctttagtttcaaagctttaaaattaataaagaacatttgaagaaaaacagaagatttgaaaatatatgctacagtataggaacttgatttgcaataaggacttctgcctaaatttccagcagaattaacagcaacttccatgagtcaaagttacttgtcccaggtgatcaatttctttgaacatccagattttaaaattagttgtcccagatttgaggttcttaaccaattatagatacatgcacagtttagaacttcaagaagatgtgcccatggacttaatcctgcactaagaaagttagattaagtcacacagagcatccattccatatgagctactgtcccaggtgccaagatatcgccccaccctctgacatctcttggcctttggagtaacccataggacctatactgaataaatgacaatctgtcccaaagaaaatatcctttgtctaacgctaatagaaccattgcttctcagtagattgggattttttaagcaaattattatctatttcattttgataaactttgcaagaaaagcccttacctctaattgcatttttaaatttagaataaaaggttaaatttattaagaaaaggaaatgaaaacctaaaaatttaaattctctttaccaacacaattctcagaacataatttacattcacaatacagacatttaaaatgaccttataatatagtttccacatgcaaagtataaatcttacttacaaacctatgatctgcatagattttgcattttgtttaagggcaagtaaacaatcaataacaaagagaacattgtgctttttctcttctaatgctttctgtcatcatttcttctgtgtaattgtacttaaaacttcaatcattgtatccattttgggattcattattgtaatttatagttctttgtgtatgattaatttttcatttttattttccttatatgtatagagcgtgatatttctgagggtacacacatgcctacacacattcacactcactctacatattgattttagaataaagttgtatccatccaagaaaatttgttttgctggtaacttttaaagaatgaatatatttttaatattgggaaacacccatgttctctaaataaaatatagccatggcagaaatgcagtccttttttttataaaggtcttttttttcactattgatgttttgttgaaaatgttataaagtataacaagactaaaggttgaaatcaaattaatcgtgaggtgacagttaattcagaaatagagatcttaaaaattttctgggaggtggaggtgggtggatcatttgaggtcaggagttcgagaccagcctggccaacgtggtgaaaccctgtctaataaaaatacaaaaattagctgggcatggtggtgggcgcctgtgatcccagctacttgggaggctgaggcaggagaattgcatgaacctaggaagcggaggttgcagtgaactgatatcataccattacactccagcctgggagatagagggagactctgcctcaacaacaacaaaaaaaatttaaagacaatttatttgttagccaaacataaggccctagaatataggtattaaaatggtacaaccttgtttctgctagaaaatgtaatccttgtgaaattctgaacttttcttttttttacaaaaaacgaataacaatagtgaaagtaattgtgcaatttcaaatagagatttagaaacagcaaggtgtatagaaaaagtccttataattaaacttacaaattaatttggcttgtagtaaacattactccaaattttatttgcacattgtcctaaaattctaaatgaaaaaaataaaaaatacagtgtcgtttgtgccactatggtcaaaatatatataaagcacaaaacctgcaccagtcttgatcaagatcttccagcttctaagttgcagaactgtgatcaaaacctacatccagttccatgttctttccattaaacatcgctacttctgagcagaacccacagttcagcaaagggtttgacatcttgtccctggttcttctaaagactgaaagtaggaaggatctttacttccctacactacagtttcatgacctctgttatccactgggttactttgaggaacagcttccgctgataattgtaatagtttattttttgtttgttttatgataatggacaaaatttattgaagcgcttgcttacttcttataggtatattgagtgagctgttgtattttttcactcaaaatggaaagatagtgctggcagaaaccaatctttacattgttttatttcaactctgcttgttaacaaactggaggcatcaaagtctgagatattgggagttgagttttctacgtgtaatttctatgatatgcttccatttttcaaacttttttaattttcaagttttatttactctaaaataaaactaagaatacttaactcatgaagaccagaaaacaatatttgatccatcttactttttaaaatcaaaactatcatgttagaccaggcgcagtggctcacaccaataatcccagccctttgggaggacaaaatgagctgatcacttgagcccaggagttcaagaccagcctaagtagcatggcaaaatcccatctctacaaaaaaatacaagaataagccatgtgtgatggtgcatgcctgtagtcccatctacttcagaggctgaggtaggagagtcacttgagcctggaggcggagattgcagtgaacctatcatcccactgcactccagcctggcaacagagccagaccctatctcaaaaaaaaaaaagtaagaatatttaactcatgaggaccagaaaacaatatttgatccattttactgacaacaaaaactttcttttcatcaaaactatcctgttaggccaggtgcagtggctcacacctacaatcccagcactttgggaggacaaggtgggcagattgcttgagcccaggagttcaagaccaacctgaggtgcaacaactcacaaacaaacaaacaaacaaacaaacaaacaataaaactatactgaaaaggctttaatacaccaactgataacttttagatggtttaaaggcatcttctgatgaactgtgtcctaatgagtgtgaatggatacctttgagcaaggtacccagatttaaaatgacatatctcttaattttaaacgtaagatcaaggtcctaaaatttgatatagactaattattcttcaacagcttgggaactttatttcctaccccaagagacagttggtttatgaagtaaccccctacacacaatatatatacacatatatttatatgtatatgtatatttatgagtgaacttttttctttgcacacttttcctaatggtgtcatggaaaactcccctccacctaagttatgttctaaagccaatcttctagttttttatcacatcatttctcttgattttaaacatttgaaatttgaaggaaaatggtttcttctgtaacatgatcctctctattcagttttatgtggttttcttttccttgttacttttcctcctcaaggtcctcccacttttttgttgttaaataaaattcgtctgaatctctctttgaagataatttatggagagaaactgtcctccaccctcactgtggcttaccacaacctctagaaaggttagttggagtacactgaaataaaaaaagactgtcaaacagcagttctctagctatggaatctactggtgttttgctggaaagctcataaaatgaagtgtcattatgcactgtgctataccatccattgtgtgttctaactatatcactcccttttccacttacccatgggaagcagcttacccaaccagtctggcctatgtgatggagaagcaaagatctgaagagccagttttttttttgttcttggccagctatacaatttctaggtgttctatgcctcagtttcctcatttgttaattgaaagtgttaatcctgatcttcatcgaaagactatggtttgctcacccatgctgacatgtaaagatgacatatagccacagctttcttgacagttatcaggaagacagaccaatattgaatgaccatcttagttttaaaaattatttttcttttatgttcatataatttcctttaaaattctaactagtagaaaaaagatttgttcagtgtttaagaaaatgtcaagtgaatgctgatttactatttttgaactagaattggcaaatagatttcctcctaaggggggtggggtgagatggaagaaacattctatgcgacagagtttttgatattcctcaggaatgaaaataacctaactaaattagtcataaaatatatgcagaaatagcgtgtgccagtatttaaagtttaaacactattaaaaatagtgtagaatggcaaaattttattgttggtaggaatgttagataatgacaacaataacaacaatgaaaggtagtagggattgaaagctaattaattgccaaacaccatacccagtaatttatgtttatcatttaatcaccatttcatatttaccaaagaaaaaatgaagacttcagtgtggtaaagcagaagtcatacatctgaactatgatagagctcagattccatccctgatccatatccagaaaggttgagaggctggcttggagtctcagtcaatttgtggtgatacagtaacagacactcaggtctgactcataaactattcaatgtaacttcaaaatacagtactttcaacatcaaatcagaaaagccatttgctactatgctaacttttcaaccaagtcttctttactccctccaattattttcatggtaatgttccagcacttgtagaaagcaaaggcaaagatggaatgtgaaaaactcctatcagtcaggaagtcactgtatggatggcttcacagttgtggccctgcttttttccttcatactaaacacatgtcttagcatttttaattcttctattcatctctagttcataaagcttacatcttgtggtcatggcttggaagactacaaatgtcatttatgaaatccccaactcttccattcttatattacatacttgatgtggaatttgccttatgtattaatgttttaaagtctaaatatatattcattcccttcacctcttagaatatctagagaaacacgaatttagatatatagcctggcataaattcttcacaaatggctgaagtctctttaacctacctggtggattctgaaattttaactctgtcaacatttatacaaaactttttcctcttctccgtacatagttatagtaaaacactatgtttaaaagaatggttggaatcctctcaccttcatatgtaaaaatcctcataaaataattcaactaatctaacataaaccttcatttctttaattgcttatcacacatcagaatgtgcaaggcattattttaaatattggacatggtcccgcctggctccaataagcttataacctgataagaagagggtaaattatacatatataaaattattagataaaagatgttaggtactacatgataggaacagatacagtatgctttgagagttcatatttttataattgtttaaagtctgaattttccaagtaccatgtgctttacataaatataaatagttaataaacatttatgctttctaatcctatcaaaattcttagtgtagcttcttaatgttatttctgtatatacacatttcctagggcaacacattttccagcataggcaataagctgttcaatatgtaacataagctagtaaatagtacaaccgatttaagtaggtaccatttaaataaatcttctactcaatgcactggccatgccagatccctttatgtgtatttgcttgcaaaaccacaaactagtttactcttcttgaaataacagatattcaaaggtgtatgatataatttacaacaatatttttatgttataattgatactatcatagaaccctcattgatgggaaataaatgtctatattgggataaataacatctatacttttcaaaagtccttcagtgaattttgcattcttttatttttcacatctccgggtatagtagtagatgcaggacatcattattttggcaatattcaggtatctttgatattcactatggaataaattatttcaacatatcgagaacagatccaaggaggtgacctcaaagacctgaaggttaattaatggactaggctatcctgactcaaaatgaataggaattcagaaagggaagaagagggaaagctgtgtatttctgcagggattcatgactagttagatggacatattttattatgttttttcacaagggaaacatttttcttcattgtatattgaggtgtggtctcttataataaagattgttttagtctttacccaataaattttccacagtatctggtataaactctggctagataactttttactttatagaatttttccctaatgtaatgtgtgaaggagtgaggtagctatcagatttccatttataagctaactgaaaacatggaaactccacaaacagcccatataacctgaaaattgagcaaaatgactatatatacacacacacacttatatatgagctatgtctatatgtgtgtgtattatttagaatactatttttctatacatcagtttgttctactccattactcttttagttttcaacaagtggaataaaaaataggatttcaaaagcaatatcataaagaataatattctcagagagcaagaaatgatggaggaaaaatgctgttttataaagctcagtctgtttagtctagccttagtttgactgctgacaccgggaatgcatttctaaacttctaaatgatgaaggttccatttctagtatatttatatacaaattttatgaataatgtgcaaatttacaaaagatgatttgctttactccaattccagtgacattttccaaccaattattttagaaatatttttacatatgccctctatattgctgataaaagctgactcctgaaggttacatgtttattctctaatagttttcattttccaattttgatactgacttctgggttcacttatagttggcacatcctttttttcctgtttacttctttgtaaaccttcttccaatacacaattacccaccccacatgtcttttcaaataggagataattggttagacaagtagatcctactgtttccaccgaaaaactagaagaagcacacattcacgggaaatgtctttaagtttatctttaaattggagcagggcagaggtcactagctgaaaggaagtcaaaatgacaaggaccctaatggttacagagaaaggttaagacaagtaaatatctttccatgagacacttgggctgttgttagctacctggcaaaaaccattttccactgaaataagttaaaatatcactaacttagaaaaagtaaaggaaagacagtttaacttaatggaagttttaattatagtctactttaaaagtgatttaactttattgcttctgaacctgtattctgtcacataaattaaaactaccaaatgggagcagataaattaaaaatacagtttacaaagacttacgttgaaaaataacttacaaacatacacaccattaaaacattaaaatgggttgctagagactggcctaaccttggagaagaaatcctggatttggatttgggggagctttcttttctaaacattattgcaacttccaaatgaatacattatttccctcccaccgtaggataaataatgagtttaaactaagacatgggagacagagagagattttaggtactacagccttccttacaattttcaaaattcagaaacgcccattggcttttctagtaggatatggctaagaaacaatgtcacaagggtcaatggtaattgctgcagaggatctagtctgagaggaatgatttaaaggcaaagaggaagaaaaatgattataaccaaacagtccctttaggaatgttttaggaatatattaaaagttctcttaatcaagaaatttctcttaaccagatagtgcctgatattcttggagattttcaaactaaaggtaaagttttgttggcttacggttttacagcaatgttgtttctaactggttttatgcaaccacagtagcaacaaggcctagtgcttagcatgatggatttatggtccattttgggcttacggccattaggatcactagcagcctagtttccctttgatttaaacaggatatcattggtttggttggtggcatatttcttctgtggctatggttggcttaaaataagcatttttggtgtacttgtcaactgtatctagggagagggaataatccaaattgtccaaattttattaagaaaagaaatcacattcttgcatatatctataagtcaggacacaaattccattatgatgtgtagaaggtattcttccatgggtaattttatgccttaaatcaagatttattgacatcaagcagtggtgtttcatcaaatggcctaagcatccttgggaaaggaacagaggcggtgactgtagaatgaggcacaaagtttgttgagcagtcccactggttcatttccagacagcatattgctgcttgtctctcaaccctttttgcaagagccccctcatctgatggtaactaaagaggtttttatccatattttatattcctgagtgttagatgtgaactttgagtagataaagtgaagagatattactggttataatacgccaagatgcaacgactgcaatttgcatttatgaaactaaaatatttgtaaattatatcccataactgttcataggttatatgataggtgtatacgtatattttggttttgttttggcagaggctggtatttttaaactttgactctcctttgcagagattgatgctgaaaaggtgtctgtgagcataacttttttagccaatccatcttttgtgggacaacaatccctgccagacatttctttaatgtttggcacaatctatgtccctgtttcttttctggaattagagctctttttttattctttctgctgttctgaaaatgagaagcagccgcctttctattttcaccagggtcaaattgctaaagtaccatttattttttttaaatgtggctatagtacacattgtgcatgaatttattcatagaaaagagaagtctaattattttgagagaaaatcctctcgaaatttgaataaagacaggacaaagtaaccaattttgcaaacaagacgtacggcatgcaactagcacattttggcattatgccttttttctgtacaatattaaaagatatattagatttgataatagagttgcttaatgtcctttatggaatttgcctctcctcactcagaaacaaaagcatatttctgtttgatcatataccttgcgattatagttttccactaagggattgtagggaaaacaaaaaaaactaatattatcagatgtctgtttaatgtatatttataaataacttctgtggaattcttctgtcttggaaaattctgagcaaaatgctaattttatttgctttgcagtatttacacatgcatagaaggtcttttcttaactctgaatgaaacccatctaattaatgatgaagaaaaagtgtctgagacggtgcattcaggagataggagacatggcaaaccactgagagcaatttgtgcactcaagtttatgttctgcataagagggttacctgctacttcctaacaaaaaaattatttgcaatttaagtatttaacatgtcctcattaatgctaacagacaataatccagaagtttaaatatgttttaccaaaacttttctgagaggttggtgggtcactttgtattgctctttctgatcttatattcatttaagtaccaaagagtagagggactttcgtaagcagtataaaactaaattatatgttgatttttccgtgggctgttaatgtcttgttaccgtgaggtggaaagggctgcttcgtggtttctggcttggtaatatttggcttgtaggtaaaggggaagaaaacacagaccacctgtaacatgaatgttgacctccaattgctctttaaccaaaattcctttcagttatttccaaatttatctttgattaattttaacatttatgcattcttcaccctactctgtgtgtcataaatggcagtcctttagaatggataatgttctaaataaaattaacctgtgtgtaatttttttccacaatagatagaattcaagctaacatagactgcagtggtcaaagaggaaaccatcaagattgccaatgtggggtagcccatattgatcccaatcaggtcatatgaccttggcataccagagaagtcactaaagagtgtcaacaaaagagaacagtctgtgtaacacaacataaagaaaagagggcagaccctgcagtgatcacatcttgtgtttgagacctgccttggccacttacaagtctcaagttcctcatcaatgagatggagttaataatacctgtctcctggggtaaatggtgaatgagtctcagaaaagacagcatatttcagccccattcacagagttaaggcttaatgtgatagctacagattggaaaggaatgaaccattactcttcttaagaatactcagaaggaaaaagcctggatgacttaagagaaaactttccaaattgtgttttaaaacatcagtccagggagatgttctcttgtctgatgagttttgtaagcttcacattctatgtaagctttgtggagacacccggagtactttagcaaactggtggctctgagaaatcctgcagcacagcaacttatttacattattgatcgcaacattaaaaaaatgaccatgacatttttaaaatgttacttttttatggaacaaactttttgaaacactgacctaggacataggtaataagcttttaactcctcatatctcagactttaggtaacaaaactgaagtgaactgtaacttaaaacaaaccgtctttcctttttctgtgcatttgagaaaaagaagatttggatgtaaatctatttatctcagactaagtttggggtttcttgttaatttctgtttaaagagattttgtgggccacgcaaactaatggagatctagttagtatataatactttctcacatcatgtggctaagtttacttgtttgctagtcttgtatataaacagggctctgacaatctaatgtctttcgccagccatttataaaagtgaccatgtatattttatggtaaaaagtaagtgcattttttgggcactggtaaataatgatttgttttgtcctgttatttttttgtggaaagaaaaatcttacatttcagtcagatgtttgtagtaaaagaaaattgtcatattcagtagccgatgataaatacattttttgtgttgttatgtatactatactgttttaaagactaagctattttttggctttttaattttttattgtgataaatttaaataacataaaaactaattgtgccccataaatatagacaattattttgtattaattaaaaataaaataaaactttaaaaagaaaaaaatttaaatagtagctgagaataaaaactagatcaacttagatattattaaagtcctgggactcacagaaaacaatacactgagataaggttatatttgacacctaattgttaaaaggagagataaccaaaccaaacaaaaatagcattatttctatttagcctattgcaatgtttttgtaatagttattgaaattcagagtacatttataaagctaaaggaattctttaattattagatacagaaaatgtccttgaatgggagaatagattgagaaaacacagtactcttcctattttaagaaggtcaaaatatttttagaggacatatttggtgtgtttgtttaactaaatattcaatatgagcaaagaagttacacaatttacttttaacgaaaaaaattttcaaatagggaggagagagacgaggagagaacagatgcttctggtggtgcagcagcacaaattgagcaattgtccagtaggggttgctcatagagcaggaaggctgattgttccagctacaagtttcacaacttcaagtagactgggatttcaaggccactcaagtgtcttagtcgaaataacctctttatgtactccggaagtgacccagcctctgatatctattaggataaaatagtatgtgtgaaattaaagaattgctaaataaatcatttgaagcttgtcatctgccttaaaatgacattttacaaaccacatttaatatgttgctgtgcattagtgaggggagctcataactgcttttccaaacagaatcaaagtgtagttaaattgtttttaaacacagatttagagaatgaaattgagggtagtaaactagtagccaactaaagcaaaacaggctggaatgttggtaaccgattgtacacacaggatccaagcaaaacatcttgaattgctagtacagtaataaattatagttttcacatttgtattttgcaagtgaaaacagcactaagtcaagcttgtgaaataaagaccaaatgatgacgtttttaattcacccacacctatgatgacccagtagacctgcctcatcatgcaataaatggaataactgaggctgaaaaaagaaaagaccagtagacagaaactccatagtttttgtatgcaattgtagatgggaaaaaatggttgagagaggcaaagggttaattgtcacaaaggatctaatgaatgtgttgatttcttctccttcctttgtccctctctcctcacaagatgacccataccacattcagccaacagtcaaggagctatctcattttctttagggttaattttctcttcttaacgtaatgagataaatggctaaatggggttggtgtctcgggagtgttcagagggcaagaaatggtcaagaactggtttatctccaaagttcattagcctattagataactgacgcagggcaccccaattatctcaaagaatgagagacttctaagagatgggagtcagtccttataataatggaacttggctgcctgcttcagaaaagagactcgcaaatccctttcgtggagcaggactcttctgggtggagaggatgggctgatttatttctctgtggtgtcctggagtgtatctgccctgattgactcccttggtcttgacatcagtcactttggagtcaagataatgaaaactacattaaagaggcccctccagtttatgcaaatggaactttttcttcaaagggacaatatccttgggagaatttctgtactattgaaaagtattaataaaagaaaatgtgttggatatttcctccctcctactcctcattttctctaatttacataggagtgggagtgacattttttattttgtttcattaaaaccctaaattttcctcatgctttatctaaggaagtcaaattgtatttagtctgaaggttgctgcatggaattagtaaggacataagtgacacttaacattattctaaacaattaaagttacacactttaggacatcttgggactggatcaagatgactggaggagcatcagttttgcatctgaacaggtgtgccttaggctaacagggcaaaaatgataacactattagcaatgacatctgcagttgtagcttgggttgccactcaagttagaaaagaatattatgttatgtctattcagggactctttgggggagggaacacgagataatgctcaaggagggaatattggaatcatgtgggaatgttgtgtttccctatctttcctacgatgctaattatttaacaaataatatcaacataaatgtgacaataaatgaggactgtgtttatatgacacagtccatgttgactcaacatttttggagattgatttgaaagagtagaaggagtttcttaacacagcatagtgacacttccaatcagtgaccagaatgggacttagcaagaaatcattaaagaatgaatagtttacttggtaatctctctggtgttttcaaaatgttgccaaggttagagatacaggatttagtttgaccttgatgtcaggtttgtgttccttggtattctaaattgagaatgaacgggtggtttatgagtgtccaacaggagcttatcctcacctgaactttctttaacaaccaaaaaaagagcacaacttgaaggattcttcctttttcttaagaaaaatctatacctagagaagagtgtctcagtttttcagttttctcacacatttttatttattttctggctagtattttgaatataatggacctagatgcagttttgtcacacgtttttatttattttctggctagtattttgaatataatggacctagatggtaaaaagttttatgtaactatttcacatatgactattttccaaagtgaactcaaattgttactttatttttgaaagttgaaatctgtaatatcattcgtactaacactatgctgtatgtatgaaacatggttaaaatgtgatagaatgctcttgcttttaatatcatttttgtcttttccttagtattgccaatcagatagtgatcactaataggatacatttatatagtattccaaaatggtggcttctttaaaccaaatagacgtttaattcaaactaatcactgaaatagattggctgtgaaattatagttaaattatcttaaatgttgtcacaagatgcaaaactacattatagctgcataattacataactatattataattatatacttgtatatattatatagttatatatgttataattatatagtataataacatattatactatataatgtataaaacttgtatgttatacattatgtagctatagttatataatgatctgcggttgcttttctttttttgcttttttttttttgagacggagtcttgctctgtctccaggctggagtgcagtggcgcgatcttggctcactacaacctccaccttccgggttcaagcgattctcttgcctcagcctcccgagtagctgggactacagatgcacgtcaccacgcccagctaattgttttgtgtttttagtagagacagggtttcacaatgttggccaggatggtctccatctcttgaccttgtgatcagcccacctcggcctcccaaagtgctgggattacaggcgtgagccaccgtgcccagccagttgttcttattattacttgacttaggaatctatggctgtacaattacaggtgagattcacaatattgaacaaccatttggtttggcacttatcaaacagaacagaacagatagtggcaataacaatcatcacattctcggtgagcatcattggcgctgaggaagagatatgattgcaaagatatctgttggaggtattattcttcccacacataagcacaaacaacttattacggagaaataaataaaagtaacccagagacttcctttgctagtgaaaacacagaggcaaattcttagagttaagctaagagtaaacgatgcctgaggaacgcattcaaagtcccaaatacttaacttggaagactctccttgtaaggatggcctagcagtttcccttcagcagtagtaaatctggatgagcttctctaggatcacatcctggcagatgagatgctcatcatgacgaggcccagcctatgggagatgggatcattagcctgtttttacattttaaaatggcctatgtgttttcttccttttattttttttaaatcaggaatgcatgatctttgtagaaaatttggcaaaagctgacaagtataaaaaacaggtgaaacatcacccataaaaccatcacccagagcaagcactattcacattattacatgttttttccctagtctcaatctctctttctttgtctctctctgtgtctctctttttgctgaaaattatcttgctgtttggaaagacagtaaatatttcttcctttgggtaacatctgaagctttttgtcccactcccttttcaactgtaataccacctatgttaagactgtttaagatggctaatcttttagacactgatattcctaaagtgttcaaatggctcttatcccttgagtcaccatggtttgctcagtcttcatgggacctgtgaggaaattcctttcaggggtcttggcatgagctgagagtttagagttcaaacatttcttactttggatcgaaatggaagtaaacagtagatttttttttttgttatgctcatgactgccaagatttttattttagggttggatgttattttagggttgaattttagggaggcatgatgagggtgatcagtactaaagccttgacttaataaaaagaattttgatggtagtcatggaagtgttcagtgaactctaactactcatgaatcaatgatatcatgagtaatgctaaaattagactcaccaggagaagacgcatgaacaaaaattatgtgattatgagaaaaagaaggaaacttatctgttatcataaacactgattataactctggaaatgcttcactaaacacatcaaaaattctttttgatcagaatttaatataagctcaatgagttgattatgtaagccctctgctacttttctccccctacaccaaatgcctaaataaactttatttttcaagttgaaaggaccgttctaaaattcgtcattcttaatgctctaaaacgcccgggttcagaaaattaaattacgccatttttatccgtttgagatcagttctgtttcctcctttggtttgtgtttactttcctgcagtagctgacatcaaaatgttttctggaatgctgggactaaataagttatgcttaactcaatatctaatacaaatagccctggggagcttcagcgacacaatcataaaagctatagtttcttttaatagcttgccacactttgctgatatagtatttctctaatcaccaatctttatgtgccttcctgaccttggagctctcagtctaaatggctttatggtatcaaaggcctgtgtcattggaagagtgaatggctttcatttttccccttgaaacttccagttcctggcatctgtaaagaattattccaagtggtattttgctgccttgcggccactgccctgtccaatggaagtgacttttcccagaaaggtcacagtggtctgtaataggtggatattgcattcagggaggaggcaactctgatttctctatttttttcttttacaatattaattattcttgtatcacattagttatcaaagatctacatcacattttgtttgcaaaatattttggcaaaaaatggtacactgtcatgttctaagcatgaaaggttagcaacaagcttcataaagtcatcctatttgttgggaaaaagacttttcatttacacttgatgggggagattatagcaatgcacaatagttcgtcttcagactctgttcctcttcagcacctcaaaagcacaccaaaaagtgtgacacagcagtgattctggggtctcaaatccacagtatctctccctaactgtgtcaactggctggggcaaccattgagaaccaagacttctgactcacaccttattctaaatttgcatttctcaacataattatgttttaagctttgtgcacagtcaatagagggtgatcccatggatatctttccatggcttagacaggaactttgggtaataggtaacgtttccaaaccttctctgtgccttagaatcttaaaagcacagagagcagtgtgggcaggggagtctgtaggtgtgtctgtgtgtgtgtgcgtgtacgtgtgtttgtgtgtgtgtgtacgtgtgtgtcgaaataatgtagaatactagcaaaacctgtgaggcaatttaatatgtttccaatcagaattccttagtgcaaataagaagtgtaagaagtataaaatcagtacagaagaacatgacaacgaactttagaggttcttgtatatcatacaattccatctatttatttatttatataaaatctgaacatgttttccctgctatagtgaacaccctcccaattactcctaggaatgttcattgtctgttatttggtctacatttcttgatttttcctaaatggctcttagaaatctactttatatattaagatattccccattgattccagtttatgctaatttgtcttgtattttatatgcattttaatactactgaggattaagactagaaaatagaaatctcctctaattccataaaatcttttactatttggtacattttcttcaaagtcctttttttgtatttcatatataaaatatgtatattttttaaaaatttgattcatatcagatgtacaattttgtaaaatgattttttttctattgacatgttaacgttgttctgtgttcctaaatgttcctcaaagccatgttttgtggaatagccaaaataccttaaaggaatacctgtttacgaaaattagtctcatagatgatggttatagagtaacaggcacacttgtcctggcattggaagctacaagaagaaaaaaaaatgtctcccttttggagaggtaacgattctaaaggttttgagatcttagagcaattactagatttggatgtttcctctacttcaacaatcatatgtttgtgtatggcgatggggagagggagagaagtagttttgaagtcctagaatttctgtgaaatgcagttgcatcttatgaatgagttgtctttatcgtcttaacttgaccaaccctttaacccctcactgccccctgtggccttttgcgtgaataacggtgacaatgcgactgccattctagaatttagtttcccagaagtaactgaggtagttggtctgtttatcaagatacgcttgggagtggggctatctctcacctctgtgtgttggtaacagttttcagtcactctgagcctttgctagatttatatttacatttttggaggaacagtattgagttggcaaccttttgctctgtaacaaatcagcccaaaacataatgaaaacaataaacacgcattattacccaggaatctactgatcagctggtggttcttctgttctgagtctactctgctaggtctaggctggccttgctcacacgtctgggaaagcttgcctggctgagaatgctagggcctctctccacatggttgtcatctccaggagactagccttagtgtgctcacagggcatggcacaagtgctcccagtagccagaagttgctggccccagctggcaagcactttttaagtgtctgcttctgttactcctgctattatctcattggtcaaatcacatcccacggccaagctcagggttatcatgggagggagctacttaaaagcttgtgtgtagagaggaatgcttcactgggtacctgtactgctacctttactgccactttcttcctagtttctgaaatccctttcagttggacagatacaggaccaaattaaaaagttttcatgactgttgctgcaaaatttatgtttctgcaaaattcatattagaatcaataaacctgaatacatagaaacttgttcataaaaaaaaaaaaccttgccactgtgaggtttttttcctcttaagcaaaacaaaacaaacaaacaagaaaacaactctccgagataagtgaatcttctcccagttttggtgtatcattctagtcattggagatatttaggagaataataaatgcatgttttacaaactgtaatctgacatgccaaaaagacatttcaaaattctcatgtccaatacagacattgattctgttgtggcgtctgatttaaaaaaaaacaaaacaaacaaaaaaaaaaaacacaactgtactatagtaccacagtacaccagtactatgaaactcaactggttagtcttaacatgtattttcagataaaggcaatttcctaaagatgagttattttttgttaatgtccgttagatatatactacacacccatatgttgcatatttttaatagaaaatacaatgctgtttcaaaattctgtctttaaaatcagaacccattataaataatttcgtcatgggaatacagaactttgaataattagtagataaaatcatctgtcaatgtcatgcctaattcacacatgaagtgaacagggaacatccattacatgtccaaagacaccctagattcccacatatctgtgatgtcttgtacatatgatttcccataaattcacctggagagagtgtagactaaggatcttccatattggagacgcacttggattaaaattcttgctctattaattactgtttaatcttgagcaaaatcctccagttttctgtgtttccatagggatgacatagagtcaaataaggcacagagacagtctcctgagtgttagtttcctgccttctctctttcactctttttcttactgtttaacttcagctactaacagcagttgaacactttctgctaagttgcaagccaggcaccatttggaagcaaagaagcaggctgggagcgtggctgtaggttagtcggatctcgctgacccgtgaaaagggacaggctgtcgcttgtgccagacccatctttctatggttgtttgctcctctctccaatttccctgcatctgctttttggagacctgctatatttccgtgcttactgacaaccaaattgttctgcctctagtgcttattatcatacttcaaggaaaaggcacttgggggccgtaaggagaacttaaggcacaaaagccaaaaccttgagtggatttatggacgcactggtgtccgcagcacctccagagagtggatggagtgaggaggataaaagtcggcgactgtccagtctgcataattttgggatgcggcctgtaaggctttaccatttctgtgactttaatttgtgtttttgctaaacattagatggcttaatttgtcagtggatcagaatcaaaaacactttgggacaaccataatgctatcctgagagaacccagggacaagctaattaggaataaagaggagagatggagaagagggtgtatctgggtaacttcatggggtgaaatcccctcatgggaggtggcagctcggaaatctgcatagtaacaaacctgtcacgattcaaggacaactcggcggaacaattagaattaccatttccctctggcctttaccaaaaatctctgcccacactttactctttgcaaccaacactgcggttttgtcttaacatttagtaagctgttgttgaactttaaacatcctttgtaaggtatgcattttctgcctcaagagtaaaaaagagttacatcttttgaattctcatatctcatatgaatcctacactgtttccatttgaatgacaattgtgtattttgaaatccacacatattatatgaatcctaaacattttatttgaatagcaaatgctataaggaatcaagagaatattaaatattttatggtaaataacatctgtttcaatgatttcttcaaacctgtttcattttattctttcctgaaactttaaagccaatcaaaaaaaacagatacactgagtatatatattgttgccttataaaagaaacacgattcttatttttaatgtttcttctatataaaacaatactttgaatgtttcatttctgaacaggtgctcaaaggaaacaaaaaaattaatgatattatggtattttgtaagttgtaattatatccctgacttcctattttcatcaaattattatagatattcatatatcaaaaagcacagtttccccaaataattaattttttaaattaaataaaatatatcaaaagtagcaataagggtaaaatctcattggtgaatttctgattgtacgaattaatattaataactgacctttaagaagacaaatatatgtgagagtaaatctggtttgcacttctgtctgactttcttctctatctttctgcatagcagcataatctggcatgtttcctattctatcattttaacattttccattttatttagacgtagtgaactaatgcatgcatgtttatgaaggatttcaaattggaagagttagaaaacaatgaagagagatcaacacacagttctgaaaacaaaaggaagaaaaattatgatatttccccctctccttccagaaataacccccaatccccatccctgtcccccagggccctgggcagtgtcacattcctacctcttcctccaggcagaactatgcaagtgtgaactgggttggctcctctgttttctcctttttcaccacaacacaggcacacattcagtccattactaattttagctgcttccttttgcatactcccacaagcagatcttaggccaagccctgaccttgtcctgccttgactaatgtggcatctctgccattcctggactagaggaggagggtggcttggagaaaaatggtatcaaaaacagctcttaaaaacaagaagtacactctgctactaccatgtaactggcatttgctagattctcttgagggcccacaaatgttcttggtataatcaggacccagtggcacccaggcactctggcctgcctgcaaaacatagccttagccagatttaatttgtgacacccaaaagaagaaagtatcggattcaccaaggtgcagtgtgtatactgtctctacttttgcttacacacttcttcctccatgacttgttgactttggaggatttgggacttttccttgcttaggaatattagaagtattgtgggctcttccttacctttagtgactttaagcatcagcattcttctgtgtactgcagaaaactcttattgcaatccaattttcctcccatattttaagaagccattctaggtacttaactgaatttgtgtgtttggaatctccttaagtgactgacatcttccctttgatagtcatatccttaagtcacaaatggacattctcaaatggcattctcatctactttgaccttgatagtctcttacttttagtacttcaaaatggggacaaacataagatttggagcaaagataaaatgaagaatttgaagtttaaacatactgctgatttcagtagctgatgaaaaattaaatttgattttaaacatctgaggagcaggaaaggtattctcttgcatatacacagacttgataataatttttaaaaataggtcacatagcctacatatcacaagcagttaaatactaaattatactttaataaactaaaaaagaagaggaaattgaagtaaaacatccattgccattagttaaaaatggttttcagcattttataagaaatggaatattttgttttattgatatgaggaaatgatatacatcagtactgtctaatggaaatatgtgggccacacatacgatttttaactttctagtagtcaattaaaaataaagagacaagtaaaattattttcaataatatatgattttttaaattaaatatgcgttcctgtgtttaaacacattaaatggggattgactgatgtacctgcgggacttctggatccttaacttgctaatttgtgttgtgcatctatcaacaggttagagtaggatttctcagcctaagcactaatgacactactgacttgccaaaatgtcagccccttgattccccattgcgggagctcttctgttcattgtggtattttaacagcgtccctgactcctccttactaagtgctagtaacacccttcttccctacctcacacccattgagataatgagaaatgtctctagacattgtcaaatgtactctgtggtgcaaaattctcctccactccccacccgagccacacactgggatagagtgtggagcaggatctcacccgtttgctcacacctggtgatctaaatgggtgtgcatattctattccaatgattaaccgaaccctgtacctatgcttagtaactgaattgaattaatttgaaatgttttaggctgggcacagtggctcatgcctgtaatcctagcactttgggaggccgaaacgggcagattgctcgaggtcaggggttcaagagcagcctggccaacatgccgaaaccccgtttctactaaaaaaatacaaaaattagctgggtgcagtggcgcgtacctgtaatcccagctgcttgggaggatgaggcaggagaatcgcttgaacctgggaggtggaggctgcagtgagccgagatggcaccattgcactccagcccaggcgacagagagagactctgtctcaaaaaaaaaaataaaataaaataaaataaaagaaatggttcagacccataggcattatgatatgtttcacaagaacaaaacaagaacatatattcaggacctaaattaatcctgtagtggaaaggaaccctttcattgatgtctgggcagatttgtgtcctaggagacctagatactgacccacagacgtgaatcctttccccagtctttcccacatgaatagaaaatgtcccatctttcttgccttaatgctaaccaggtcgtttgtttacatgtggtaaaattttgatcctctctgaaagttttccttttttttttttttttttttttttgctttattctccctgagccgcaataaatttccacagcaaacctaaacatttcatttgcgtaattaagtttccatatggatgctgatggcttgtttgcctcatttctttccagcaaaattgtaagcaccctgaggttaaagacttcgttgatttttttcaatacctaccatggatcaaggaaatttgttagtaataaaatatttgcttaatgattgacaataaaattgaatgctttcataaaacaacaagctgttcccactaattttaactttttcctagctttaccttgtatttcactcaaatagggaaatgattctttatttgacatcatttatgtgctggacactggacaggattctgggcaaaactgataaacaaagaactcctgcccttggcaaagctcacagttgagcgcagtagttctcaacctgggaggactttgtcctgagagacatctagtcatgtctagagacatttttaattatcacagttggggtgggttgctactggcatctagtgggtagaggtaaagggtgctgctaaacatcttacaatatataggacagagcccaacaacaaataattatttggactagaatgtcaagagtgctgagtttcagaaagcttgggaagaggaggataaatcaaccgatgacagcttaatggaaagtgatgtatgccttgatagagttaggtcgagggtgccttgagagctcacaaaaggaaaaataaatccaagtgtatggctgagagacagagaaggctccccagacgaggttatggaggctgggtatgcagcttgggaaccagcagcagaggagtgaacaatgaggcactggttacccccaagaagaaagtgtggaaatagagccaagagctaggggtggagccccagagaagccaactgtcaaaaggaagcccaggaagaaaagccacaaagagagggaggaactggaagggtggaaagcagcgagatggcgtggaagccagtgaaggagactgtttcaagaaggagagaatcactaacaatgtcatatacctcagagaagctgagtgagataaacacagaaaagtatctttaacataggtaaagaggtcactagtcactttaaagagagaaattacaagtgaaggaagtcttagaagtgatggaggatagattgtcctaagcagagaagtcaatgtggggagataaaaagtgtggatttatcttcaggaggaatgcttatgattatttatagagcagaaaaattgaaaacagtccaacagtctaataaaaaggtatgaaaatatttataaatatatgcaggaatatacagcccctaacaggcatacttttcaggagcatttaaggtgaagggaatatagtcggaatatatgaaaaaatcaagatgccaaccattattcagtatgacacctgctctttttttaggtagggaagaacaaaactacaaaaaatccaaaatattaaatattaacagtttattcatgcatggtggatatgggcaattattattttcctctttgtaaattaatctccaaatgttctaaaatgagcatgtcatacttttaaaatgagaagaaaactttcttaaaagaagaaacttgactgagaaagaacagagaaagttttggcagtaacttgaagggaacacagggaggggaaaggagtgtgtgtgtgtgtgtgtgtgtatgcacgtgcatacatgtgtgtgtctgtatttgagttggaagcgatgagagcatttttgtatattgaggggagacagacagtacatgctgagaggctgaagatacaggagcatggatgattgatggagcacatccctaagggagcaggaggggatgaaatccagatcacaggtggtgggattagccttggctaagaggagagacatcgcttcaactgaaaaatgaggaaaagaggtaaggatggatgtgggtgctgataagagtgtagaggagggggcaggaagttgagggagttactgtttgttggcgtctatttcctttgtgaagtagaaggtgaggtcatttgctgagtggggtcaagggtttacagagaatggagaatgatggagatttggaagggtggttatggagaaaaagagggaggaaggggacttgggacacagagattgcccagctgccttgaaaggccagctgaggctgaagacaggatctttaacaaacagcacgtatttgtgtgtccacatggctttctctaactgtcacatgtttaaaaatagacaaagcaaatagtgagactgatcataacttgcagtttttgcagaaataatgagactgatcataagggctttctgcataaggccctgtggaaacatgattattttgagtgcctgaagtaataaacaatagagtttgtactggaaagggagagaaataagccagaagaaggctgaagggaatggaagccaggtgaggtctacaagtcccagtattgggagacagggagtgagagaacttgaatggtgaaaggtttgggctgtgaatggaatattggacggcaagattctagttatgaaagagtgcttggtggaggggagaggcctcattagctgatgtctctatggactctcccagcaagtgtggctactggactgtgaaaacacagtttcttatcatatgtggtacacagaaacactcacaaaaagaagcaaaatcctctgtgtagattaaatcacattcattctttctcctctctccacacacacccacacacatgcacacacacacacacaattcatacacacatgtatacatacatatatatattcatacatatgacttgaaatattattcagaaaataacataaacgttaacaacagattcccaaccaagaaaaaagaacactggactttgtttctttttttttttctttttttctttattttattgcagaatgtgcaggtttgttacataggtatatgtgtgccatggtgatttgcttcacctattgacacattctctatgtttcgtcccctcactctctacctccccagcaggccctggtgtgtgtgtattgttcccctctctgtgtccatgtgttctcattgttcaaatcccacttatgagtgagaacatgcagtgtttggttttctgttcctgtgttagtttgctgaggaggatggcttctagcttcatccatgtccctgaaaaggacatgatctcattcctttttatggctgcatagtatggagtttgtttcaattccagatatttaattgctctataatttaacatgacactttcacatcagaaaacttgattttctcattggcaaaatgggttaaattatatctatttaacaagtatttttttaagaactagattaaaatttagaaacatatctcagagtttttgaaaccccaaatattatagcttaattcacttattcaacaaagattgattgggaactacaacatgtttgtatttgtgcttggggaattgactgtgaataaaccagacacattcttctcccttacaggtttagaatcaaatgggagaatttaagggattatcatataataaagcacctttcttgccctgtgttgtcctggcctcaagcaatccttccaccttggcctcccaaagtgttggcatcacagacatgagccatgacacccagccttgccctgtgattctatgcttcaccctcttccaagacttaagccagagttctgccagggtcctcctacactcaggggtgtcttctgagaaatgtcagtgtattagtttgttctcatgctgctgataaaaagacatacccgagactgggtaatttataaagaaaaacaggtttaatggacttaaagttccacgtggctgaagaggcctcacaatcatggtggaaggcaaagaggagcaaagtcacgtcttaggtggcagcaggcaaaagagcatgtgcaggggaactgcgctatataaaaccatcagatctcatgagacttattcactatcatgagaacagcatggaagaaacccacccccatgattcagttaactctccccaagtcccacccatgacacgtgggaattatgagagctacaattcaaggtgagatttgggtggggacacagctaaaccatatcagtcagggaagaaggattttggttatctgtgatcacaatctgttaatgtttcatcttatgttacatttatattggtttaattattcaaaatcttaaatgcaagctcctaattttacttcagaatgattattttcacatgcttatatcaatcatacacacatgcacacatatacagatatgtacagaaacacacatatatgcatacacacatacatacgtatatatatacacacatacatattctggtaaaaaaaatttcacgcataatcaaagcccaaaggaggttaaatattcagaatattagctcattaacattcagcacattggggataatgtctatgttaatggtatccgttcatctaacagagggttggcattcatacctaggagttgaaagtacatcaaatgctccttgatgagctaagcaaagtgaaaatgtacgtgctattcccctaacaaggaaagccgctgaagtttaaataacagaaaagagcacatggatagagaaaaagttaatgcagaacattttgttgctttattattcagtgacagagattagccagtggggaatatatatatacatgtgtatatttacccatataaataaatatagattttaaactaacagtcacaaaggatatcatacatttcaaatttgcatacaaatagtacttcctaaaattggcaatttgatttactcatcttctgaatatcttctgcaggtgtagtaataattttcagtatgtctggatgcctagaatatgtttagcagtgtcctaagtattttaagtggatcctctcatttaatttcgacaacaatctctatgcagtagatactactgttattgaaaatttacaaattcaaaagatggggcaactgaggctttaaggaattaagtaacttatctgtcatcgtcattgctcctcattgccccaaagtagagagaacatctcaattcaacaaatcatattgattccaccttctaaatatctcaggggtccaccttcctctctccaacccactgctgcaactctggttccggctgctgtcaactgagttaatgtaaagtctctggtagtctgactactggagtttaataacccaagtggttgactagtgtttacaaataagctcatattagttttgattactaacctcctgctgtcacaatagtcctaacaccataatcagtgtctctcaggtacttccgggtcttcctcgagggagtcttgcacgtgttgaggaatgagtctgtgctcagttgagagccaccaataccagctgtggtctgccacacccaccacccctgcccacacttggggttgctgcttcacagttctcaaaactttacaatcctcagagtgcaaagtgactcttcattccttttagccctcaatgacttttttgtcacaaatgagaggaacgctgtcttccaaactgtttcattttgccacaaaagaacagcacttgtgctataaatctcatatgacacagttctttctacttcttcctgaaggccttttctcttggagctcaaatagccattcaccaggctcaacagagaacacactttgttcggggctgtccattccctgtcttttcccatctcttctctcatttctcaccatacttctttttttttttttttccttcgggaaaacagtcaaccaaacaaagataaatcaaactcatatcaatcaatgcaaatgcccagtggatgtagtgggccagtgtgcaggatgaaggatgtgtagtaaaccccttagtagtgcactggtcatggctcatcaggtttgcccatagccagtctttgaattccaatttaaataaataggggtactttaagtcttccttaaatttaaatataatcacattttttcattctttaatatacatcagcgacttctcattgttttctgattaagttaaaatccctaaagatgttgacaaatttttcattaactgctttcagttttttctctttcatcagcggcaacaaccttctctaccaaccttgcttcaaactccatgttctagagaagggatgggctctagcatgtgggactattgcatgataaacaaacagcagtgcatagagctattgtagaatgccatagtcacttattctgcaagtttacaataattcctgtttcagtgtcaatttataaatagctactaataactaaaagcatgattttaaatctgcaggtataagcaataacaagcttagttaacatctaagaatgatgagaactgttttagcctttactcaagttgtgaacaaatattatgatgatgactctgctgaagaaccaagcagaggataaacaatgccagtaaatcctaggtattgcaggttcattgacatgttataaatcaaataaagttaagcttgccaataattgaatataaccactttaacatattatttatattgcttattgagcctacaagtataattttgaatagcaatgtttgatactttacaaattataatagcatgtgcataaatgtgcataataatattattttatgtctttcaaggagatgaaataacttttatatgcaagagtttattcatgtaagccaggaactattttagtgagatttactttgtttctattgattctatttagagctgaatctgtagcactaaaaccaaataataccagacaaggtcttaaaccaaattgttaagccttgtctaatcatattatattatccatttgttctttgttccgtttgatgagcatagttaaaatcaggtaactgaagttaacataacttgacgcaaaagcaatgcaagttgtatagcagaacagaaaagtctattttgtgggcagtgaccactaaaaataattgtgagaaatgagtgtcataaaaaaaaaatttgactgttgatagatgtgacaatttatgacaactaatgagaccacttagcagaatctgcatacctttggttgctataggccaaattattaaacagtgttgttaggataatagtttggtgatgagcattgcagatgagttgataaaaattattgacccatgagactaaatacagggactatctcaaaaaccaattgttagaagatatgtaagaacagagacacaaaataattaagtacgtgaggtaacatatatgttaattagattgatttagctattccgcaatgtatacacagatcaaacatcatgtttaacaccatgaatatataccactcttatttatcaattacaattaatttttcaaaagaatggagccatcacaacagatttagaaagatttgtcttgtcatcctcataaggatgtagggcatttatgcaagaagatttattaatataaaaatattagtaaattataataaaaatatatgtaagaaaaatcaacatgtgcataattctgcataaggagctaaatgatcatggaggctgagaagcaccatagtagatggttaatgaagtggttaaagactgttaaacaatatctagttgtgactagtcataactgatgactgtggcattggtgatggatatcagaaagaaggcagaagtttggctcaataacaccttgttataacgtattttggtaatagagtcaatttgagttttaaaaaataagtcgttgataacaatgatatattaatgatcaatttccttatcctatttggagaaatacctgatactatgaacgtttaaataacaatgctaattagattagtcttttttgcagataaaccacttattctggaagaaaaagtgcttatcaaatacactgtcatttctttattttatagatgtgctctgagagttcaaataaagttttcctaatttgcatctttgtaaagtggtagagctggagtacaaaccaaggagtttgtttttttctgaatcctgtgcactttttaataacgtcatttaatttgcgtagcaaggtgtgtgaagattaagttgcctactctacgcaaaacataggttatttttctgctggaataatcatttctaatgcaaatttgttcttatcaaccctgttaaactaattcaatcctcaggcccaaactcctggaatctaaagctatttgctgacttgctgttgctgttaggcttgagagtcagcctccttagatagggtgcaagtactgcatggcctccacaattctattcattccccagaatctccataaccagcagtcttatggagtcttacgaataagggctattcacccttatgaatagccatgctgacctgcacctgctctgtggcatttaccaggtgccctgtcacgagagtgactttccacatgctatgctgtctacatggaacattcttctttctttctttgccaagctaaacccttctcattcttcatctcttggctcagaggagcttttcttggttgcttctaatttaggaccctgtactactcttcataactcttacctccattgctcttttataattatttgtgtggaactgggtgaatatttgtctccctcaccagattgtaaattcagaagaagagtgactggatctgttgagtccaccattgtatcttctaatttctactatgattcctaacacctagtaagcgcttaatataatggatatacgaatgaaagaatgagttccatgaaagccaagaaataattacaaaagtgttttaaattatcaatgcctttttgtgatatttatttttaagtttgaggaaatacttagaaaagacattcttttcaaaaaccaaagtatttttagatattatgttacattcatctcagcaaatacaccagagtattattgtttaaaggtttggttgttgagacaaccacagttttcaattctgacccacagtgacaagttttcattctatttaagacattttcttacatgctatgagttgagctgtgtgcttcctcaaacacttatctattttaaggggaaagtgttttttttttttaaagcggatacttctgtttaaatgccaaaataaatacatgttaaacaatattctctctgtcttatttttatttttaaaattttttgttatccaaacatcttaacataaactgtcagtaattggctcctagttcaatgacaaaagatatttggaatatctttactttgacccatgcatgctttgggaggaagggtaaaatagagataaagtcaaacttttcttgagttagacatgcttggtaatttatacacaagcaattgggtctagacgccagtgatgaaaaatgtgattctcctaatgttatgtttagtaagatgttttcttggaatgagagggtataaagattaatgtctgatcctgaaagaattgggatcctacttacttgacccagcatgtgatatgtctgaacccatgggttttaaaaaatacattcatgacatattatcaatgttaaatctagtatattaacagagaaatctaaaagttgtaattagtgagattttattatggccacttactccattttttctttaaagctgtgtttcgtaatattattttttaaattaatgacctctgatgaaaactatagactaaatcttcagaaaaattcagagatgcacactctcatataattttacacacaacttcaggagttttatatccactagaattcttccacagatcctagactgagaatatctgttcaagataaatctatccaattcatgtgtcttaaatagaaatgatttatgttacttgtcatgtctctcgttatgatattttatatccagactctaattatcaaaagggaggaataaaggaaatgctcaagagatccatcttattcaaacgaaacctctttttcccctccttctcttcaggctattatctctagaccagagctctattgttcatcctgtactgtccattggctgccaaccagacaagggatgctaatctaggccattgtacaatttcatccctctctgggctgttatgtaattaaaataacttcagtgtgctctcttgaacatttttttctacaggcaattgtaaaaatatagaagttaaaaagcaaatgaaggaagaaaaatataatttgttttctttacttttctattgcaaaagacattacttattgtggacttgttatttatttaatttcaaaattggaatatagtttcttttgtattttgtactgcagaaaaatatctattgatttaaagtggtcattttccaagaatgcttcaaggcagttgaattttaaacatttctaaagcaactagttttcatatatatatatataaatgcatagtgcaaccaaattagtaatttattttctcctggaacctttatgtctgaggataccagaagcaatttaaatattctgtatataggtagtaacttttaccaacattctacccaattgagaaacagtgttgttaaataggtgcagcttcacataggtcaatgccaacactaaactaagtccctaaacctcaatccagaatcatgggttaactaaacatacacactctctcccattgtgtgtgcatacaaacactggttactcttgaatccaattccctctgcttctgttggtgatacttcagctgaaagctttgtagcattcagctaccaacagtcctgtcttataagtcacattattgttttggattcttcatgatttgaaaacaagaatatttgatttgcaaaattttacctctcgttagcacttttttttttttttttttttttggtattttgttcgctggcatgaaaaatgtgctaggcaaaaactcctgtttaaaatgagaagaacgtgagaaggagagagtgacctaccctcactggaagtgaccagtgagtacctgggggcaatacttcatctccttagaggctcaccactgttacaaggggccaccacttggccctagagggaagactggtagaaaacagtgagcgcattctgttgctggtgagcatacacctgttaatccagcttccctgaactgtgcaccgcacttgcgtactagaattcagcaatgctatccatagctagggagaagggggaataataaagatcctcacacgtttgttaaagataccctctaccttaaccaaatttttactgagcacttcaccttccacctcttatggattgatttacaatttcctttttttttttttttttgagacggaattttgctcttgttgcccaggctggagtacagtggcgcgatctcagctcactgcaacctccgccccccaggttcaagtgattctcctgcctcagcttcccaagtagccgggattacaggcatgtgccatcatgcctggctaactctgtatttttagtggagatgggatttccccatgttggtcagactggtctccaactcctgacttcaggtgatccacccgcctcggcctcccaaagtgctggggcaatttcttaaaatcacaagggataaaaatattttagcataaacacacacaacatataattgtacagatgtacaaatataaaaatatatatacaaactatataatgtatcactacataaatatgtgatatgttacaaaacatgcacaccaatagaaattaagaaaggagataaaaatgaaataaacattattttaaaattaattttgagatagtgggatagaaacttttttactatgattttaaaaagtgtttttaacaactttattaatatattcatatatgctatatgctttactcatttctatgtacaattcagtggtttttcgtatagtcactgaattgactggtgcaaccatcaccagagtcaatgttagaacattttcatcaccgcccaaaagaaactgtacccattagcagtaacttcatcctcctacaaccctaggcaaccactagtccactttttgcctccataaatttgtgtgttctgcatattttatgtaaatcgtattgtatggtatgtgtttttttgtttgtttttttgtttttgagatggagtcgcgctctgtcccccaggctggagtgcaatggcgcgatgttggctcactgcaatctccgccttccaggttcaagcaattctcctgcctcggcctcccaagtaactgggattacaggtgcacggtgccacgcctcgctaatttttttgcattttagtagagacggggtttcaccttgttgcccaggctggtctcgaactcctgaggttaggcaatccacccgcctcggcctcccaaagtgttaggattacaggtgtgagccaccgtgcctggcaggtgtgtggtcttttgtgactattctctcatgttttcaaggttcatccatgttgtagcatgtatcactgtttctttccttcttacggctagataatattctattttatggataaagcgtaatttttttatccatttatcaattggtggacatttggattgtttgtactttgggctttcacgaatagtgctgctatgaacactcaagtacaagtttttatgtggaagtattttttcatttttcttaggtgtatacatattattgaaattgctgggtcatagggtaactttatatttaaccctttgagggagcacaaactgtttccaaagtggctgcatcattttacacccccaccagcagtgtatgaaaattccaatttctctgcatcttccacagcatttgctttttattttttatttataataaacattctaattggtgtgaagttgtaaattgttggggttttgatttacaaatccctgatagctaatgaagtgagcatctattcacaagcctatcttttttagacaaatgtctgttcagaacttttcccatttttaaattgggttgcctgttatctttacctgttcacctcattttcaattggattgcctgttagtattgattattgtgtttaaggattctttccatattctggatacaagtctcttgccagatacatgatttgcagatattttctctaacttgtgggttacctttccacttactttatggtgtcctttgaagcacaacattttttaacctcaatgaagcctaattaacctatttttttctcttccttttttttttttttttttttttttttgagatggagttttgtcttgtcgcccaggctggagtgcaatggcacgatctcggctcactgcaacctccatttcctgggttcaaacgattctcctgcctcagcctccctagtagctgggattacaggctcacaccaccacgcccagctaatttttgtatttttagttgagatgtggtttcaccacgttggccaggcttgtcttgaactcctgacctcaggtgatccacccaccttggtctcccaaagtgctgggattacaggtgtgaaccaccttgcctgacttaagtaacctatttttttgggggagggggtctcttttgcctttggtcttatacgcaaaaaaagtactcctctatttcgtctgagaatattatagttttagatcttacatttggttccatgatccatttggagttaacttttgtgtatggcatgaggaatggagttttactgtattcctttgcgaaaatgcgatggtggttatgcagttgtccctgttctatttgttacaaagtccttcatggaggaagaatttttaaaatattttgccctgctgaattgtcttggcacctttgttgaaaatcaattcatcgtaagtgtaagagtttatttctggattatcaattcagttccattgatctacatgtctatccttaagcaaggaacacactgttttaattactgtacctgtatagtacagtaagttttgaaattagactcttcttcctatattaggatatcttcatagagtttatatatgtgacctttgatgcaggaaatgggtagaaatggtagtatctatccatatatcaaatactggtataatttatgttctttcttatattttaatttaaaaattaaatatgagaagctctggtattttcttctgcacctgaacaaactggctcatgctattgaattgaattattttcttaaagtttgcattttaattaatttatttaattttaattataattacatttaattttaataatgttttaatggatttattcttttgtttcaaatcatcatattaagttcccaatttatagtcttcttaatttttcagtccctttagtgtcattaacggctttcttactgagtgaattcaaaatgataatatgttgaaattttaaagacaaaatatacttaattatacatattactgtgttcatttatctatcagtgaaattatttcatagttggtacagattaatgtatatcttatgaatatatgacctgaaagtaaattcacatactttaccttagtaaaaaaaaaaaatgtgttaccaaacgtatttttatgctcttttcttttttttttttcttttcttctttttttgagacagagtttcgctctgtcactcaggctggagtccagtggcctgatcgtggctcactgcagtctcagcctgctgcattcaagtgatcctcccacctcagcctcctgggactacaggcatttgacaacacgccaactaatttttttgttgtttaattttttatagagatagggtctccctattttgcccaggctggtcttgaactcctgggctcaagcatttctctgccttggcctcccaaagtgctgcgattatagtgtgagccgctgtgcccagcctatttttattttcttttttcatttatttttacattttctctcttaatttcttcttcttctacaaaaatgtagtgtttacagtaaaggtatctgtatgtggaaggttagttattataataatattggtgttttatgtatgacaaacatgccataagcattaattctatttttgaaaaattattaaacaattaatatgtataaatattacaacaatgaacactcataacatccagcttaagaaataaaacactacaggtacaattcaagtttcctatgtatctctctcctattgcccctctcattccttcccttctgaatttgctgtttattttttcatgtatgtctttactttttattaatttcattaacatacttaatatgtgatattaatttgcaaattttggaaataaaaatttttcatatattcttttgctttttttcactcaccatatttgcgatagtttatagtaaatataaactatttgtactaaatgttcgtgaattcttctttaaagtgttaaaacaatttactctcctccaagtagtctatgagtgtctcttgctctgtattttcagagtatgcattatgatttatgatttctgtcatttgctcttgctaaagtccatgatgatattgattctagcccatgagtaaccacccacaggtcaggaagcaaatgtgatcatccagagcaaagtgaaaacccagaagctatacatttggtccctgtgcgatagcaacaagaaagcaaagcaaaacaaaacaaaacaaaacaaaacagaaaaaaatctgttattacaaaaaacggaaccatgtaatttccttaactcagggaccttagcacttcgtagtctccattagcaggccacccccaagaaaatatttaattctaagccagaacattatgcttgtcatacaaagaccttctagaactatccctacccactttcaaatgatggcaatgcctatgccctaccacttagaatgatggggccacaaaggcattgatgttttactaggcaatattgaggaatttacaaaatagttgcataacaactcttctgtcaaagtaattacatgaattttatcagtgggagtggacagatgtttgagcacagtggccttagaccacaccatataatgaaaagttgtcttacacatctcagttagctgagagtattttccagaatgaccatctggcaaaataacccatcaaaacaaagtccccaggtgaatcagctgaaaaagaaagacgaatactttgactgcataaaaaatagactcaatagagaatatgtaaaataaatgttaataaaaaatgcttttgtggagagcatgttaactattcatttaaggggggtaacacattttctaatggtgctcaataagtaaaatgttaacttgggtatttatctaatttttattaacagtagattctgaactgtttgacatttaaatttttcagcactgtaagagagaagcatgctctttcatacttacttagatgtataaacatgaataaaattatctcagtaaaactactaatggtaaaaaaactggcttagtgaaacacttcaatcagttccagagacaacagaaaaatgtaatttcagctttcaagctcaagaaggatgcttttgttaatgaggctgggtatctatcctaaaataaaagtgacctggcatttaatgataactcagtgattaatatgcagtataataacatgtggtttactggattattataactctccttatacattgaaagccatatttcatttgtaaaagtgtataattgcaatcaactctttgaataaacttctctcttctatagtcctattttgaaagaaagttcaaaaatgtttggcccatctctgttcatagttccaataattatgaatctgtcctaataaagtgtttggaagatttaactgtttagtttaaataacatttaccattttttttaattacagttttaatataggtaatatgcagaaaacttggaaacgacatgaaagttcaaaggaaaaataatcctcaaatcactggaccttttctcacattatctcttggctccaacacaaaataattttaggatttcgtcccttggtaatcattttgtctggactctatttctcatattttttttctcagccatttcttggttattttgtgttgtgattgcttataatatgtttccttgttttatcctatccttataataagatcttaaggatgattttatatatatctctctccttattatgcattcatttaaaactgaaaaatatatattattaaagcccactatgtgtgaaacactgcatgggaatgatatgcatgggaatatataacagccaaaggtcatctcttcatggaacttactaactacggttaaggtgcaagtgcctaaattttgttgccaacccacaacatccttaatctcctttgctgtctgtacagtgcagcacaaggactgttgccttttggttgagcaatagatattggatgaacagttataagtaaggaacaaattaatattagacaagtagttatttgtttcttacttatattgccatattccttctggtagacactggacaggtaggatgctgcttactgaattgtgaaattttatactatgatgtaacatttataaaatgcttttgagttagcaaactgttttatcttacagggtttcagtgaagctcaagtagaacaatacttacttactattaaaaaaaaagaaaggtagcgggtggtgttatttaaatggagtccttacggtatcaaactactcattaacaggaaaaatatttagtaaccccagtcatctaaaacatggccatgtgataaaaaaagaaacatggcctttcatttccaaatatctattgcattttcttaatgcacagacaaaataatatggcttctagaaagtatgagaaaatatataaaatgcagcagaaaataagttaaaagatgagttatatccagtttctggttcaacgagctttcaacgttatacaaggaaagatcatgttacacacacacaaaaatgtgcatgcacacacccatgcaaaatgtatttagagcttctccttgcatttgtcacctggttaattccaatttgtctttcatatttaaaattaaacatcactttcttaaacaaaatttccctgaacctcttcaacaggtttttcttaaaagtttttcatatcatcccgaatttttcctgtatagcactcactgtatttataattacattgttgtacgaacatcatagagtatacctacacagacctagatggtatagcctactatgtacctaggccatatatgatagcttacttttcctagcctacaaacctgtacagcatgttactatactgaatactgtaggcaatttgtgtatataaacatagaaaaggtacaatataaatacagtttattataaaaggtaaaacataatatacctggataaggcacttagaatgagtggagcttgcataactggaagttgctgtgggtgagtcagcgactggctgatgagtgaacatgaaggcctatgacattattgcatggtactgtagacatcataaacactgtacacttaggctacactaaattattaaaaataaagtaattgtgctatgacattaggaaggctcatacgtcagtaggtgaaagggatttttgtgttccattataatcttctgggcccagtgtcatatatgtggtctatccttgaccaaaatgttgttatggaatgcatggctgtctttagtatctgtctccttactagagaataagcataaaaaaggttctgcacactagcaaagtgtccagcatggagtgtgagctcaagaaatagttactgcatgcaataactctaatatataaaagactatggcagggaaaggagagagaaaaacaaaatgtgatgggaatgtaacagaaggggaaagcgcaattaatgtgtgttcaaaaaacactgtgaaattttaagtggaccttagaggatgtgtgtagtgctgaatgtggagcttcatagccacacatagaggggtgatctagaaaggatggcttggaagaagcatgaatgttcatggtcaacatatccatgagacacagcagacacagtgcccaaagcctatgatatgcttgctgttaggggcccacaaaacattttaaattttaatttcttaatcagaaaaaaatgaatctaatcatatgaatatataataatgaatccaatatatgccaatgtaggcttaaaatgtagtttttaatactattttttgaagtccacaaaggtaaaattgcacagggcccctgaaagtcatactgcagccctcggaatgatatctgatattcagtagatagtattcggttagaacttagaaaagaataaatgatctaaggcttaaaatgtaggttagcctcaggtaaaggagagtacaaatgacaggctgtagagattcttcaaatttgggttgacttcggagtctttttgtgttaatgtcttgcttactgcagggcttcaggaagagaattcttgcaggaaggaataggactggttggtattagaagttgggtgatcagttaggagctttttgccatgtcttacatgggagctgaagaaattatagtagaaagaaagggaggagatggatattacaaaaaatcagataaacatgtacccaggaattgtagatcatatgtggaaaagcttccttttcccgacataaccccccaaatcataattatatatttgtgttccctgtaacagtgagttccatatgaggaaggactatattaatcttactgctgtgtcctcagaacactgaacacaagacactcaagaaaacaggagagttagactcttgtaaaagtgtataaaccattgtagctagaactaggtccctgaccaatccatcccaatcatcgaagcgaatgcccaaagcctcaatatgtgaaatataccttccaattgattgatggtttgattattctgtagagcaaaacagaagtaacaacatacacattagttataacctattttaaagttgattttaaatcattcttttttctaaattcagaaatctctgcttatggtctgtaattaaatctatatttataatccaaatttatagatttatatgcagcattaactcatatcatgtacagagaaagctacaattacgtaaaaccacataatacgcaatgagtacagttgtgttgtatacagatttgttagctttctcagtaagtttctcagccagtgtaatttgtacacttagcatgtaccaagccttgagtgaaaatacaggatgagtatgacctgtgatggcacatattaggtagaaggggagcacctagtctagcaggaaggttaaggcaaggccttaactaaggagaagtaatgtctgcctcaagtcttgaaagaacaaatgctagtcagataggaagcagaagcagaagagcacacacatttataaaattactagaattagacgtttaaaaatactttggtaacatttggagcaacagtttctttatccatggcaagagagtattatgttttttaccactgttcagctatttttcacattcgttaggaaagataaataaaaacagcataaagattatgaactccctcatgttgaagataaaatattcagtgtagtatatatatttttgataaatatttttattaataaataaataaattctttattaataaataaaattttgaaagaatatatatttaaaatatatattttgaaatacatacctttttttgcacaaagctcgctgtgtagcattgatgattaaataagctgcctatctgtgtttgagaatatcttttcttggagacagaggaagagactaactgaatcttccataaaattccaaactgtgattcactgattcggtaagttgggaaggatgaagaataataacagcgttaaatcactgaggatatatttaatagtatattaaaaaccaaataattttatagtgttgaaattataccatacaaactatgaaatattcattttcttctataccaatatatgaagactgaaaggtgtcaaaatataattgtgtaattggtcatttttagagacatccatagaattcataaacaatattcactgaaataaattcaggagagaattttcagaattaggcctcactggcagtttgaaagtgttgaattgttctcccacgttgtgtggcagttctggggctgtattcaaaacgttggtatctaggtaggaaatgagtcaaagtcgacgttactcttgaggttaaaggtctgtttctttcaatcagttcaaactgacaggcctcctgccatcacctcctccttagccaggcagacaggccctggccgtcagtgtgaaaacatctgttgaatggatttattgactggatcttgttttttctctccctttctctattttttttttctttttccttcacaccgtttattatgtctctgacctgatgaacttaatttgttgacatgtcgctcagtgtctccctcaatccttgtctcacatttctttctactgtgctcttttcttggcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggtaggaatccctaaagactctctctaataggcaggctaaatgccccgttcttgtaggattaaccgatttaaatgctctgaataactccaatagcagaacactccattttaacccagtgcaacccaaattttacgaggttatattggctataagacaaacagcacatctgataaatcttgggcttagtactaatagcctcataaattgctatcatccaagggcctggaaaatacatcaacaggtgcatgagttttttggaaatgaaaatccctgcaacattctttagcagtgttcctcaatctctactcttaccttctgcccagtcactaggaaattgatgatgcttggcttcctcatttgactccaaagagtaccctttaaccagtttgtttttttgtttgtttgttttatttcactgttttcttctggttccccatgcaaatgactcatgggattctatagtaccaaagcaaacttcacttgattctatgtatgttactttcatttctattcattatggaatctctgggtgggcttttcgaccaacctcttcctttgtctacagctgtgtttgatatttcagaacctgactacagaggaaaacaagccagataattccaaggccaaaggaaggttaagtgtggaacacacacacacacacacacacacacacacacacacacacacacaaagggtgctattccctctgcaaaggaacagtgctgtacatatatgcgtggataattatttctttttgtgtactctactccattctagttccgtgttctcaaactgtggctaatcaaatgaaatatattgtagccctaagagactcataacttggatactgcagaaaacgaatttatatgtaccttccccaaaggctcttttgagttctctgatttattttaaaatccattttcaggattcagagcttgtttttgtggcttctgtgacctcatgcaagccttcgtgcttggaaaagttaaatctattttctaaaaccatattcccaagccttgatattatctttagtttaaaaattaatgaatgaaatagccaagttaattacctttggtaggcatctttaataagtatgcatagaagtgactttttataatgttttatgccataagaaaacattccatactaggagctatgagctgggtctatttctttctccgtactagccattgcctctgactcttctacttccaggagcatagcaaaactgcccagatattccggaaaacccaggaacactgcccagtgttagtggcagccttttgaatcaatcatgcctggtgctatccctgtggattcaccgagtttttgctcaaaaccagatacatgatacagaggaataattttttgcatgtagaaagagcaatagcctttaagaattacttactctctattctttctcctgaaagtgtcttttattcaaccctaatatttcagaaaatacagagtaacaaccattctatcaaaataactgtttccattgactgaaataatttccttaatattataataatattaaaaattaaaaataatattaaaaataaattccttaagtaagcttaactacaaagtttcctgttgatgtgcccaagtttgctactgtatattactgtaatcctatggataaagtttctttccttggttaagaggggtggcccttttctgacatacttcagtgtcttctagttttcatatgttcctttgaatgaatgaagcaagacatctgaatattagagagaacctggagtttaaggaaactgtgttgccaaatggatagggtttgtagaccttagaagaatccagatgcaagggtagactgtaaacccagcaacataaacaggacataatcctaccctgatcattcaaacaaagactaggtcatttcagagagttaggtttttttccccctcataatgtcaacattttagtatttatcaaagcatgtattccaaaaacaaataggaaagtgaacttaagattctttttatatataatggatttgataaggcaattccttgtccacatgagatattatataaaattattttagaaaacacaggattttgtacttaataggcattcaataaacattttagttgaatcaatgaatattaatttcataataaacacgaatttactagttcaaatttgaatacactgaaagtaaaaattacattgtaactattgttccgctaaaggatagctaagttatttacaagttacaataactaagaggaatatttgttagctcatttgaacttacaagaatgttgcatctttacactgaaaatcttacaagaaaaacgcacaatattttaaaatcatgcaacatatgcaatttataataatagcttctccactggcattgggattaaaatatatatatacttgatatgtaacattcatttagtactattccaaatcctaaggaaatgaaatgcaccatcttcactctgctattccacatattgctctggctttaatccaatcttaaatttcccctgtagcctgaaaactactgtaatccacatgatctcaaaaatcactttagtatttctaatgatcttgatttcagatgagaactgtaaggttttcattctagtatgattgaaaatatatcttttaagcactaatctcctttcttttgactttttaatatctatttgttgcagacatgttaaacaatctaaaggaacattcacctatgttctttaggaatacagtagaccttcttatctgcatgggggctattctaagactcccagagaatgcctacaacagccagtagtattgaaccagttgaggtcaataggaacccatttctgttcatgtcttccacccataaatttatggtcttttccatcttaactaagcacttttcacatgctgtggccatagcttttgtagtgtgaggtgtggtgggacagaaaacaatcacaaatttcttttttcttcatcacaacttcagggatagaagattccttcttactgtagagcttagcaactttagcatatgatttttttttaaatttccttaagtcaagaacttaaacctttcattcaaaggaagccctttaaggcttgtctttggcacatccaaactgttagcatcactactcttgcactttggagccattatgaagtaaaaaataattaaaagcatgcactggtgacactgccacagtcaacctgtcatccagacagctactaaatgactaatgggcaggtgacatagagagcatggagctgctggagaaagggataattcacatcctgggcaagccggagtggggcactgtaagacttcaacatgctgctcagaatgatgcgcaatttaaaacttagaatttggttgttatataattgtgtatttctggaattttccagttaatattctcaaaccatagttgaaactgtagaaagagaaactgcagatgggggaggggagaggctatttgtatttgtattttttttttaaaataaactcatacgatctcacattctcaatagctgttccactaaatagcaaggtagcggacacagacacattataaagctaggcggctggcttaaatctatcctctaagagctatactttttggtgctactaagaagttatttaacacaaaagtcacataattttcaatgcacatcatttaaaccttcaccatccatgtgcatcctccacagcccactggattaggcacacaactccctttttgacaagaacaaaaaatgttccaagggagaaatattatctgagtttagtcagttttggaaagatgctgtcttcattctatttcctgagagcagaaagtaggcataaattgcataaaattatttttaaagataattttttttgagacggagttttgctcttgttgcctaggctggagtgcaatggaacgatcttggctcaccacaacctccgcctcccgggttcaagtgattctcctgcctcagcctccctagtagctgggattacagtcatgcaccaccacacccagctaatttttgtatttttagtagagacggggtttctccatgttggtcaggctggtcttgaactcccaacctcaggtgatccgcccatttcggcctcccaaagtgctgggattacaggcatgagccaccaggcccagccttaaaaaaatgatattcttaagactatactgtaagtttttcccccaaacaaaagacataattgaatttaaactttatcactaaatatttggtgaatatgaatacatgtatttttagtagagacgggatttctgtatgttggtcaggttggtctccaactcccaacctcaggtgatccacccgccttggcctcccaaagtgctgggattacaggtgtgagctactgagctgggcctgagataactgttatatattaattgaactttcgtggtaacatttatacttttgagaattataaaaattgatacaagttcattgaaggcaatttggtaaatctagaatattataatggaaagtcactcattattctcccactcagaggtaacctctattaaaatatgtttatacttatttttcaatcaatactttttactctataagcttctctttaatagaataaagaaaagtgatttgtatttgtatacatatctatgtgcatgtgtgtatgtgtctatctgaaagtatgtgtgtatatttgtatgtgtgtatatacagtgtatatatgtgtatatatgtgtatatacatatatacactgtatgtatgtgtatatatgtgtatataatgtatatacacacgtgtatatatgtgcatgtgtatatacacacacgtgtatatgtgtgcatatgtgtatatacacacacgtgtatatgtgtgcatatgtgtatatatacacacacacgtgtatatgtgtgcgtatgtgtacacacacacacgtgtatgtgtgcgtatgtgtacacacacacacgtgtatgtgtgcgtatgtgtacacacacgtgtatgtgtgcgtatgtgtacacacacgtgtgtttgtgtgcgtatgtgtacacacacgtgtgtatgtgtgcgtatgtgtacacacacgtgtgtatgtgtgcgtatgtgtacacacacacgtgtgcgtatgtgtacacacacacgtgtgcgtatgtgtatacacacgtgtgtatgtatgtgtatacacacgtgtatgtgtgtgtatgtgtatatacacatgtgtatgtgtgtgtatgtgtatatacacatgtgtatgtgtgtatatatgtatatatacagatatacatatatacatgtgtatatacgtatatacacatgtatacacatatatacatgtgtatatatacatatatatgtgtatacatgtatatatatacacatgtatacacatatatacacgtgtatacacatgtatatatgtgtctatacatatatacacgtgtatacatgtgtctatacgtatatacacatatatacatgtgtatatatgtatataatgtatatatacacaggtatatatgtgtatatatgtgtatatatgtgtatataatgtatatatacacatgtatatatgtgtatgtgtgtgtgtatgtatgcctgtgttaaggccttctagagtagcttctgttattactcatattagaatagagagactaattttttcttttgtcaggaaatctattttttaaattgctgtcctcaaatatatatgcttgaaatttctttcaaaaaactcttccaaaatttactcatctaataatcactgaagaagataaaaagagctatcttctttatttaggagattaattcaacttgatcacatatatcatgtatcacatatcataacataaacattaatgtagaaaatatatttataaatatagttatataatacatattatttatgtgtatctcatatgtatacatacatacacacacatatatatttttttgggggtatgctttttatacctaagaatttcatcctattaccttcacacatgttttgaagacagacttattgggacacaagttttttgtctgaaaagtctggaaatgtgatcaaatgttcaaggggtttagcactgaagagtagaagtctgaggccaacctgatatgcgtttctttgtgggaagcctggtttttcttttctggagataagacatattttgttatcttgttaatttaaaaaaatcatctttgtgataaacatttgcaattacttatcaatgcacaaatttttttctacttacggaaatatcctcaattagtcctatttcacgtataccttgttttattacattttactttaaaaatttaaggtttgtggcaatcctgaattgagtaagtctattggtgccacttttccaatagcatgtgttcacttcctgtctctgagtcacatttgggtatttctcacaatatatcaaaacttttcatcattattatatattatagtgatgtgtgatcagtgatctttttcattatactttaagttctagggtacatgagcacaacgtgcaggtttgatacataggtacacatgtgccatgttggtttgccgtacccatcaacttatcatttacattaggtatttctcctaatgctacccctcccccagccctccacctctagacaggccctggtgtgtgatgatccccgccctgagtccaagtgttctcactgttcaattcccacctgtgagtgagaacatgtggtggttggttttctgtccttgtgatagtttgctgagaatggtggtttccagcttccagcttcatccgtgtccctgcaaaggacatgaactcatccttttttatggctgcatagtattccatggtgtatatgcgccacattttcttaatccagtctatcgttgatggacatttgagtcgattccaggtctttcctgttgtgaatagtgctacaataaacatacatgtgcatgtgtctttatagtagcatgatttataatcctttgggtatatacccagtaatgggatcactaggtcaaatggtatttctagctctagatccttgaggaatcgccacactgtgttccacaatggttgaactagtttgcactcccaccaacagtgtaaaagcattcctacttctccacatcctctccagcatctgttgtttcctgactttttagtgattgctattctaactggtgtgaaatggtatctcattgtggttttgatttgcatttctctgatgaccagtgaagatgagtattttttcatgtatctgttggctgcctaaatgtcttcttttgagaagtgtctgttcatatccttcacccactttttgatgtggttgtttgattttttcttgtaaatttgtttgagttattcatagattctgcataatagccctttgtcagatgggtagattgcaaaatttttctccattctgtaggttgcctgttcactctgatggtagttcctttgccaggcagaagctttttagcttaattagatcccattcgtctattttggcttttgttggcattgcttttggtgtttttgttatgaagtccttgcccatgcctatggcctgaatggtattgcctaggttttcttctagggtttttatggttttaggtctaacatttaagtctttaatccatcctgagttaatttttgtataaggtgtaaggaagggatccagttcagctttctacatatgtctagccagttttccctgcaccatttattaaatagggactcccttccccatttcttgtttttgtcaggtttgtcaaagatcagatgtttgtagatgtgtggtgttatttctgaggcctctgttctgttctattggtctacataactgttttggtaccagtaccatgctgtttttgttactgttgccttatagtatactttgaagtcaggtagcatcatgcctccaggtttgttctttttgcttaggattgtcttggctatgcaggctcttttctggttccatacaaaatttaaagtagtttttccaattctgtgaagaaagtcaatagtagcttgatggggatagcattgaatctataaattactttgggcagtatggccattttcacgatattggttcttcctaaccatgagcatagaaaggttttccatttgtttgcatcctctcctatttacttgagcagtggtttgtagctctccttgaagaggtgtttcacatcccttgtaagttgtatttctaggtattttattctctttgtagtaattgtgaatgggagttcactcacgatttgactctctgtttgtctgttattggtatacaggaatgcttgtgatttttgcacattgattttctatcctgagactttgctgaagttgcttatcagcttaaggagattttgggctgagacgatagggttttctaaatatacaatcatgtcatctgcaaacagggacaatttcacttcctctttttctaattgaataccctttatttctatctcttgcctgattgccctggccagaagttccaacactatgttaaataggaatggtgagagagggcatccttgtcttgtgctggttttcaaagggaatgcttccagtttttgcccattcagtatgatactggctgtgggtttgtcataaatagctcttattattttgagatacattccataaatacctgatttattgagagtttttagcatgaagggctgttgaattttgtctaaggccttttctgcatctattgagataatgatgtggttttgttgttggttccatttatgtgatggattacgtttattgatttgtgtatgttgaaccagccttgcatcccagcgatgaagctgacttgatcgtggtggataaactttttgatatgctgctggattcggtttgccaggattttattgaggatattcacattgatgttcatcagggatattggtctaaaattctctttttttgttgtgtctctgccaggctttggtatcaggatgaagctggcctcataaaatcagttacggagaattccctctttttctatttattggaatagtttcagaaggaatggtatcagctcctctttgtaactctggtagaattcgggtgtgaatccatctggtattggactttttttggttggtaggctattaattattgcctcaatttcggagcctgttattggtctgttcatagattcaacttcttccggctttagtcttgagaaggtttatgtgtccaggaatttatccatttcttctagattttctagtttatttgcatagaggtgttcatagtattctctgatggtagtttgtatttctgtgggattggtggtgatatcccctttttcattttttattgcgtctatttgattcttctctcttttcttctttattggtcttgctagcagtctatcaattttgttgatcttttcaaaaaaccagctcctggatcattgattttttgaagggctttttgtgtctctatctccttcagttctgctctggtcttagttatttcttgctttccgctagcttttgaatttgtttgctcttccttctctagttcgtttaactgtgatattagggtcttgattttagatctttcctgctttctcttgtgggcatttagtgctatacatttccctctacacactgctttaaatgtgtcccagagattctggtaagtggtgtctttgttctcactggtttcaaagaacatctttatttctgcctttttttcgttatttacccagtagtcattcaggagcaggttgttcagtttccatgtagttgtccagttttgattagaatatagttttcattagaattaattagaacttaatcctgagttctaatttgattgcactgttgtctgacaaacagtttattgtgatttctgttcttttacatttgctgaggagtgctttattccctatgatgtggtcaattttagaataagtgcgatgtggtgctgagaagaatgtatattctgttgatttggggtggagagttctgtagatgtctattaggtccgcttggtgcagagctgagttcaagtcctggatatccttcttaaccttctatctcattcatctgtctaatattggcagtggggtgttaaagtctcccattattattgtgtgggagtctaagtctctttgtatgtctctaaggacttgctgtatgaatctgggtgctcctgcattgggtgcatatatctttaggatagttagctcttcttgttgaattgatccctttaccattatgtaatggtgttctttgtctcttttgatctttgttggtttaaagtctgttttatcagagactaggattgcaacccctgcttttttttgctttccatttgcttggtagatcttcctccatccctttattttgagcctatgtgtgtctctgcaggtgagatgggtctcctgaatacagcacactgatggatcttgactcattgtccaatttgccagtctgtgtcttttaattggggcagttagcccatttaaatttaaggttaatattgttatgtgtgaatttgatcctgtcattatgatgttagctggttattttgcccattaattgatgcagtttcttcatagcatcaatggtctttacaatttggcatgtttttgcagtggctggtaccagttgtttctttccatgtttagtgcttccttcaggagctcttgtaaggcaggcctggtattgacaacattactcagcatttgcttatgtataatggattttatttctccttcacttataaagcttagtttggctggatatgaaattctgggttgaaaattcttttctttgagaatgttgaatattggcctccactctcttctggcttgtagggtttctgcagagagatccgctgttagtctgatgggcttccctttgtgggtaacccgacctttgtgtctggctgcccttaacactttttccttcatttcaaccttggtgtatttgatgattatgtgtcttggggttgcacttcttgaggaatatctttgtggtgttctctgtacttcctgaatttgaatgttggcctgccttgtgaggttggggatgttctcctggatagtatcctgaagagtgttttccaagttgtttcccttctcctcatcactttcaggtacaccaatcaaatgtagatttggtcttttcacatagtcccatatttcttgcaggctttgttcatttctttttactcttttttctctaaccttgtcttctcacttcatttcattaatttgatcttcaatcactgattccctttcttccacttgatcaaatcagctattgaagcttgtgcatgtgtcatgaaattcttgtgccatggttttcagctccatcaggccatttcaggtcttctctacactgtttattctagttagccattcatctaatcttttttcaaggtttttagcttccttgagatgggttcgaacaagctcctttagctcagagatgtttgttattaccaaccttctgaagcctacttttgtcaacttgacaaatcattctccatccagccttgttccattgctggcaaggggctgaaatgctttgcaggagaagaggcactcaggcttttagaattttcagcttttctgctctggtttctccccatctttgtggttttatctacctttggtctttgatgttggtgacctacagatggggttttggtgtagatgtcctttttgttgatgttgatgctattcctttctgtttgttagttttccttctaaccatcaggtccctcagctacaggtctgttggagtttgttggaggtccactccagaccctgtttgcctgggtatcaccagtgaaggctgcagaacagcaaatattgcagcctgatccttcctcttgaagcttcttcccagagaggcagctgcctatatgaggtgtctgtcggtccctactgggagatgtctcccagtttggctacatgggtgtcagggacccactcgaggaggcagtctgtccattctcagagctcaaatgccgtgctgggagaaccacttctctcttcagatctgtcagacagggacgtttaagtctgtagaagttgtctgcttccttttgttcagctatgccctgcccacagaggtggagtctgtagaggcagtaggccttgctgagctgcagtgggctctgcccagtttgagcttcccagctgctttgttttagctactcaagcctcagcaatggcagacaccccttccccagccaggctgctccctcacagttccatctcagactgctctgctagcactgagcaaggctctatgagcgtgggacctgccaagccaggcacggaagagaatctcctcgtctgccgattgctaagaccttgggaaaagtgcagtatttgggcagaagtgtcccgtttttcaggtacagtctgtcatggcttcccttggctaggaaagggaaatcccccaaccccttgtgcttcctgggtgaggtgatgccctgccctgcttcagctcgccctccgtgggctgcacccactctccaaccagtcttattgagatgaaccaggtacctcagttggaaatgcagaaatcccccatcttctgtgtcaatcacagaagacctgcagaccagagctgttcccatttggccattttggaatggacccaatcagtgatctttttatagtactcttgtaattgttttggggaaccatgaaccacacccaatcaagacagtgaacttggtagataaatattgtgtgtgttctgactgctccactaagcgggcatggccccatcttcctttctctttttggccctctctattcccagagacactgggaatttagaccaatttataaacccacagtccaattaggccaatttataaacccacagtccctttgtgttcaagtgaaaggaagagtcacatgtctcccaatttcaatcaaaagctagaaatgattaagcttagtgaggaagtcatgtcaaaagctgagataggcaaaagctgggcctcttgtgctggttacccaaggtgtgaatagaaaagaaaagctcttgaaggaaattaaaagtgttactgtagtgaacagacaaatgataagaaagcaaaacagccttattgctcatatggagagagttttagtggtcttggtagatcaaaccagccacagtatttccttcagccaaaacctcatccagagcaagtccctaactcttcaattctatgagggctgagagaggtgaggaagttgctgaagaaaagttgaaagccagcagaggttggctcttgaggtttaaggaaagaagccgtctctgtaacatgaaagtggaaggtaaagcagcaagtgttgatgtagaagctacaacacgttttccagaaagtctagctaagaccgttggtgaagatggctacactaaacaacaaatttcgttgtagatgaaagagcctttcactggaagaagagatagagagaaaactttaagagatagagagaaatagtcaatgactggcttcaaagaataagctgactctcttgttagaggctaatgcagctagtggctttaagttgaagccagtgctcatttcccttcctcaaaatactgtgcccttcagaattatgctaagtctactctacctgtgctctataaatggaaccacaaagcctgggtgacagcatatccgtttagagtgtggtttattgaggattttaagctcaatttttagacttactgctcaggggggaaaaaaagttccctttcaaaatatgactgcctaattgactgtgtacctggtcacccaagaactctgatggacatgtgcaatgagattaagttttcatacctgctaacacagcatccattctgcagcccatagatcaaggagtcttttaaatttttacatcttattatttaagaaatacattctataaggctataccttccatagacagtgattcccttgatgggtctgagcaatgtacattgaaaccttctggaaaggattcaccattctagatgccattaagaacattcatgattcatgggaggaatatcaacattgacaagtgattgaaagaagttgattccagttctcatggatgacttcgagggggtcaatacttcaatggaggaactaactgcagaagtagcaagggaactagaattagaaatggaacctcaatatatcactgaattgctccaatctcattataaaacttgaattaataaggagttatttcttaggggttgagcaagaaaaatgttttcttgggatggagtgtactcctggtgaagatgcagtgggcattgttgaaatgacgagaaaggatttagaatattacataaacttagttgataaagcagcagcagagtttgacaggattacctccagttttgaaagaaggtctactatcggttaaatgctataatactaagcagcattccatgctacagagaaatgttttgtgaaaggaagatttcatggatgttgcaaacttcattgttatcttgtttgaagaaattgccacagccactccagccttcagtaactactaccctgatcagttagcagccatcaatatcaaggcaagaccctccacaagcaaaaagattatgactcactgaaagctcagatgattattagcactttagcaataaattaatttttaattaaggtatgtacattggtttctttgacacaatgattccacacttcataggttacagtataatgtaaacataacttttacaagcataagcaaaccaaaaaactcatgtgacttgctttattgtgatatttgctttattcggatgatttggaatctaaccagcaatatgtcccaggtattcctgtatttggttagtcagatttcctcctcaggagcaattacaactttttatttggttattttttttttctgaccactgtattttcatcttattatgtacatctagtagtcctttcctttatattctggaggcttctcaagtttgtattcaatagcgctgatctggctttctgaaatgtaaattcctttctttattgcctccagtatagattttaattttgctactctttaatttccttgcaatccctgtttatcatatccagttttatttttattcattccattgtctttttaatttagttctatctctgcctttagctttggtctctgatgttataggaccagtgtcttttgacttttgaagagaacaaaacattttctaaaatcttattttgcttcctatagtaaatcatgttcactgaacgaagcagtatgaatgatattttcttcataatatccgtagtatattctcaacggccctgtttttttttctcactcattcttgaatgtagaaaagctttccagatattttgccagcaaatgtgtagtgaattgtgtttggcttcactttttgccaacttacatgctggttgaatctccttcctggctttacagttaaatggcaacacttaatctaattcctaggccttaacagacactcatatagtgttagttggaaggcttatgttgggaatttcttctacccacttcctttctagctgtctgatactctgttaagatgacttacatgaaaaaaagacaaacagacaaacacaaagctgtaaggtttagaaaatgcttcttatctagtgagagatacaatttatcaatttttttaaacagaatttttaggcattatatcatttgcttgctggatacatcaagtttcacaaataatttaaaaattacactgtttggtactttgagttctgtgttcttgttaaaaaatgctgcagatagttatcacaccactacactccagcctgggcaacagagtgagactgcgtctcaaaaaaaaaaaaaaattgcagatagtaaaatataaactgcacttcagcctaggtgacagagtgagaacctgtctctaaaaacataaaataaaaaaattaaaattaaaattaaacaattaaaaaataaattaaaaaaataagacaccgtaagtcttatggatagattagcattatggatagaaatagtaacagccactatgcatgagatttgacggtcattagacatgaaccttgtttcagaatagctttttttatcttttttagtaattctaccatttgaagatcattccgtctttaaaaaaatttttgtgtttttaggagatctttgattctctagcctcacaaattttttctttagcagagttttcaaaagtgtcatatttttacatctcacttttactactagtttttttttttttttttttttgagatggagtttcgctcttgttacccaggctggagtgcaacagcactcccaggttcaagcgatcctcctgcctcagcctcctgagtagctgggattgcaggcatataccaccacacctggctaattttttgtatttttagtagagacggggtttctccatgttggtcaggctggtcttgaactcctgacctctagtgatctgcccgccttggcctcccaaagtgctgggattagaggcgtgagccaccgcgcccggcctttactactagattttaagttaaatgtggtaaaatgaagctgctagaatctggaacatagtgagcattcaataactgtctactgattctgcatcttccaggagaatgccatgtcatatatatttgtgctgtgctagtcctttgtccagtcccttgccctagaaggagtttaataagtgttgtttagcaaacaccttgggaggtgtgaaacctcaggtagttcccagaaatgcaatatgaagttgaatgttaggaactacaaatcaggatcaataattttagtccaaatgttctaaactcagctttctttatagacaagataaattgtctataaagactctatagactcagactaataggtcttactagactgagtgtaaatttgaagacagaaatagattatatggctaaaaaatgacaactacatgcaataaagaaggaaagatactacactagatgctacaaatacattatctcatttaataagactgagagaaagagaaagcacaaagtccaagtttatctaaaaaatttatcaagaaattttaaggatttcttgtatgtaaaaaaatatatatataatacgtattttctacatatatacgtatatatgtggaaaacaaacaactgttgtttaaaatgcaggtaaatattttaaggctcctttgtgtatttttcaaattctaattttaactcttgtcccactgatcaggagaaaaattaattaatctattggcttatgttatattgcaaatggtaatcagtgagccagaaagggtcaaacaaaagtagaattccatatgaattgcaaagaaaagagcaggcttatttctcaccctataagtccatgtttctgagaagccaaagagagagaatgaaagagagagggaaggaatgaagatgaaggatgaggttaaagtttcattttccagtctacctgttaacacctcagtgatacatcattaggatgagtcagtggaagtttggggttccagattgtatatatttccctttaaattcaaatggccttccaagagcccctggactttgaattataatctctaggtacctggcaaaaattcccagctaccattacctgtttcacaattatttttcttggcagtggattatggggaaaatgtcattaaaagggggaaacattactacagaggtaagcttagatatgtcaagagatgaaatagtgaaaaagttaagcaatgtaatgattagactctctactcttttttttttttttttttttttttttgagacggagtctcggtctgtcgcccaggccggactgcggactgcagtggcgcaatctcagctcactgcaagctccgcctcccgggttcacaccattctcctgcctcagcctcccgagtagctgggactacaggcgcccgccaccacgcctggctaattttttgtatttttagtagagacggggtttcaccttgttagccaggttggtctcgatctgctgacctcatgatccatccgcctcggcctcccaaagtgctgggattacaggcgtgagccaccgtgcccggcccgactctctactcttgaagaatatatttcttcttcttctttttttttttttttttttttttgcccatgcaagttctcaccctgtggcccaggctggagtgcagtggctcaatcactgctcactgctgcattggcgtcctgggctcaagcaattctcccaccagcagcaggcacaccaccattcctggctagtttttaaaaatttttgtggagacagggtctccctatgttgttcaggctggtttcaaattcctgggctcaagcaatcctcctgcctcagcctcccaaagtgctaggcttacaggtgtaaggcaccgtacctggccaaaaatatattttcaaaatgaggtggatgttatactttttgtttccatgttattaaactatcactttttattttatgaaactatagttgaaaaaaatgttaaacagttcttcttatatagtagtaactcataaatacttgatatatttaaattgtgaagacacgtcttacacatctctgtattttaaatgttattcttccttcctgcttgcctgcttccttttctgccttccttaatgtcttccttctgactttatttaaaaatatttatccttattggactttatagaaaatgtaaaaagaggactttgtgaaattccatgtagaaatataaagctaagtaaaataaatgcctatattagaagcacttagggtaggaagataagggacataaaataaaaggtagaagattaaacaagtaagactacccttcaggaatccaaggagatccaccaattaattcattgaggaaagctttagtggaaatatctgacctatttttgggatacattcattcatttacagttttcattcactcattaaaacatattttttgaggaccggctttatttaagcttgtttatggccactgaaatttcaaaggtaaaaacacgactatcatctgcactctcaaagatctcaccatctaatgaagaaaatatacaattaacaaaattatacaacaattatataattgtgacaaatgcttgaaggagatccagaggatgctaagagagtatatagtaggagacctaatttagagatctcagggtatgcttggtagaggaggtgacattaaaaactgagccttgaagagtgaaaaaagattagccaaatgaggactggagttatggaggtcaagaaggaagaatttccggcatagagggaatagcatgtataaatgtcacaaggctgctaggattttgatctttttgaggaaaggaaggaaggcttttgtaggcgaaatagagaacaaaagagggagatatatgaattgaagctggaaagatggggaggggcctatgtatgctggcctggaggaatttcagtctctttagtgaaggccctgaaggatttaaacagaagaggcgactgttgtgtggcaaatggaatagagtgaaagtcaggttctgcattacaaggcaatctcagaagtccagattagagataataacaccttggattgtgtatggttttggcagtggagataaggagaatgaataattcaagatctgttttggagggaaaacagacactgctttggttctttggagggggagcgtcaaggggacattaaggtttctcgtatgaacaatggcagatcttgatgtcttttgtaaacatgggtaatatcgtgtgtggtttaagatcatgaattaaaaatcagagacattttcactttatgaaaaccatgagacaactaagtggagattttggatggatcattcaatggggaagtgtgtaagtaagctgctcataagggaggtcagtcctgaggatgaaaatgtgagaatcaggggaagaaggatagagtttgaagccatttgagtcctaagaatagatattatttggaatggtaaaattatattcttttgttagacataatttctaccacatggtttcaaaatgcaggtgccattcttctgcattatttgagcacactcaaggaaaaatattttcttctcttgagtaacatttctttaacacaataatgtaagccaaaaggagaataaaatgtactttattaaacttcttttacagcataaattactggtgcttatctattcctgaagattttttttggttgttgttgtaaaacttcttataatgggtgttctccccatctacaaatatacttcgatggtcatttattggaagacatttgatttgttaaataatttcttatgtcaggcaattttgcaagtaacatgtttccacctcaaggaataggtttatgggtagaaatcttctttaaatgagccagagttataattatcatctaacttgttgctttaaaaagtcctattttaagttctgctaataattcatcttatcatgttattatacagtctttcccatcataaggcttacttgaaaatgaaatatgctaatacttgataatttaaaagaagattgtattcattagtatctgtataatctctagtagtggcattgtaatttacatttattttttaaaagaaacactttaaatgccccacgatattataagatctacaacatccatattggttacataatgacataaattatggggagaaacacaaataaacaaagaaactgtttttgaacaaccttgaagaaattactaaacaggataggcagagtgggaaaatcttccgttttattacaaaaatgaaaccttgatctgaagtcaggctagaatgactcatggaagatttaaagagacagcttgtttagtggctccaatggtgtggtgaaattaaaacctctactgaattaaattatctgcctaaaaacaattcataatgatttaaaatactggtaagattacaatatgtatattttaaaatctgaagtgtcttaaaatgtcatcatcttcatcactttacagatttactaaactagggtctgagtactggttaatgcgtaagttcgtgtttttgagtaaatatccagatagacaggtctcaatagttcttatgtgctcctgagaatttgctttgtgatatttcctcctttgttaaatttattttaagaataatgacttttttggagttatcatattatctcctaacatgtgtcattatcttgtactgttactcaatcttgtcctgtatttcccttgtcttaaaggaattgcctatgaccccttgatgctgaaacaccagtgcgtttgtggcaattccaccacccaccctgagcatgctggacgaatacagagtatctggtcacgactgcaagaaactgggctgctaaataaatgtgaggtaatccagaattggacacactcttttacttacttaaataaatcatgtaaagaggccagtattcatttggggagtaatagaaaaatattaaccatatagtgcaaacaccatgattgatgaaccatcatagattcaggtagcacagagcttaccacctgactctgggcggggcacactgtaagtacttggtcagtgttgatgagctgagcagctgcctgatgtgtgtgttccaatgctgcagtattattacatatacatggtagcactgtttgtaaacagacattatttattgagttgatcttctgagaaactctttgctaagtaattattatttttggttataaactaaactttggatttagatatatgccaattttgccacatggaaatgaatcaatttaaaatatcaactgtcctcttaccactaaaagtcatttctttttattgaaatgattgatgtgtttataacttgatgaagggatttgaatactttgattttatcattatttctttaaactcatttcagtaggcgcttggtgaataccatttttatttggaaaaatatacctttttatgctttcaaaggttaaaaacaacagtcatatcaattcagaaaggctcccatcatcaaatgtgcaaaatatgtaacaaccagctgctattcgatttagttgctataaatgtccattgttgtctgaaatccagtaacattctgcatttgaatctaaggcatttttaaaagaaaaatgcccttcatgggttttctcacattattttaacatttactaattatttcttttactgggtctctgttaggttctaaacatgattcaagtactggaattataaaatttcacaagacaaatatggtcccaaaatgtagtcaacaaaattcctattcaaattcaacttaggtttaaactgagtctgtaaaatattttacttgaaatagaaatgccaaagcagacagaatttttcagcaggtcaagtgcacttgcctacgtatgatagtgtgagttacatcaatctgatccccttcctctgcaaactactaaaaataattgacttttgaagatgcaaagccattcattcagtttgttcatttctatggataaaaaaattttctttatggatttgtttctttaaagggtggataatatattctatgttacaagggaaattaattggtttttaaaaacatcaaaacattggtagtgtcttatggatcgctcagtagttgagattgtgaatgaatataccacaacaccatgtacagatttagtctcacaagttttattatatatttatggtagaattatcaaacagttttcatatttaaagctctgcttttgattaaatgtatcctttacctagaaaccccaaagtgaaggaaaatgaactagatttatttatctggtcctttcctcagtgcaagtctattactcatttttttttgccagtggcattcatattgtatggcagaaggctttcatactctggtcaattttagagttatctttaaggatttcatgtttctgatactgcagtttggaggccaaaccattctcttttctatgcaatcccatatggagtccataaagtagaccagcaaggagaattatttgtggtaggctggtcttaatggacaaaatgcatttattcatgtgaacattcctgtctcaccttttcatctgctctgcaatttttgtgtgcttttgccagctgaggcattgctgcttacattttttcacattcacgtttgtgttatatcctgcggcagctggcctggtcctaactacttcaaattgtcagtggctgatcatagccttcgaatgccttgttagatagtggtattcctaaatcctattacctgaaggagaactgtttatgaaaggaacagagtacagaaataaatggaatttgatatgattcacactggtctaaaaattagaaagtctattatcatccttttctggttagtcttctttttcaattgcttatatacattacattattttcattctttattatttgaaaccatacaattcagtttgtatagcactaaccgacgtaatatcaaacacaagttgagatgtcagaaacactatcatacaactatgggtttgaggagaatagagtctccttggtatcacttaatcacaaaattaacaaataatacactcacaagcccaggtcagcagatttgctcttaattaagattaagcacaaacatcatatccaaaacatggcaacaatgcaaatagaagccacttttcctaacatagtttgatggcagttcaccaggtgtttgctttcttaagtgaagattatgttgccgatattatttatcattatatatgataatgctcctacattatcaaaacacccatattagcgaagaaagtattgcccatataaatttatttactttatgaaattatgagatgctaacctaaaccaaacatgaaatggaacttctaaaactgctaaaaattaattcacttttaagatacctaggactttaatggcagatggacatctgcccatgtgtgaatgatattagaaaaattcaaaattaaattttagaaagtattaactaaacaaatgttacccttgtgtagagaccttttgttcaatatgagataaaacagaactaaaagggaaacactattttcataacttattttctcttcctgattggttttaccagaagagtaagggagtaaataaaaagggaacacacagagattattccaaaccaggttagccccctcagaaatagtagaatactacctagtgctctcccaagtccattttttttttactaaacacaatggaagcaactgatatatgttccttgtagatttcttctaatatttttgatttgacaaattaagtatatatgcaaatattttactatgttattaagccatcttacaaagatgctaaactttctatttcatgccaaattattttcgaatgccgtgaaaaatacaacacaaatttatcaacaaatactttagcaatttgccacatgtcttaagaatcagagttgttgaagaatcaggagaaaagcacaccatggaggcaagtgatctgtgtgcctggtgggtatttaggctagttgaaagcgcaagaagggtcctacccaaaagcctactggttagtgtttctgagccttctaaaggaatcaaagataatgacagtatctgcccactgaagttcacttattcactcgacagaggaagttgggtcccagctcaggtgtgagtaacttatttaccaagataccccaaggacccaaataaagagaatcaaggctcaagggcattacttctaaataggctagaaggggctatcagaagttaaacttttgttcctttgcctagttgtgtctaaaacacgctaacatgaggaggtataatctctgctaactgggactccaaggatttgagtaccaggcgggatgtcttaggttatcattctctcctaagcagtatgaacaatttcctctctttgttgtgggaaataagaactcagttgtttcaaaagagaggatttattagattccacaggaaagggtataatcaaataggaatataatgcatacaagccaggtcagtgcattgtttttcagtatccacatagtcgtctgccgtctttgggaactattctcccaccacgtctgtgtagccacttctggtaagaagggtatcttgaatgttgacatatttcagaatcatctgaggggatggtaaaacacagattgctcagatctaaactcagaacttctaattcagtaagtctggagtggggtcagagaatctcgttgctaacatgtgtctgggtgattctggtacttttggcctggacaccacacgttgaaaacagtgatgtatccattcgatgatgtttatcaagaatttgagttttccaggcatctttgttaggagtagaagatacaataccgagtacaaaatatacatcccctgtcttcaagaaggttactatatggtgtgatcagcaggcattaattagacaatcatacaaataaatacacaattacaaatttcaaaggggttttgagtcattcattttatattgctgtgattttgaagactcttattgattgtgcttgagcaagaaaaaaatgaggaagattgtggtcagctgcctctatagtcttgacagcatcagtggggccctgtgaccaagagacagaggaggtaatgttacatgtgagagtgtgaaaaggaaaatatcctagatcttgtgatgaataacttgccctctttgtgttttcatttgtgttctttgtttattggggttactatttgaccaggacaaaaaataaggaatctcaattctgctgacatacagagaagggtcagctttcctcaaccaacagagcagtcaattttacaattaatgaaataaaaaaatacataatagaagagatagcactttgaaaatgctaaaaggattccttcatttccaaacagtagactgatccacaactcaaacttttggtttatgtcaattcatttagcaatgtcgcaaattaatcaaaatgtattctctcaaagatgatcattcaatattagattcgaccttagttttgccattaattatctgtgtgcttttgtcagaccatttaactttgctgatctttggttttcctatgtttagatgagggtgttaggcaagatatttgctaggatctcttacagctgtaatactgtctgacactagaagtgttaagcagttcttttggaacataacactctctttggttaagagtagactaaatttttagaatgtttcagtaaacatattgctcttagtttgtaagctatagtgtaaattggctctgcttactaatcctgattagtagccagagaaaacattagtcctcattatattagattacagtggttacatgggttaacttttttttggcctgacgtggcactgtttttaataagttgaggcagttagtagtccttcatgccaataccacttaattttttcccctactgaatcattcatacttagtttagtgattctgttgggagcaaagagcaaaaccagcagctttcttatcaccatgagaaatggatctggaggggttatttggtgtcctcttcagaaacaagctatttgattaagtagctgggtttccaagatgtgcatgctcctgaagaaaagaaatgtgctcttctgtggtcaaaaaaaattgtggaggttgacccatcatctgttagaaatgcacttgcagttgttttttccagaaatgctcatgactcccagccccaccaagccacccacagacatttgcttgctctcacatttgttttgagaataataacattttataatgcttttgttggattacacattatgtggaatttgcgttgcctttttgtgactaatattgaataactttgcttcgcttaattcataagtaagaaccataagcaacatacagtgctgaaatgtttaactcgtttattcaagtgccaacacaaagtaattacaaaacaattctgggacgcaaaaccaagctactgttgtcccttcagggtcttctcggcagttccaatgagaaaagtggagagcaagtttagtgcagaatcttatgatgccaagaagcagggattccagcatatcttcttgcacacataggtgactgtaaaatacctctttgttttaaatcaaatctaagtaaggaaatacattcatctgtggtgaaacactttggaatgtgcaggttttctgatatcaagactgcaaagcgctgaaaactgcaagttaatggaaattcaattagacatttgttttatagagtagtctaactagatggcagcacgtaacagtgtactgttttgcttagtttgcaaaaaaaaattttatgtgtttgtgccttagaatctaaccacaaaacagagagaaactcaaacagggaaccctgtgaattgtctctaaaggatatggcagtcttggaaagaagtacaagtgatctagatttgatgagtaaaccaggctacattgtcattgttctaaaagatatttgtatatcacagagtggacccaggcagataaatataccaaaactaattgtacaccttatagtcaaatgatttaggatttcttttaacaatgtctgctaaacagaaagaattaatgtggaaaacaaccaacaaaaggaaataagagaggctgttcttctgagtccatttggaaagtaatacagagcttttgaaacagcagcgttgaagcttattaataaaaagagttatataattttcacccatttgaaaattgcagtttttgagtaacaaaaaatatttgttgaaagtttgtttcatacatgatgaccagtttaaaaaagcaaagctttaaattcaaccattaaaatatttatttacaatttttagaaagaataattgcaatgtagggggttcagttgcataaaggattgtgaaaattgagcagttagactaagggataacatttttttcttgctttctggtgaggacagtgatttgaaataggtggaagtaaaacttaaaaaaatagagagtatatatgctcgtcaccatttcagagctttattattgaactgggatttgctgttttctgaagtgctttagaaatggctctatgtcctaaaatactttaaaataagtcgtagtgactgaatcaagcagtattaagacacatgaaaggcacttaacattttgaagattgataatatttttactcatcaatcttccgtccaccaatattttaaccattccgtagtcccaagtgttggtcagtacagtgtcagtatcttgcactcagttatgagcagtaagtatggacagctccctctaacacgtggttcttgacctaagctacccattagaatcctctgggtggttggaaacatctgggtgcccaaattgcacccagacaaaggtaataaggtaggacccaggcatcagtaacttttaaacttccccagctgattccaaggtgcagccaatgttaagaactactgaaacagaaacacaacttcttaacataatcttaacgagatagagacaaataggcaagtgaatcaaatatttggagatgggaaagtaacagaagtaagcattaacctgagaaacaaagatgacactaactcacaagtgtcgtacataattttcaaaaattattaaaagcgtttattattttgaagttgtcacaggataggaatatgagctgtgaaaaattctcttatttttcaattatgattaagcttataagaaacaagcatcatggaatagctggactccttttgaaaatccttattcaggtttcctgtttggcctcaacctcagtaatttatcattgcaattattttatttgcttgcctaaggcaaatgcataaatcaaagcgaagcgtgttttattgcatttctattgcgtgtaaggttatttcacatagaatcctatcatcttaaggctaaaaatgagctttgacataatttagtcaaacatctttatgttcatagatgaagaaacaaaggcccatagagatatctcatggctgactataggcacattaaggacacgtgggagtcaggaccagaagtcaaggctcccaacttgcaattctctttttttccatgtgacccacagaaaggaccaaaagcctgttaggccacctgcctgcttgattgcctccttccttctttcactccccaacctttttttttttttatgagaaaaactctgagaagtacaggttattacacgaggagggttgtgtggaagattgtgcagttgcaggggcagttaaaaaccatttcttacgtaacattttaagaagcagttggttggagcattttaaaactccagtagttgtgcttaggcataagcaatgagatcatatttttatgtttttttttaagaaagacagatagataaaaaaatcaataagaccatgaattgactcattaaatattaagtatggtatttgtggcagagtgtaactttgacactaagaagtcatttatgattctttattttcttcatttttttaacctttgaatttcttcagccctggatttttggagaaaataaatgaaaccacatccctttatttagagacaatggatgaaatattttcagaaaatgggatatttcagtggaaattcttgcctggtatgtcaccactttgaaaatgattaaagaaaatggagttttccccagtggaggcaggtactctgacttgtcaaatttaagttggacattttctcttagtttggaactgccacaaaatgagccctttcatgtccacaataataccaaaccaatgcaacccatctgttctgctaaattatttctagttccctaaccaaaggcactgctttttcatgcattttatcatgattttttgccctttattatattttacaaaaggttctgattcctccagggccaatgagaactgattaggacactggcctcaatccaggctttgaacacaggagggaaaggaatagaactgtttccttttttccctgctccttggcagaaaaaaatatgaatctatatcgtgtgtgtgctctgtgtgtgggtgggtgtgggtaggctgcattttatcctgtcacagtatgactttgtagatcatgttcagaacatttcttctataatcgggatgcattaacgggctctctttcagaaagactatttctttaagaaagaaccatggtgtgttgtgagactcaatgatatggtcattttaaataactttagtcaaactcccaacctgaatatagactgtttagggttctgaactaaacatgatcatattcctaaccacagagtaagtgctcagtgagcatagctccttttcagactctcagggaagaaactaagtgcacgtcacagggaacgataaggtaacaatgaacacagtcctacatcacaaatttctttattaagaaggtgacaaaagctatgaggtttcattcctaggcctgtgttggtaaggcatttaagacccgtattgactccaggtgagaaatccccagatgaaatccattccttatttgcattgtgtgccccaatatgctcagaattcttaaaaatctttttgggcaggctatcatagataactttacgtagatatccttcggaccaagtatctctgagaatagaaatcagtactccctaaattaagattatcagaaaactttagcctattttttgactctttatgctattgacctttaactcaagagagccttgagagagagaaatgaaagaataaagggtgcgcagaaagttgaaaatatgagaagtgattacgtgggaatatctatatttaagcctacacaaataaaatactaaattactgatggcaataccagaaaatgggaactggtgaagatctcaatatgaaaggaaaagttgaatgtgacaaatttaaggcatttatacaagtgaggcaaaacggaattactccaggagatcctatgtgttaaggaataaagaaagctgttgctctttcagaattttcagcttaatcatccaccaaattctcctagcagtgtctctgtgagatacaaatttcaaaacatgctttttccagatcctgtctacaggtagaaacatttttttttttttttggtactgaattagttttcactgctctctttctgtagaaacatgtgcactatgtttgtgggctgttctctagcaaccaaagaagcagaaggtgattgccaagaataagtacttccttatatttagtgaaattattttttaaaaatacttttaataataataataagagccagtgtaaaatagttgcttagagtcaaaagaaagaataaggagaaggagaaaaagataaatcaaagtgaaaacttaggaatagtggtacattttaatggcaaggatggggcctagagtataactagcggagaaaactgttagattaagtcaatgctagatagctgggccaaatgagctgtctttactgttagttgactgatcttacacaaggggatgaccgattcagcaggtttcttcttatcaggggtccccaaaccctgggccacggaccactactggtccatggcctgtaaggaaccaggctgcacagcaggaggtgagtggcaggtgagtgagtgaagcttcatctgtattttcagctgctccctgttgcttgcattaccgtctgagaacagcagcgacattagattcccagaggagcgctaaccctattgtgaactgcgcatgtgagggatctaggttgagcgctccttatgaggatcaaatgtctgacgatctgtcactgtctcctatcacccccagaggggaccatctagttgcaggaaagcaagcttagggctcccactgattctacattatggtgagttgtataattatttcattacatattaaaatgtaataataatagaaataaagtgcacagtaaatgtaatgtgcttgaatcatcctgaagccatctcctccactttttttgtcttccacgaaactggtctctggtgccaaaaagattggaaaccgctgttcttatgacttactagcacttcagctactgtcaattacagtgaatctcgttagcagatgagtgtttaaatgtgtgattgagcattcagctagaatcagtgggattgtgggtgaataagcaaaggtgttggacaagcatagagtgcatggtatgcaaatttacatgactagtgtatgaacacatcaagatatacttaatggtatttaatgttataccggaagtaaaaatttaatttatagatgaaacgaatctttatagacatgaagaaaggaggaaaaaatcaatgaaagtttatgatagtcatcaaaacatgggtctgatcattagctgcagagctgacattgttgaaaatactgatgtttcactgtatcagcatatacgatgttagtggctatggatttcaaagacccatagaaggaggagctcgaagccctcttatttcatagtgttcattattctgccagaattggttgccacattctgttttccaatgccctgctcagtccaattttagatgactcaaaccatggacttaccattatttatcttgagggattctccaccccctgaaatctcacagttaaaacgtttccctttaatgttgccttcgaattttctcatgcttatttagtctctttacatgccatcctactctttggttgttctggtctcccataaactttccgatattgaatgtttcccagcaagctacttggttcaagatgttttctaatcaatcagaaagatggctgaccagaaggccatcattaaatttttcttagtcttcagcatcagaattctgatcttacccacctggaataatttctctaaatcatacttttatttttatagtaatttgaattgggttagacaatgctgaatgatagcatcaaaaacagagaacttcaatgatatacaaagaaagttccataagtattcatgagtttgttcagcacgtcaaggcagtgttaatgagattttgctttaatcactcccttcctgttacccctgcagacccccaccaatcctccctcactgtgacctgatcatttattttcagtgacaagcacagctcggcctccggcccagtaaatgctgagaaattgtcagatattgaagttgtcctggcctgccccttcagtgaaccacacattaacattgaagagtctggcagcagctgcatcaccttaaactagggaggctgaatgtggaattgtcctcgtcctgagagaggtgttgtcacctgatgtttccgggttacctggtggttccttggtcaggaacatgaaaggacagcattccctgaacagattctccttgaatttcactgttgttctgtacttcaatattaacttacagctgccttgtggttatatatatttttaagtgaaatattaacactgtctctgtaatactagaaagcacagccatttccaaaagttaaggctaattaacttcgtgcaccagcacaatatttatcaggctcacagatgtgccagctgaggaatgtagccagaaagaacactttgcatactggataattgaggtttgacctaatgaacagttttgcctgtgttgaagggctgtaatttgttagctggagtgaaagtctctgcctagcctttttggaaaaaattgatggagtctagagtgtctcaaacagtgtctgattaaacagcaggttttgtttttgtttaatttccaatctgtcagagactaatacgcataaaaaatgttaaaaatgaaatacggcaaaagtgaaataaatattgaagagaggtaagattatagtagattcaaaagacataaaaatactgtcaaattgccataaaagtttctaaatattgatctgaatttctgtactgacctcactacagaccattaataaacagatattgacgtgttattgatcccatgggacacagtttgaggaacattggttttaactaatactactgtgaggtgcacacatgggaagtcattagcgtatctgtgatcatcaagttcattaaaatgaaatggtatttatttatgtccttcaagaaggaataaagagtgtgttctaacaacttctttgggtaagtgtaaaataagattgtaataaatttaattatcagctaaatagtagccctgttggtttttaagctgatactttacaaaagagttaactattaatttctgtgttatagctttctcttccatgccaaataagaatatactttatgtcagttgcccatttaggtataagcaatctgttggatctgaaccttccatacactcatttttcaaatattattatggtactttactaagcaaatcagtgtcacattcctacatgatgaaattcagcccattattaatcatcttaaatgtgacttggggtctcattttcttctaaatgttgtcagtggtgtactgttggcttctgctattttcttgcagcgaattcaaggtcgaaaagccagcctggaggaaatacagcttgttcattctgaacatcactcactgttgtatggcaccaaccccctggacggacagaagctggaccccaggatactcctaggtctgtacgggcctccactgtactgggaacagcacattccagcactatcattagtcaacgctggtgtcagttcaaaatacttggcaagtagtgcaacaaaaaatcagtttttccaacagctttgctctgtggagtgagtcatttgcaacagaagccattgtagattaagaaaatcctgcattagaaaatgacaatgtaggttccatggtgtttactttagaattaaccttcatttgaataacatttgtacaatgtgtttttgcatatagaaaaaactacattgctgaatttattgtgttttcaaacttaaagtagaaatgatttacacatgctttatgcaaatttctcttcaccgttcccatttttttgtatcttttagttctttgttctatgaccttaagaaacaaaggaaatagtacaacttgtattaagtgaaaactcattattactatgcccatcacactacattctatagcaagattgcaaatctatttattgccttacctttggaattaaataatacattaaatgcaaaactagaaaactaataaacagttttttgttaatgtatgattttttgaaactttatcgtcagattttaaaataaaatttatattgcagaactttatataagctttatatgagtgatagaaacaacaggtttctggaagaaaaattagtgacaatccttattttagctgaaatgataatattgttttattaactttttataagtgaataacaatatctaacattggcaatagatgctgatggggtcatgttttaaatgttttaactaaaaaagacattttaggagtttttccttcaaataaatgtattgtgtcagctctaagttattgaactctttcacctaattcaatattatttcaaaattgttttatattaactggtcctaaacaatttgaaagcaagtagataacatacagtaggtaggtatcttggaaagcaattgtaaggaagaattaacagttactcattataacacaatatacctttttaaacaagtggcaagcatctcttaaatttatgaagtgcaggcatatgagtgagcataaatatgcccacacatgcgtgtagcagtataggtagcagtagcttggggagaagtaagaccagaggggaatacataaagattatccaatttttagaaagtacattgctaatatttgatgataaaaaataatgtatactatcgaattaacattgtatattaatatgaatacaaataaatcaatctaaacatatatgctcattttttcctttctattttagaaaccagtctctgtacatgcagatactttacataaaatacctcttttgctgcaaatattgtataataaatgttcttattttaacatgaatcaataaccctacccaactaaccaacaagatgaagtaaaccagacattttaattgtcatgattttatgaggtcataatactcaagcatttaaacataggagactgtgtccatgtcattattttttaattgagttaagaaaaaacaagtagaaaacctccccccactttttaaaaatctctggtcctaaagtataaatcaaccttccaactttattggaacaggctgggattgatcaaattgtgaatataaacacacatttgatatttgagaagtgctccaaaacaaccattgttccacattttaagagaaaggcatatttataagataaatgaagtttaaacttttgcaacatcaaacttttattcataaaacatggcgatgtttttttaaaaaatttgactcttttgaacaaacctattttttgtaaaatatttgatgtgcatatcatttttaaatttgatgattttaaaatgaaattccatttataattttaacttggacaaaggttcttttcatgtatgtatgtgatgaaagcagcaagtacctatgattcaatgtttaaaattttaatctaaataaattagccatttatctcattaattttgaacatatgatgtgaaataatattcctacagttgataatcttagagttagcattctatacatgtgtggagtttcatatacacttctcagtgatcattgcaacaatttcaatattgtgtgtgggctacgtaagtacacagaaacagggatgttgcattctatcaggccttaaggtcgagcactaaagtcaactgtatcaacacttcaaaactacttctctttccctagtgtatccaaaagtttagctaatttttctcaatctcagttcaaagtgaataattctgttctttttaaaggttaacttttaatactttttttgctctttgtggcatttgcattcttctggctttttttattgttgttgttgtttgtttgtttgtttgtatctggaagaccggattgaagctgccatatgtgaatgtatagaaattcataatcgtcaagatgttttctctctttttatccattcctttcacttccatatatcttactacatcccccagttcctcccaacacatatgggagatgtcttttctgagttaaattaatgctatttcccttgatagttgtgttctagagttaggaggaagggtttaaataaaagttcagtatgatgagacctgtcagtctttgtatcttgaaagacatctatagatgataaaataattggatttgaaaatgaacatcatttatctctttaaatactctagaccctgtaaggttacatggagaagacattctctccaattatttctggtgcaaggctttccttagcattaatattcctgtcgctcttatgaccagtttccagtcgtcttgaggctagccaaatttcagtgcattgataagacaacataattaaaaataaatccagtcagtttggtgaaataaaagtttcttgcccatttctaaatttaaagtatcaattatatgcctgttttgtattatgtaaacattctcctaagtaggtattaaataatagtattaaataaaactctcccaagtaggatacttattttgctaattctcttgggggttaataatttttttcaattactcttaaaaattaatttattggctgggcacagcggctcatgcctgtattcccagcactttgggaggccgagacaggaggatcacgaggtcaggagatggagaccaggctggcaaacatggtgaaaccccgtctctactaaaaatacaaaaattagccaggcatggtgatgcgcacctgtagtcccaactgacgggaggctgaggcagaagaatcggtggaggctgcagtgagccgagattgcaccactgcactctagcctaagcaacagagtgagactccatctcaaaaaaaaattaacttactatgttatcatattatcttcattcctgtttcttgactattaagaattcagacactaaaatgtacatatatattttaatttcacaggtgatatatgaatatactcttgcaaaatattcaaggatacagttatatttttgttaggaacaacaacataagaaaactttactcctcccccaaaattttgatgtgccttttactggtgccaatattgcagttttaatattattttatgatttttatttgtaattctattgacttctcatctttttgttaaaatgaagatctctctttataactagatggcttcatttgtacatatatttttctttatcatcttccatcttttagtaattacatttaaaaaaccaactaatatgatttattgttttcaaaacaaactgtcttctgtgacaataaaagctatttagacttttactgacgtggtgtatgaattctactataaacctgttttcaattttaatttctcatttcattgagcatcaatagaacaaattaatgggataggtgaattggaaatttgtacctggttctaccactgaactgctgagtgacatgtcagagtcccttcagaaccatttgactatgaaatagaaatgttcactgcccttccccatgattactccacagacagattttaatgttaaagatgtaggagcagttactactgtttttctctattcatgtagtagataacgtagaaaataaaagtacaggtaaacaaaataattactaaaaatcccatgaaacaccagttctaagagatactcacaattcagttttgggaatatatttttaaagaagatattttatattgatattgatgttatatagatccccaaatgggattatttttcatagtgtactgtttaaaaaattgtggatgttagaagtggcctatggtgtacttggctttagctctatcttaaagttgatatagctacttataaccagctatacttagttatgtcttaagtagaaattaagaataagtctgtacatttgagaagatatgttaatatttgaaatattttttaaatgacagtatatggtggcataaaccttgtagctcaaaacatcccattgaatgaatatactcagtgaagagctgaattggttaaattttaaaaattgtaatgtataatatagacatggagaccaacttagaaaaaaatcttgtgacccaaatctcatgagcatgtgtttattcatgtggggcaatagactctacatgcaataaaatttatattgatttgcttttagttcttatttgtgtatacagataggcagaacaatgatattctgaaaattgtgttgaataattggtctgaagttttattaatttatttttgcatcaaacgataaataccatgtgacatattattatgtgttaataaatgccaacattttaaaaattatataacctccatttatctatattttttatgtcttcttactgtataggtgatgactctcaaaagtttttttcctcattaccttgtggtggacttggggtaagtacaagttggtttactgcctttaaataacataaaattacaaaaaaaaatcttttttgatttatctattcagttttagggttatttctcagtaaaagttatgctagacttcaggactgcctacttaatttgcagagctaagtgccaagtaaaaacgtggcagcccttgttaaaaataaattcttaagaatttcaagatggtggcaatacagaattaaaccaagagcaaggcccttctaactgtaagttcccgtgtgactgcacaggtcacacactcatgaagccagctttgctaggcctttatatagctggagaaaaggtgcttcaagagagtttaacacagatttgcagcagaattccattttcaatagaatcacattgagtacgcacatacattatattcctggtgaaaatggcataaacttcacaaagtgctttgcattatgggacattttgtttgtgaaccccttggggacatttttgtcttcaataattaaggaagccttttgactcaacatatttagaccacatttcaaggacaaatttgttagaacccagcaacacatgaagaaaaatgtctacatttttgtagatgattagaacatatcctataacctgaaatctatttaaagttaacccttaccagtaacaaaccatcatcctgtagaactaagtgttatgttagaacaacataattctaggtgaagttttcaaagactaaggtatttaagtcaattaaattgactcgatcttgaagggaaagaacaaaactagtcacatgtatatcacgttttaaacaattgttttgtgagaactaaatttgatgcaaagaaatcttgaatatttttagtttattctatcattttgatgatgccagatttagtgagttgtagccttttgttcctttgcttgtgattctgcttactctggaaaacagaatggtagctatatccatttgcctccgtgaggacttacagtttgccgacaaacaagttccaaaacaaccttgtgaaatagtcattaacaccattttgcaaatgagaaagtgaaggctgggagaagctaagttattttcctgaagtcacacagtaaaggataaaaagctgaaagtatgggggtgatgtacacatccttgtcgaggagttccaaaagagctttctagacactttcatggctttcatctttaacaatctagtctcagcttccccccactccctctgggtaagcagcgcagcagtgtggctgatgtggtataacccctttgtgacagctcaccagtgacttttgctttttgaccaccagcatgggacagtcatcaatcccacattaatccttgcttatttttagccaacctcctgtggagctgggagcttgcaaaatcattctggaaagcagaggataagctgacttttaaaatgggtttcattggctttgtgcttattttctaacatctcaaatggctgttttatgagaatggctgcctacctgtaaatggggcaaaaaaatgaaacaaacctaatgactacttaatgggaacagtgatgtggaggaaatcaaagctattaaaagggtggcagtcatcaaaccccactctttagaaatatagatgatccctgagttatgatggttcaatttatgattttttgattttatgatggtgcaaaagtgttatacattcagtagaaaccatactttgaatatacagccattctatttttcactttcaatacagtattcaataaactacatgagatgtttaaactttattataaaataggctttgtgttagatgcttttgccaaactgtaggctaacataaatgtttggcatgaataaggtaggctaggctaagccatgatgtttggtaagttaggtgtattaaattcttttttgactaaggacattttcaaactacagtgggtttatcgggactccttcataagtcaaagagcatctgtatatttaatgtatgactcaggactgaattgaggccatctccctaggactcacctcccaaatctgacctgggacgtgcttttaattcactatcccttcaatgcgaagttcctctactcaactgctctaaacccaaattgacttcttatttctcacctagaactgctttagtaaactcttcaaaatgaccaaggagtgaatattggctgcttcctctggaccagtatatcaaacataatgcacagtgtgggtcatagagtaagtccttagtaatgtccctagagctgacctcacctggatggtggcagcagtggtggtggataagtctggggtaggccagcagaggcaggagaaggagccctgcattgttagtttgactccatcagtgctggagaaggttggagagatgtgatgcttatgtaggtcagggtgggtgtgaatgtgtgtgtgtgtgtgtgcaagtttgcacttgctgatgctcttgtgaactagtttgactcagtatttttgtttacaggaatgaaatagttttctcagcctttcaaaagtcttcttgccctctcagatttttggttttggtacaagccctaggagaaaccctggatcctcttgatttaagcctgtctaaattttcacctccaggacaatcccagacagattagctatacacaagatccccagtatgatcccggaaggccccaacttggcagcatgggagcaccctagagattttggaaattaccgaaatgacttttgtcttaaggcatggttctgtctcaaattacttaagagggacctgttggtttccattctgaaatactcagtgatccccaattgttaaagtaaacgccagttccttagaatatataacttcattctagaggggtttgatatatacctacagaatacggatgggttaattggcttttgaggaccctacctgggacattatgaaatcagaacatctctacttctcattaaaatttcccctaaaattgcacatggtaatttactgttggtcaagcagctcagtggataaatggtatttaaggtgctgtgaaatgtactctccagaactgcatttcgagcaacaatgtcaaggtttctgaattcctttgtgtttgcttttctttttgttcagttattatggctgactcatttctgattcctgtgtgattgcactacaagaaaatgcaccagttgaaaagaacatttgaccaaatcccaggacttggtcatggtgtagtaaaatagataattaagggactctggaaacaagagccagtgcaggatctcttcagttctcactcctcagggtatatcactaaaaatagtgatcattttcctggccatctgacctgctgctgtgtgaagaaatcttgaagtcatttctcagcctcattttcccctcttcacttgataggccacagaaaaacccacaaaagcaaggacgagcaggcttttatgataatgtcgtcatcagctcccagcttcaaacgcttctgcggcttttgagttgtcatttataacttggaactgaatcgacccataattcccctgatacacttagagaaattgataacagactctgcgcttcttttatggctcagaggaggcaactccaatcacatcactattggcaggcaatattattttttgacatggttgtaaaagtataaaggggcttatggcatttgtttagatgaggaatgggctctcaagctgtgctggggtttacaggaccagatcagtgagaagcaaagggaatatgatgtttgcaaacaggatatgattttatataagtttgggtttcatgctctgttccctggggaaagccctgcagacagcagagaattccacttttatcctacagcagacaagctcccagggccaaaaggcagaaaaataaacgtggtcaatgggtagtgtcagacccttgattggaagaggaggagctgtggacgagggagaacaatcccctaagaggactgaggatttgcagggcacgggcagaactgggacctgactaagtggttgaagatatgcaaaaagaggctctaaaaggtttaatgaaggcaccttctccagcagtgactcagtcaatctgtgaacacaaagctagctttttattacgacttttactctgttcatattctgtttggttacacctagatctgacacacttaggaatgtcatttttgtgattggggaaggggagatggggagaaggattaggtgattatgagagggtagtaatttaaggcccatttcaattgctctgaggttttctgcaaacgtttcagttgtatatcaactatactcactacgcgagaggcagatttggatgaaatgtcttaaattttcttttatcttgtcagaattaaaatgtaagctctcccctcttatttataaatttacagatatgtgtgtgtgtgtgtgtgtgtgtgtgtttatatatacaagaaacattgtatatacacatacataatcaggagaaaaatctattttacaccacatgtgtatcttcatattatttttctaattattacaccacattggtccttcacatttattctccccagtaccagtaaatagtattctagtggcaagccctacaaagagctgctctggtgtttccctccattataatactagggaatggattttgttttatgaccacatctatggacatatagttaaactcaatgcgacaaaagcttggttaataatgcattttactgctgtgatttaggatggtcatctttgaaacaaaaccaatattttcaaagccataatgtgtgccatcagataaggcatgaagggcaggaagaataagataaggcttgttgttgatgactagacaaggtgcagcatgcaaaaacgaatgagcaatgagacaagaccactgctctcaatctcaattgctcacagcctagccattgggctggttcagaaaaatgctaagctatgagagcacagagaaggaagcttttaaaacagcaaagaaagaatagggtgtggaggttactcaagcagttataagctaaattttcaagaagaattagcaataaatgtgtgagttgtgtgttgggggtggtatgaggacaggtcatgggaggcagccaggcattgactgttcaggcaatagaacacaccgtatttctgacaattgcaccaagctgttgccaattagtagagaatttttttcttccaaaaaaggagggaaaaaccccaccttctgtttatgccaaaactttgcatgttcctgaggttttgatattgactcaggaacctctttcttcatatgttatttcaacccaattatcctgagcaagcacaatgccttttgttacatcagcagaaagaggagggggtagcatctgcttctcacatgcagtaatcagggtaatgttaatttccctcctattaatgttcaactcaaacctggcttgcaatcagtacttcatttcctccactgttgctatcaaagaggtatcacaaactttttccctccagcacaataaaaggatccaccctgatttagaatctctcttttttatatctcctcttcctaactgtatctggattttcatcagcttcagacttgatgcaattgatactagcaagaacaccccatggcacctggcaaaattaaaactgataagccaccttaatgaaactgagaatttagtttcatgctgcaaattctgtaaaaagattatgttgcctcagacttcgaaaaaatgcatgaaatattattaaagtcagggaattccttctaaattgcaaaggaagtttccagtattgcatagattatgctaattgtgtatactcaataatagttgttgggatgtagacaacactccctacagagatacacatgtatacattactctgtgtatgggacaaaatgtgaaaatacatagaatcattaagcatctaatgtccattgcaggaaagaagaaaatgagagaagaaaaccttaatttcctccttaattcacttacttgcagcatctcatctgtgattaaattctttctattgctttgacattatggctaagtacaacgagatgcattttgaaataagaatacttcattttcttatttaaagtaaacatgaatatcacaaagctgttaaaattcttctgttgccaaaatgagatggctaaaaaaatgccatcatcaaagctttatttgtgttttttacattactggggccataagacctatttttttaaaaaactgtatacacacacacacacacacacacacacacacacacacacacacacacaaaagcacctatttccaccaaagtaatgtcaataacagggaggaagaaaacgattatgaacattgagacaagaagaaattcagccttaggctctgcagttgctgaaggtaaatggatttgatgaaatttaaatttctatctaacttagaagatctgtggctcgattaaataaaagctgagaaagtaaaacatacttgaatagatttgaaaatatgatcatctactgattgctacttctgactgccaaggagacgttaggcttaaatcaaatgaaaatttagagtagacaaaggaaatggtactacctaaaaaaaaataattcttgtagcagcctgaaatacagctatattcaggcacacctaagcttttcattttaaggtgaagtaacagcatttgtatttttcatctgtcatatttccactccgaatagttagttccagatccagatattcacccccgtaacaaactaatattcaatatgtaaaactgatgtgtcattattggatttgtctttgtgaagtattttaaccacaaacttagtaaagcataacttctaaactttcattaatggagaacaacagtttttttttcaaaattcaaaaccaaaataaattagctcactgaatgcttgagccataagcaggcagttcacagcagaatccctaggatttaatcattccccaactcaagaaaaacccatagcttctgagttttagactagcagtatcattattgctatagagtgtcttaactttaaataaaaaataataagtaaaataaaggaattaaatgactaagcaatgattctcttagcaatagagcatgcattgagtcattatttctatgaagactgataagactattaaaggactaatatattcgatatttttatgctcctgaaatcatttggtgaatttattctgttatattctaaatattatgatttatataatctctaattgatatttactatggatacacacagacataccttggaaatattgcagattcagttccagagcaacacagtaaagcaaatagcacaataaagtgagtcacacaaatgttttgtttctcagtgtatactaaacttatgtttatactgtcctgtagtctattaagtttacagtagcattatatctttaaaaatgtacataattttaaaactatgtttaaaaatcctaatgatcatctgagccttcagtgagtggtaatctttttgctggtgcagggttttgcttcaatattgagggccttattctggataaagcgttggctcaagggaatgtggttgggttgatcttctgtctagaccactcaaactttctccatatcagcagtaaggctatttcactttcttagcatttgtgtgttcactgcagtagcagtttcagtttcctttaaaaacttttcctttgcattcacaacttggctaactgttgggcacaacaggtctagttttcggcctgtctcagctttcaacatgccttcttcgctaagcttaatcatttctagcttttgattgagagtgttgagagtgagagacgtgcaactcttccttttacttgaagacttagaggctatcgtagggttattaacttgtctaatttcaatattcctgaatattagggaatagggaggcctgagaaagagaagagatggaggaaagactgatcggtggagcagaagtcacacacgatatttatcaattaagttcactgtcttatatgggcacgattcatggtgccccaaaacaattataatagtactatcaaagatgactgatcacagatgggcataaaagataaaataatgatgaaaaacttttgaaatattgcaggaattaccaaaatgtgacacagagacaggaagtgagcacatgctgctggaaaaatgacgcccatagacttgcttaacttggcgttgccacaaaccttcaatttgtaaaaaatcaaagtatctgaaaagtgtaataaagtgaagcacagtaaaacaaggtgtgcctgtatcgagtatcttcctgacgatctgtaagcacttctcaaaatgacttgtatcattttgagatgtgaccatttaaggaataaaaaccaagacctacaagtagcgaaattctttgctgctaaatagattacttttctttccttaatctattgcctctaaagacaatttaccatccattcattcattattaaataagcatgtactgtccaataccatcctatgtgctaagtgtgaagcaacatgtagactcacattttttcttatgttgtgtttttttttttccttttcaattcccactcatgtatcttgtcatacctatcacttagactctgcattgattttcttctattcataattgtcaactctggtaggaaaggcctgggagttcataggactaaggacagaagatagtcagaatatccatactcagttgaaccagattcaaattcagtagtctaatgaaacagttctacgagatggccttcttgtctcagctttctttgatgggggcatccaattttttgtttgtttgtttgagacagggtcttgctctgttgctcaggtgggagtacagtggcacaatcacagctcattgaagcctcaacctcctgggctccaaagatcctcttgcttgagctttgttaagagctaggaggtaggaatacaggtacacaccaccacacatatttggctttctttcttttattttgtagagatgtggtctcactacgttgctctggctagtctcaaactccctgcctcaagcaatcctgccaccttggcctcccaaactgctaggattagaggcctgaaccactgtgcctggcaaattctcattccaagagctaggaagcgcagtatccagcatcaatccacaactccattaatagcaaatgtggaagaagttcaaagaccagtgctcactggtgcagactattctctgtgcttctgaacttactatactcacaatttccaattttcacaacttgggacagaattcatttgctcacttatttagtaatttatttatacagcaaatgcttattgaatgcctattgtatgcctggaactgcaaatacagtactgaacaaaacagaaaacgttttatcctactggaacttatattccagttgaggagacaaataagcaagaatgaatgactttaaatatatgtgcatgtatgtgatgatgatgaatgctatagagaaaaggaagcaaggaaggggtgtggagtcttgtagtgttggggcagagaactagtggttaatgagaagtgttgcttttttggatattaggatagacaggtgaggggtgacctgggagccctggtttcttgtggtgactgacttaaagaggggtacagagaataataagatccatactgagggtgcaaagcagagtggtggggaagcaaggaaagttcaggaggtggagaggaggcttgccaagactgctcagagtttggggaccccatctcactctcactgttaaagatctgtgtgtctagaggtagggttgttctattcagaacacacagagcttctggtcttccttctgacaactggattgaggtgtggcaatagatgatgagagggcaagttgaatttctaggcacacgctgagatgctgacatttctcttcagagctggctatggaggtatagagaaggttgggggtgggggcacacttactcaggcactcaaagatctgggactcagtagcaggccctgggctgtgagatatctctctgggtagttccagatcttagcagcactgtgtgctttggggttccaagtccctggaatgttatgtggacatacttttctttttaaattgggcagctgcaaattatatacagtactccaacacctgcccattttcaagtctaataaaaatgtcctgacatttgcatgacctttgcaagtgggttggtttttttccttgtgcattttagtgtcttcttgaatgacattgtcacattatggcctcagttgctctggctggtccatcctgatttatatctgaactgtgagatttggggtaactgatttgttggtcccattgtgttggtgcatagaatggaccaaataatgatgacgtctcaatttctatatgcccagtttcgtgttgtatttatatagtgcaagagagataaaagtctgaattccagggtatttttactattgacaatcagtttctgatcctcagcatcctcaatattaaatgaatagaatcaagaaaaaaaacttggctaaattttttaggattatgctttaaccattttagcaaaataataattctcgactttgaccccagtggtattcagaggattgaccttaatgatgggattatccatcaagtaaagggacaggtaaggtgccctagattaggctgggcaatagagaatcctgcaaaacataccctcctgattctcacagaaccaagagggctgattcacagcctcacagcagagactagccattctttacacaaaccttccaatgataacctgcctcaatctcttttaaatcccaaataatcccagaggttttattgctaaagatgcaattgaagtttcctattctacagaaaaggaaacaaaggctcagagaggtgagtatcttgttcaggtcatagaattagtaggccatggagcagagagggcctgattcccaagcttttaaccacaatactatgcacacacagcacaactcaccataatttcaacctcatatgattgtcaacactcctttcccaagtgagaatagccctagccgtaagaaaaaaacaattgctatttttgccaagagcattctcttttttattgaaattcctatgaagtattaaatccatgcactcaaacatcatcaattctgggtaaaaaaaaaaattacacagctatacatagtatttcaaccctaactagaacactgaaaagtctctgtccttggaccaaaccactgtgggatgagatagagagaatctcatttcacacacctactgagtcagagttaattttattaagctacactctgtaggaatgaggctctaatgtgcactgtccagtgaataaaaagattggcatattttgaagcaccctttacacagtgtggacatcagattaaatgaagaaacagtaggaaagtactaaaatggtatttcttggctctgtctctaactcagtcttggtagaactgaccagcagttcactgaaattggataacaatagggactctcaaattcctttactggtctttactggccacataacccacaggaatccatatattacttggtaaatctatgagtcccccggatcttaagtaaggatccttagagtctcaagatgtagccctttcgccagagcaaacatattcctctccttattcttgttactggcaagtaaatagcaaaaggcagatttttctgaagataaagagtgactagaaattgcacatgcaaggtcaatggagctgccagaaagcagttgatcataccgggagatggtttgtggtagagcattaatgcacatggcatgccccttttctcctccagctgtcacattaatatttcacaccttctttccatatggaatatcagtcacagtattcattcatcatatccatggctttacttggaatctgaacgtcttccctgtagctgctctgtttctttttcatctcaccatgactaaagaagctaaggtgtgggcattataacctacaactgatcccaaaggaatgggctgtcattcatgtcttccttccaatgttgaacaaaagagagaatgcatgtgggttcacccacccattgttatcataaatccatcccagctccatttcaagactctcagggtttcagcagaacatctaacacgaaatgaatatatacattcaaggagctggcatgttgtatcacaagggagaagggaaaacacccattgttacagcctcagagctgattgaaaaagaatgcaataaagaatatcagaggttctcagaccagaatcatgattctcattattatcccacaggaggagaaaagggacagtcacccagaattagagagggctctagaagttttgaagtgttgacacctaagcgtccacaaaactgctcggaatagttttattttagaagtatcctgcccagcctgagtctgagaaaccagcaatgcaaaggctctgttaattattatttcacttatctgagacttggtttctttatctatgaaatagggctaagcaaggctcccacatggtattattgtgaggatcaaatgtgataatgtaggttatcactggcagctatatgtggtaatgagcactgcaccaccctgtggggtcaccttgagtagattcaggtctgcagagggtaaacagactccctgatttaaaggttctccaaagccctgcaaccctgaggtctccacctgacctacctatccaactaatagtctaccattagaatcaaggcactgcagggagacaaataaagggagggaggacattgctttcagaaatcccagtgattaggcatctaggcagagagccttcatttaggaactccggaatctggattcaaatctttacgttgtcactgctccaaaagcgctttttcaactctaaagtgcagattccaattcagcaggaccaaatgcgagctgagattctgcatttctcatagcactcagggatggcattgctactcatccgtggaccacattttgagtggtaagatcctgtaagaccatggactcacaaatcattgaaatgactgggcctcagttccttcacctatgaagtaaggtgataaatgaaatgtgatttattgtcttctctggggatcaaatatgtcattactgtgtgatagtactttatccaaatttaaaacagctttttacaaaattcatttttcttgagagatcagatagcaggctcccattagcttgtcactggggatcttgttgacttaagtcttacacagtctgtctcccttgggaaaatagtgagtggggaagcttctgtgagagacaggggtgatgcatgacaacagagatccagggcactggggacatcacagttgttgttggatgattcagtgaagaagcatcattgtaggatgatgcaccaaaggaagcacccaatgctggcaagcaagagctagtaggctatacctggtgcagactgaagatgagagaagcagtcatcactacatcatggatgtattgcagggcccaaacaggggtggtgtttggagtttagatagtttagccacagtaaagccctgtaaagaacagtatcactataggattctttggttctcatccttaattcattccctcgacaaaatttgttaagcatctattatgtgtcagaccttgaagaaagagcagtaaagacagacacccataaccctatgcctaggacacttgcactagcccattgtgttctaaagaatcaacaacacagaatatctttttaaagttcacatctgtatttggctagctagggctgtcataacacaataccacagattgggtggcttaagcaacaggaattaattttctcacagttctggagcctagaagttcaatatcaaaatgttggcagatttgatttctcctaaggcttctctcctgggtccttggatgaccttcttctcattgtggcctcacaagcttttctctgttcatgcgcatccctgctgtctctttcttttcttataaggacatcagtcattttgtattagggccccacccttatgatctcatttaaccttaattaccttttcaaaggacttattgattgctgaatacagtcccattgggcttaggacttcaatatgcgaattctgaggaaacacaattcagtccataacgatattaatgtccagggttggctttggttgaaaccccagctcttcatctcatcaactatataactttggtcaagttacttaacctctttacagttcagtttactcttctgtaaaggtgactaataatacttttataaagctctcatgaggaattaaataggtagtgtttgtaaagtgcttaatagggtccagcacctagtaggtgccccaatcttacccactatgctgttctttaaatactgaccaaagatatttactttttgctttctttgggcaatagatttgactttattaccttttcttgtgaatctactaataaattaggcttttctttttcttggaacctcgcaactcacaccccttttcttaccatttccaaaaacaaaatatctactggaatcatcagctttagccctaattgtaaaggatcaaggataggaaaatgttgagcttatcaaataccacttaggtgggaaaaggtaattattttgtttcccaaggcaaacacaaaaagaaatttggcattagaagatgaaagtagataatttttaagttaccaaatcaagatgctgtttgcagaaatatttggtccacagtagatgattcatttaaaaaatacactttacctgacacagtgcaaaagttaaaatgatttttattttattttgcggtttagctttaatacaacctgctaaaatggcacagaatcaatactgcaatgaaaaacctctgtttctttgttgagtctggtgtctgtcaataggtttccaggggcatctgatcattatttaagcttaaactcaattattcagaaaatgccctgtggccctagcgtcagcataaaatagcagcaagaccttactaaactgctcagaactgggtgaagagtttcatttcccaactttcagggtgaaatgttcaaggcatctgaggaaggatagtgtaccacattaaacatgcacagtgcatatgaaacctgttttgttaatgggcacaatagtattatatttaactctgggaatatttccaccaggaagcaacaggctgcatttagattatacaaaggagactgtgcctaaattccttttcttttaagtcattccctttccgttttaaataccttcacatccactttcaggacaggtagcttaatttctatcatgtgcggcttttcagagcattagctttgtttcagattccaatgattgagctatgctggatgtgcttggaaaagcctgcaaagacccacattcactcaggaaactacagttgaactagatccatatgtggctagaaaacatgtagctttctgattggaggtagttcctggcttccagcattatcacagatgatttttgtcctttgatgtgctgcgaaatagaaagtaatgttagaagcaaaatgcggggatttttttttcttagttaccattgactgagagcttactgcttccagcatcgtcttgtgctgtgttaagcactttatatgtattgactgattgaatgctaacaataatcctatgaggaaggagtattattccatttttcttaggtcacggatcggtgaatgaacttgcccgtgtttgaatagtttgcaagtggaactgctggtttacgaggtctctaacgctaaggcaacaaaatagataaggtgccattgcaccaaatgtcaatgatgtccttgccaatgctaccacctaaaagaataggataaagtagaggaggatttgcccaaagcttgcttccttttaatgtctgtttaaaagtatatttaaagcctaacaatttctcgaaatcctggggttaaaccagtctgtaggtaccaaattttggtgtatgactcaaacaaattattggtagtcattctctcttggtacaatttatgttgataggtgtaacttattaatacaaattcctaaagcatttctaattttacttctggcttcaccttttctttctatccttttatccaaatagaactctttctttaaacagtttgcaaagaaaagcatttctctatgaagttaatgcttctcaaattattatgtggtaaggggcaaggttttgtttacttacatttcatttcctatatctgttgtgaagaaatacttgtatatgaggcaataaatacaaattactaaaagtgagatacaaaagacatagaacataaaaactccagttattttttattagattcaacagatcatgtctggccttgtcctcaggcagaggctggaatccttcagtaacacacctctgtaagagttagaggacttctattctcccagggcactgccctgagaaacctccttgaattaagctttgatggttaccacacaaggaatcaactcaactagttctgctgagactttttttttttttttttgcctttcccgctttagaattttcaaactttgtgtgaaaataaatcaccctgggtagcagaagttatgcactgccaggccagaagccatattcaacacatacatagatttctcttagcttggctggggatttttaagtgaattattgtcaatatttaagatagaaaaattgcacctaagaatacaatatttagggctactaataaataccatgctatcatttccttaagacaaaaattgtttggaactgtgtagccattgtccttttagctgggacacaaacactccagtcaaccatagttccaaccagagaacctgtccctcatccccagttacctgacattatgtctatgtccccattgtggctttcggtgtcatttgaacacgtggctacttctttagccctaatctgtaccccttctatattcgagtctttctgggtattattattattattattatttggttctttgtctctgtctgtggactcatggacactacttgattccaatacatataagacaattaatccctttaacaccaaggaaatcctctcctctcctctccttttcttctcttttcttttctttcgtgtctcaccttgttacccagactggcctcaaatttctagactcaagtgatcctcccgcctcagctttctgagtagctgggtctgtaggcacacaccaccaaaagctagctcaagaattttttttttacaacctagtaaacatttaatttattcctgattcaaatccgaggaggcattttagaagagaaggttgctactattgctctcagtgtgaacaataagaggacaaaacaaaaaacaaaaaacaaaaaaaaaactgaaggccaccaggtgcttgccccagacatttgcagaagcacagagacttctggataggagagcactgaggaagcatctttatgttcttgcaaaatcctgagttggtcatgggtttttatcatttaattcatgttcttaactcacagtggaataaagaaatggtgtaaacaacggttttgaaatgttatacccatctctcagctgctcagaatctgtttcaaagatagtgaacaattagaagggtgggttactcagaatcagtgcccacatatatttcacttaacagaatgaatcatggccactcaaaggcagcagactttccatgtactcccagcctgccacgtgtgtagtatgaacccaacattctcatgaacaacagtttctcaaaaacttggcttttaataggtagcaattgcttgtgtgtgtgtgtgtgtgtgtgtgtgtgtgtctgtgtgtgcatgtgtgtgttttgtatagactcataaattatatgatgttccttgaccctttattttgccaatgatattatataattatttctttttgaaatcatcagataaaattgcagtactttcctttggcgtattaaggagtggtaaggtgagaatgaagcaaaggaatgggaagaactatgaagagtttttactggttctgtcactaacatttgtgacacttaagaaaccaagggcagaacaatgcttaaaaataaatatataacagcattgattctgttcagtagacagaattatttggacaaattcagggaaaggacactgattaaagttatttttggttgtataccaaaaaaaaaaaccatgcatcgtaggatgcgtagtggcattcctggctctatgcactagaagccagtagcacacctcccttactcagtcatgacaacaaaaaatgtctccagaaagtgccaaatgaccccttagatgcaaaatcactgtcattgagatccactgctctaccataatagcagacaaatcacaacactcaagaaaagctcaactcttctaggtaccacttgaaacatttgatttaaaaaaaatattttagcacttttaacagggtagggtttcaataccgtgaaagaaaaaacattcttgcaggtcttagctaatttatttaattagaaaactctttatgcatatatgattagaatctgttttttaaaataccattttattatttattttactttttggattttgattttactagcataaaaattactatgggctaacagctcatagttttctcagttctttttctaccttctctaattactagctgaataacctctgaatttcatatataaaactgcttaataatagcatctacattaatggtcgctgtaagaattgtattagttactatgggcaaaagctttgcacagtgcctggatcttagtaaatactcaataattgctagacaataatattattgttattgtcattattatttctaaataaaaagaaaataactttatagagtagggaagtatataataaaactgaaaacatggactgttaaattttagttttttattactttctctatgtattttctgaattgcattctgctatgactgagtaaacgaaatcatgtttctgctattcatgttccctaagttatgtttaactcagcactcatcctttttatcccttattctggatcaccactagtaagagagattgcaacatgttattcttcttttaaatgtgaacagcattatgtagtagctaagttttaataaatagatgtataactagcgctttactggccctaactctttatcctcttgtagtccctccatgcctccatagagaggagtatcttcctaattattttaggagcttcaggtaatgcctaatgtgaatagtaccatgtgcttctgaatgcaagatgttttttcccatcgccctttccttccttcctttcgtccttccttcctttcttccttccttccttccttcctctctctcatgtactttttgctcacatacacttcctgtgtcccctgtttctgtcacacctcttgggtatggctggctggcttccttccttccttccttccttccttccttccctccctccctccttccttcctttcttccctccttctttcctcccttcctcccttccttcctttttgctcacatatccctttctgtgtcctcggtttctgttgcatgcgcctcttgagtctagctttctttccttccttttcttttttctctctttctttcttttctttctttctttctttccttccttccttccttccttcattccttccttccttcattccttccttccttccttctcttttctttctttgttcccagtgagtactgctggcccctgctgatgcacattaccgatattctggggtctttacattgccaagtgctcaggattctatgaggtttatagagaaacagaaaatgtgcttccttccctcttttaaggtcataatttttcaaattgataccaaagtgttctacgtaattctcatgtttttagagggtttaaaatgttttgcctattttagttacttataatctcctgtgtttctcaacccctttctaccctattagatagacaggactctgggagtgtgggttgggagagaatctcaatgagagattctgtactacttcagattgtgcctcctcctctgatgactaaatctttcttatgggccaagctcctgtgactctcaccctaaagtggggttctactcaatctcaccgagtgtgtttgttccctcacacagaaagactttttgtggaatagcttcacttacacttctcaaccccagttttggatgtatgttaggtccagaccctcctacatatttataaagtgagttgaactttgggatgcctatttcaaaactgatagattttaattctggcaataaaacaaggcctctgtggacctatttctcagcagactactaaagctgccttcatgcttggtacattagttacatcattagaaacatttgaaagttaaaagcatactgtttttagaatggtacataaagcaaggcttggtaaagattccagaggaatctgaaggtaggaatatttagggatttccatactgtaaaatacagttaaacctcactagcctgtgtgtacagcatatccttagagacttctgcccagaatcctggctagatttttatccctgccatttggcaaaataaattcctgaccttggaaataaatgggacacaatatttcccatgctccctcagatgtgtgatgaatatgttatttattttttctcccaattatagtgatcctctccataattaataatctatcagcctcttccagtttgaataacttcctttcagtttagaaatactgtcttttcaagatcaccttattattggacttaatgtctttaggtaattgcttagcctctcagattcctctttgaagatggcatttgggcacctgagggagggatggagagctgaaggggtacctggatcctcctgctgtcctctgaacactcagggttccatggcaacctctctgcaccacctgactcttcctgaagttgaagctgaggtcggcagcagattaactcctgattactgacttctctgccagctggagcttggcagggttcccgggctccagtagcctccctttggctcacattggtaatggggttcctctgaacccctctgtggactccatttggctccacccatagttaaaccatttcacaggctctcccatatcataccccttggaggattgtgagaacttgagacttccagctgcactctacaggaaccaagagcatctcaggaatgctgtagcttaatcttccattagtttttcataccactctgcagactttattatatggtggccacagtttagtgtagacatgacttcaaaaagtcccaaatattggctgaacgcggtggttcacacctgtcatcccagcattttgggaggctgaggcagacggatcacctgaggtcaggagttcaagactagcctggccaacatggtgaaaccccatctctactaaaaatacaaaaattaactcagtgtggtggcggatgcctgaaatcccatctacttgggaggctgaggcggaagaatggcttgaacccaggaagcagaggttgcagtgagccaagatcgagctactgcactccagcctggatgacagagcgagactctgtttaaaaaaaaaaaaaaaaagacccaaatatcaaccaaagtgaaggctcaccgaccattttgtcaacttacctgaaacatttttctctctcgtttgctcacatgtcgctttctgtgttccttgtttgtgccgcaccccttgagtccagctttctgcagtctttcaggaccagaagagatggattttaggttttccttccactcaatgtattctatatgtaccctaatcaacaagcatgcctggttgtcacaggtagaaggggtctctactctgaatcattcagagaagaaataatcatattctttcgatgctatcactaacacaggaccgtgatctgagacaaccaggttcagttcttgatatgtaaaggaatttgggaaaatatcatctctcaccacaaaatctgtatttttatgtatattgaagcaaaatcctgttttggtcatcattttctttacctttcttctatatccatcctaatctccctttcagctcatgtactattactccttaatgcacacgcagacacatacacgcacacacacacacacacacacacagtctctctctctctctctttctccctttctctctctcactgggaaaaagaataagttgttggagagacaaaggagaatttatgtgcatggaaagaaaaatgacaaagcatattttttcagaatatagtagttctatttttaagaatttgccttgcatgtcttctcaactttagcaagaccttagtagtaggccactgtgctcagggtggctccctgctccactgtcatttatttcctttccagcctcatctattacatcttgcattatttttccatttccagagccaactttatgccactgtccttcaacttccaaatgtgagggtgcctgtcttcttatagttccaaacccttctgatctctactttcatcattattgcattgccatttcagccccttaatcctgcatatctgtatgcattccaagcaaatccttctttcccttttttcttcccctccagctccaaaatatcttattctatgcaaggaaccactatcagttgatgaactcaactgttttctcttacctatagttttttcctactgtcaagatgttcttcagcagttgaaatcagagctctcttaaggaagtggccctcttgatgctatcactaatatagggaaattggttggagagattgacaaccaatgagagggacaaagagggaggaaaaatatttttaccattgagaatattggaaagtggatatggatgttcttctagtgacacagattatagcataattcatgagttatgtatcctgttttatcattgaagttcttatgaaactgtaacatggaaaatacatgtggggagcttttggcagctaatttggccctgaaccccatttggatcatcatgccttaggaaagtatgcttgtaatttgacttatgaacaagattttgggatttaatcttactatgaactgaagagtgtgccctcaaaatttatgtactgaagctcaaatcgctaatctgattatatttgactaccttttgaaagtaattaagattaaattaggtcataaggtactgtgtgctaatccaataggactgatatccttacatgaagaggaactttagtacaaggaaagggcatgtgaggatgtagcagatgtggccatctgcaagccaaggggagagtcctcaccagtcaccaaatgggttggcacctttatcttgaacttcaaagcctccagaattgtgagaaataaaatttcttttgtttaagctacctaccccttggtattttgttatggcaacctgaatggacaaagacaaacttgtttgtaaattcagaattaagtacaattacctatttatgaacagattatatccacaaaacttgaccattaccgtttataagcatttataaactaaatgtaggtaaaacataggttgaggtggtattgagataaatattgtttttgtttaaatataaataaattaatggatgataaatcccatagtttcctaaagagaacttctttagggataagcctaaacattggttatgagtcaaaatatcagtcatccactggatacctatgtgctcaacattctttatgatcaataaacatagctttattataaaagtaacccccacccggcaactcacagtaggtactcaatgaatgttaactgaattaaaacaaaactaccattattagtagaagtttagacaccaaaattaatgtcacaaacatctttggcagatagaaaggtatggacaggcatatgggtatcacgcaaacgtatttgtggctacctaatgccctttagtatggtcaaagatacagcactctctgctgctggaatgtttttctaatcaagttcagtatttataattttttggaaggaaatttgccactgctttaagaaataaagaaagaaacaaagcttatgatgtactccaaagttgagtaaaaagggcttaggaattttacatggttcttgagtcaccgaatacatcttttggaatttatttattttatttttttgcttgcttccccagtaacttaaattctgattaatgcaggcttttctttggtactagtagctctgtagtggtgggaaaactgactaaaacctatataatacatggtaaataatggtttttatttttcaacttgtgcagtcatcttccttaagaatatagctacacaaagcttaaacaactacttatttatattggttcagtaaaataataaaaccttcaatttagagggcaaatgattaggtctcagtgtccatttcaatgattccttcactctttagctgacagtgcagaccatgatggtatcgactatgataggggatgctggctcctagaaagcacgggtttcttcaggagggtgatggaaaggcatgtgctgacagggtcagagttctgtgtgagagtcccgtggtcttcagaacagcctttctaagccacagtgtactcattcaatcaacacgtaggcctctactatgtgccaggctttacaaaacaggtataacagtagctgaaatggtagtagctagcttttgtttaccacttagtcatttaatcctcactaaaatcgtatgcagatggtactttaaaaagttggtattttcacagataaaggaaccaaggcacagagccattaattaattaattctccaatgtcactcaggttttaatgatgaagccatgattttaccccaccagtttgattccagaaacttcactactatactgctgtttataggatcttgattttcttttattatgtatgcacttatttactgttctcatttattatttttgtattcattgttcttggtagtatttaagtgtgtaagaacctcatgagaaaaaggcatgtgaatattcttagaaaactacttagttcactgtgaatgtgtgttgttattatttattgtatttgttccatgtgattaggccccttgcatttaattctcttttttttttaaaaaaaaaaaaaaaagctttgttttatgcagaatttctcccctttgatccatttgggaagtcttgctatttacagtcacaaactttgtattctatttcctggtgcttcaaataacttatgtgtcctaaaattagagacttctaccatctggtactgtttttttatgttatgaagtattttatatattaaaaatataacatatgataattataaaccaccattgttgctcttttcatgtatgcattattatgtgttttcattgcattcatgaaaaagggtaaacagcattttataaagggaaatccagaatattggtacatgctttgttttgataataatgttctctagtagataagcaaccatctattttactggcttatccaattttaacaataccagtttgaactgaaacaatctgacaaattatactgaaagttagaaatcttaagcttatactttgaacatcacatttctccttgcaatttgctgttattgttttaagtgtgaggaccacacactccttccatttagttggagaacctgacttgtggttgctactttctactccctgactgctgctgctacctgcctaataattgtgtttggctccctgtaaacctgcagtcagaaaggtatttgaattttccccctctagcacttgcaaatccgatttttatgtataactaagtgctcttagtttttactctatctactactggggcctggtttctagcaggcctgtaactaagccagatccggcctatgtaatgctgtttgtaatgagaaatctaaacagggaatggcagtgaggcatggcaggaatgtgtttccattggagaagtcagtgtagagaaaaagtataagcaaagccatgtccagaaggccttttcagctggccaagacggaagactaatgttattgtacataggctgttaccctgccagcccttcctcacagatttgctttctctctctgtccctcttcccctgcgacctcttccccttttacccctttcatctcttccttctctttcgctttcttcttctgtcttcggactctgctgactgtttgctcaggtggacagtgacaccatttggaatgagctacactcgtccggtgctgcacgcatggctgttggctgtgtcatcgagctggcttccaaagtggcctcaggagagctgaaggtgaggtccgggttgcattaagtgtgggaaatccagagaagaaactgaaacagagatgttgttatgtgggaattgcggggagtgtggcgtggtaataaaaggaagggcagaaggaagagggtagagatggccactaaggtgtgataataactcatctgtaggcagggagcagctcatcctgctctcagggccttcttctgcctgagaacactctgcagtcagggcccaccggtgtgcatgtaagagcacagagataataagcaaagctatggttcaggtaaaaaatacctttagtatatacatgtctgtcatgccatcctgagattctcttttgaggcaattttaaaaatatgattactgagaagtgtgtataagctcagaataccacccagagagagggaggcagagaaaggtaaataccagacgggaaggattgggaggaggaaggaaattgttgattagaagggtaatgatccagagtgtgtttttccatgaaagaacttaaaaaatgagctatgctttattgttcttttctttttatggtctcttcttttctacatcgtatgaaaagaacaatgtccaaaccccagcgtttcccagtctaaacaatttataaaagctagagacctgacagacgttgacattttatttggtattttaacagtgctatttaaaggtacgccatgtgcgtcttgaatgcagttaccccaataaactttgttggtgctaacacggccttttaatgcactagttcacacacttcatgacgcaatctgggtcgtgattgattcggtatttttagcaattgcggggcttagggaaatatattatgaccaataacatatgcactgtgagttttgtgaaaccaagataaaatgtaattaggattacttttctttatgtctagtgaatttttattcaattacatgggactcttccagttgtgattaaaaatgtggagtaggaatgtgcacttcacaatgcaacgtttgtccaagaagtctttactcttaactctttaaagagtcagagcctacggaaatataattttgatagggtgagctctatttaaaaagtagatgtgcctgtatatatttgacataagtagtattaggacattgctcatctcaggggatatatggggtcattaatgtggtgcttactcttcagtctttacctttgaaaatgagcaaataaaaagaggaaaggaatcagcctgtggagaggttttggctatctcccagtagaacttgaggaaaaattcttcctatttgagtgcttgtgttgtacttgcaccactgcaataaattaacactttaaaataaaatttgaacatcttattttaaaaagaatccaaatggcagaaatcagccaggccacaatattataattttaaagattatgctggcacagctctttgataacaaagataattattatgttagctttcacaatttctaattgttttaagtttgtgtaagtttaagcaataattcagaaaccttctcaagtagaatgcccacgtgtttcagtcatcagaagcatcattattagcttcactgtgtgcagaattgccaaatatatgcacgaagatagttgaataaaaacataattccatgtttagaagttatccatttaaaatagccagttccaaacaatgtgtcaacaacacatagtatgggcatgctgaccaccagctgtagtaacatcaggtatttatattgagaacaacgattggtacaaatttcttcccttcctctggttaaggaatcagcaggcatggtttaaaaagaaaagaaaacagtaaaaaaaaaaaaaaaaaaaaaaaaaaaagaaaagccagcctaagaatcaagaaatcttagtccaggttccaccacttgcatagtgtgtcatttgtggcaaatctgtaacttttctggggctcaatttctggttctgcacaatcatctaggtggaattgataatattgaaggtcatccatggcactggcattttgagctatttgcaaatgaaaagtggatatgaatctcaattataacactatggcatcccaagcggtagatattctgaaatttcagtttgctttgatgaacattccagattgtgcagctgggttatctttctgattgccaagtccattgtaaaagtccaagataggcagaatcataacagaggcactggtactatgctgacaggtcaagagactgaagccctgggttgctaataatttgggtaaggctacagagatgccatgggggaaaagtagaactcacaaatgatttggagccatagtaaagaacatgtgtaactgaggtagacagccatgtttgtggaccgctattcaacaaccacaaaaactacccagtgcctacgtgtcccagactcaaatatgatggggctgatatacctgcaggccaggagcattattactcatggtttgtggattcgattcattcagaacttggaagaaaatagggaagcttattcaaggacactggtaagtaataagaaatgtgaaaagaaaagacttgagcattttgttattcatttttctgcatctacattcagttctcacatattctatcccattctcccagtaaatcaacatttaattaaataaaattggcatgttacgataccacatcgtatgagattgcactaatttttcttggaaaatagagtaaaattaagagctttatttgaaatatgatgtgcctggatatagtgtggaaataagagatgagagctagctagaggaggtctctgagatcacagaggatgaggacctaaaagataagaaatgtgcacaaaaaaagaaaatgccagaaaaaattgtatgacttggaaattttgtttgatgctgaacttgaccatggctaacctcctaacttttgataggtcctttcctttcttcccccaggggatattgatgagctgaaggaattagaagaatgaaccaggcacagggggtgggtttcctgttaatgcttaaatagaacatgtgcagcaaactatatcagcaaattggtatattttttggcacagcatagacctgctcagtggagctcagtgaaaatcatggggactttcagactttccaagtttttaaacaatacatttttaaaaatacataagaaggaattcctcaaatttacaggtattcaaattggctatttctcagattctcttacaaaggaacaaaaatattctgaaattgttggcatgtttggtgtattggaaatcataattggaagaataattatctcaaaatggttttattgttttataggacattttagaaagtatgtcaaagacatagaaatagctctaaaaggtgaacattttgtaatcataaataaaaaaggattgatacttattgaagtttaatataaagattcactttggtgttcttttgacaatgctaccatgtcttcataaaatagtcaaagttgcttttagcttctggacatatttatcaaaacaaacaaaaacaaaaaaaatcctaaacacctggttatctgagtgatggatgaatttgagcatatactgaatgaatatgagtttgagtgtgtattatgatgtcatgttgctaataataactgctactcattgagtgccttctataggcagccagtttatatgtaatttactattattctcacaatgtacccttgaagtaagtacaggatactggctcaaagacattaagtaaccttttaagatcctgcagataggttaataaataataaaatatgtaaatctgataatcctctgttttctttcaaccactctatcaggacattcttttacagatagcacaaatatacatttaaaaaaggggctaaaactatctattttaagtaagcaaaattttatcttttttattattataaaacatttgagacatacaaaaagacaagaagttacattcttacctaacaaaatataataataaaataaatacccacgaactcctcatccaatttaagaattgaactttgctcacaatattaaaattctctcagtacttatctcattcctatattttaaaaccagatagtcattaatctattatatttttttaaattatggccctgcgcagtggttcatgcctgtaatcccagcactttgggaggctgaggcgggtggatgacttgaggtctggtgttcaagaccagcctggccaacgtggcaaaaccccgtgctcactaaaaatacaaaaaattagccaggtgtgttggcaggcgcctgtaatcccagctatgtgggaggctgagacatgagaatcgcttgaacccaggaggcaggggttacagtgagccgagattgcactgctgtactccagcctgggtggcagagtaagactccatctcagaaaaaaaaaaaaattcctttcgtcttgttaatagctttaaacatgctttttgctttataaaaatggaaccttatcgaatatattcttcttcagcatatttcccctaaaaggtatattatgaggatttatccatgtggagatatatatatatatatatgaatgattaattcattttcattgctataaaatattccctttgcaccataatttatatttttattcttctgcaagacattgttgttgtttccaggtttttgcttttttgaataatgctatatgaacacccttgaacatggctgctctttcactagagtataacaaagagtaaaacagtccgctcctaggctactttcacagtaaatttcaggaggtaatgccaagtggaattccaaagtcattttaccacaatgacatcagcaaagtgtcagtctaagagttcaaaaattcttttctccataaaaacaatgataaaacaggcaaaatgtgtcaggatgaaatttttcaaaactcaggaaagtaatcaaagtcttccaacaactcaggaagcatgtttcaaaaaacaaaccagctgaattttggtgagaacagagagatttgtggtgttttaactcatcgtatttccatcttcccctttctaggtccatggtagccttaccaaatcacagcctgcattcttagcataaactagtaacttgccaacctctgatggggagataagggagtggataatggaattggaactccttcaaagcctcaatcctagagaattgtcattatttgacctgtccagtgcttccctgcataacttacttgcaaggctttatttggcttcatgaggttttcacacagtgtgaaagcctttttcttagaagtatttgttgtgaaaaattagtggcgatcactcaactttatggctgcttgaggtggtggataacaatggggcaaacagtaggttagccaaaagcatcaaagaaaacctgaggaatgtgcataaggactatgaaaagccccatcagattcctaagaatctagaaagccacatgtatgatagggctatatgcatactcagatttgtgttcctactcaggaaagacctgaaaaggccctaagctcttatgtcaaactgattttgaggctctgttcaaacaggaagtgaaggtccgggtagagttgtcagctgcctggctaaatatttaaaatgtgccctaagacacacacacacacacacacacacacacacacacacacacacacacacacacacagagcccctcggcaaaggctgggggagtgctggttttaagcattaaaagaaatatatttatccaatcattgactgaccactaagctaacaatgcaaagacttcagtagcatataaaacatagaacacagattttacacaacgatttcacaaaagtcactaagaaaatgacgataacaaaaaggaacaacaacaaatcctggaaagaggtgagaatatgacttctagttttaccatactgttttgtttaaaatgtccagttttccacagaaatgtttgagacaagcaaagaaacaagaaagaatgccccacacagaggaaaaacaaatcagtcaataataactgtccctgagttagctcagttatcagacttactagacaaaaactaagctagatatttttaataatttaaagaagtaagttaagccatgtctaaagattgtatgaggatgtatgactctataaacagaatactaataaagacacagacattgttaaaataaaagaaccaaggaaaattctggatttgaaaaacacgataacttaaatgaaaaatttactagaagggcttagtagaaatgtgagcaggcagatgaaaatgtcagcaaacctgaagatatctagtctgaagaccaggaagaaaagagaatgaagaaaaatgaacagagtttcaaaggtctgtaggacatgatcaaatgtaccaacatatgcataataagtttcagagaagaaaagagaaaggggaagaaagaatatttgaagaaattacggctgaatatttcccaaattcaataaaaacattaatcaacatattcatgaagctcagtgctccaactaggataaactcagagatccatacctagacgcaccataatgaaaccattgaaatccaatgatgagaaaaaaatcttaaaaacagcaaaagagaagcaactcatcacctccaaaaatcctcaataaaatcaacaacttaggtctcatcataaactatgtaggccagaaggcagtgggatgacatcatcaaagtgctgaaagaaaaagaccatcaccaagtattctatgtccaacaaatctgtccttcaaaaatgatggtgaatttaatacatgctctgttttaccccattagtccattcacctatctctgaatcagtaccacatactactcattacttcaactttataagaggtcttgactatctgataggaaaaattttttcactttcttattcttcctcactagatcttgacattttctttgttcttaaatgtatagtttaaactcaccgtgtcattttgcatgaaacattccatgagaggtttttttgcattgaatctacagatgagtttgacaataattaacatttttagatgattgagtctatttgtttctgagcatatgtttacatttatttatactttctttgaagtttcttaatcaagttttataatttcttcttgggcaagggatggcggtgcatgcctgtaatcccagcacttaaggaggctgaagtgggtggattacttgagctcaggagtttgagacctgcctggacaatatggcaaaaccctgtctctacaaaaaatacaaaaattagccaggtggggtggcatgtacctgttgtcccagctactcaggatgctgagatgggaggattgcttgagcccgggaagtcaaagctgcagtgagccaagatcgtgctgtctcattccagcctggaagacagagcgaggccttgtttcaaaataataataataataataataatttctccaaagacaaaaaatatatatatgtaggtaatttgtgtttttgaaaagaattttagtggcatcttattacaattacattctctgttctgatgtacaaaggggctgtttattttttgctaattgtacatcattattattgcaaaactagtaacaatttataagtcatttggggtttctttctgatatcatctgcaaataatgacagttttatttctttttttccaataattatgccattttaaaatttgtatttccttattacatgggctaaaatctctgatataatgctgaagacaattgaacatggtgagtattcttgtgtctttctagattatctgtttcaccattaaatattatgtttactacaggctattgtaaatattttatattttgtggaagaaattacctttcatttctacttttctaagaattttctttctcctgtgagagaattttacattgtatgaaatgttttataggtggctattggtattatgaagtgaattctatttaatttcttaatgtgataagttatattaattaaatattaaaaatttttgtattcttgagatacatctaccttggttatgatttattatcattgttatgcatttccacatttggtttgctaataatattttggttggaatttttgcatataagttaattactgaaattggtctgtaattcttataaagacccatcaatctagtgcatcagggcttcataaagtgaatatgagactgtctctatatttctctactttagagtaatagttcggtaaaaattgggaaatttgttttctcaacgtttggtaaaactttcctctaaagtcacagagccttgttatttaggaagatttgtaactactgattcaaattctttcattattatgaaactatttggaatttgtatttctttttgagtcaatttaggagtgttgtattttttcttgacatttacatattggagccaaattttcaaaattagtcatatgaatccgttcataatatcctcttttaacacttcaatgtttgcaggagctttagcaatatatctttttcattatcataccgcttatttttcctctttttcttgatcaactctgtcagaagtttgacaattctctaattcctgtagagcaaactttggcctttgtagatgtcatatattttatgaatttcttctatttttattatttattttatttggggggaggtcatatatttcttttaataatttcttaaattatttagctcattattttacaacctgtagtcttttctacttattagagctataaatttttctttaagtactatttgagttacatgctgttttctataaagaattctcaagagtttagtttttaaaatgtcttatttccattatctccttttttgagccattagtgtattaaatgtgtatttttaaatttccaaacgtatgagtgttttagtcacaatttttgttattgactcaatttaaatataagacattcataaaatttgatctgtatcatactagttcctggaagtttatgagacccgctttattgacaagtgttcttgctatttgtaaaatgttctttgtgtgcttaaatagaatcggcatccacatattattgagtgtaatattttatatgtccattagcacaagcttattaattattttgttaaaatagtccatatttggctgcaggatttttgcaagattctataatggctatttaaaaatgtggtgttgaagtttccacatatcatgatagatttttttatctttatggaactgttaatttttgctttagatatttaaaaactctgttattaggtacagtaaaattaagactattatatgcttataaatcctttattaatatttaataattatcttaagtaaatatttttatcctcaattatatttatgatattaatatagcaaaaacagctttttttcttttctagtattttcctggcttatcatttaccattcctttactttcagactttctctttattacatactaggtctatctcctataaacagcattcctggatttgttttctaatatgactgtgtattttaattggggagttcaattcacttatatgtgttatgatttataatatactgaaacatatctctatcatcttattttgttttttctttttgttccattattggtttgtccccttactttcacccgccccttgctttatttttaattaaattagtttattttttctctatgtgacctcttttttcagaaaatgcacactttttttctattattttagtaactacctttaaaaatttaacctacttataacacatcctaaacttcactatcttttttttcccaccaacaatacaagaactttatgttttctttctattttaaagcaatagtcatgtcctaacttacatgcttaggactttagttgtatttataaaagactagtagcactgacgaggtatgattgtactgttttaaccatcagtgtttctctatacttgctcgctatttaccatttttcttatcaccatttatgattgtatctgaaacctctgttctgggattgttttctttcttccaggacattttttcggattttccttactgacggtttctcagtttttatttatctatgatgtcttttaccctcattcttgaaagacagctttgctaagtacacagttcaaagttgatagtttctctcagcactttaaatatcttctgtgcttttctggcttccaattttgatgaggaaaaatcagctgatagtctgatgatcatttcttgtagattttctattttttttctcttggatttcttttaatgtcttctttttggatttgttatactgtgtcttgcttgccatgtatttttagtggattttactcagtcaagttgtttaaaatatatacgtattaggaaaatcaaaatttaatgcagccagtcagtgatattttgtgatatatcccttgcaatagactgcaagcaaccttgctgatttcaataatcaatgattaatttatttaaaaaaaacatgtttcaagtacctatcatatgccagaaactactttaaatactgaaaatactgtggtgatccagacagggaaattaggtttcctgctgaagagcaatgataaagagataaacaaatggacatatgatacaagttcatgtgaaaatgtgttatggataaaagtaaaggatgaaagagagctagaggaaggctgagcaagaaggctagctctgttagcttatcagaaagctttactgataaggagagatttgtgctgagtgaattaagggaagcattatgtagatatgtggggaaagaatattccacacaggaaaaaagcaaatacagaagctctctcagggtggggcaaataagcaggtcttgacatgtttaagaaacttcaaggcctgagcgtctgaaagtgagatgaggttagagagatagtcaagtgctacatgatgggatgcatgtacacgtccaccctcacacatacacacaaacacgctgtggttcatacacacgtatgcatacgtaaataatattaaaaatgaagggtctatttctaatagggcataaggatagcaacggtggtaagtgctgattgtgaataaggaaagctgcattgcatttcatatacattttgccacacatttggcctttcttaaaatgttatattgctgtctaccctaaaatggttcaacaagtaaggtatgcattgaaatacctgtgttgactccaattatgaccaaatcctaaactgtggacaatggatatttaccatgcatactatatactgcttcagtgaattccttaaaacagccaaagaagactgcaattatcttacctaatccagttcacattacaaaagactagagaacatagatgtgattgatggaagattcttttcttttcttttttattgagacatggtctcactctgtcacccaggctggtgtgcaggggcgtaatctctgctcactgcaacctctgcttcccaggcttaagtgattctccagcctcagccccctgagtagctgggactacaggtgcctgccatcacgcctggctaattttttgtattctttgaagagatggtgttttgccacgttgcccaggctggtcttgaactcctgagctcaaaaagatctgcctgcctcggcctcccgaagtgctgggattacaggcatgagcccctgcgcctggcccagtggaagattcttaaaaggaatttaagtattctgactatcctgctcagtccccttcctaagctttggtcccacttaaactaaatgtgcaagagaaggggaaggacagtaaggaaatcactcatgtccacaaacaggaggagtagcttttcagtctttaacttgttgcatgttgagctataggaatttgtaggttcactttagactgttaccagagtggggtaggacgttcactagaaggcctgataaatgtgtcaggagtttgagagcttatgtaaagatcgaggaatactcaggcttgtcacctggagaagagataagtggagagctggctgaacgtgcccatgtggataggtccaagagagagaagtcagcagctgcacagatgcaaaaactgttggtggggcaaggatttttccccctgcgggccagtggacactgcgcagaagccaattttaatcatgaaaggatttcaccaacaatggttgcctgcaagggaaaagccaccagtagaatgagactggaggcatgtgaaagagctgatgaaggcctgcaaggtcagccagtgagtgcatgacgcatctcagtgaacttagcagatacaggtcactgacagtggacctgagagtgttcccattcataaggaacagtgtttggatgtctgctgtgactgaaggcctttgaagaacccagagagatcaccaacttgcattgctaatccagtctttatgatttttccttcttcccagtctccagagctgtaggatctgtaaagtaagcaggaaggaagtggagtaagaaggaaaaaatataaactataaattatatagcctcctctccccaacacacagagatgtacacatcacatttgcccactgctggtccctgatcctgtgggtcagctgaggagttggggaagcttcaaacaaaatgtgacattaaggttttcaatgaggctgaactggactttttaacatctaaaaatgagactatttctatagtaaaagtaactgaaaagctgtggaatacatcagataaaaactaaagaaagactagggcttggagaagaataatcccacttccatttcaccccattcaatatatcagtgcattattaactttctattgctgctataacaaattaccccaaatttggtggcttaaaacaatgcaaatttattcttttcagtcctggaagtcttttgacaggactcaatgggccaaatcaagatgtcagcaggactacattccttccttattcaggggatggcagaattcctttccttgtggtcgtgagacttgggtctccattttcttgctagctgtcagctgcaggctgcccttagctcctagagtactctccccattctttgtacctctacatctcagagccaacaatatggcatggaatcctcatgttgtcatttttctaaccctttctgtcattatgtctctctgtgaccacggttggaaaaggctctatgcttttaaggatgcatgtaattatgatattagctgtgctcttagatggtcttcattatatgaaaatacatttattatatacctaatttgttgggaattttattcaggaaaggatgctgaattttgtcaaatgctttttctgcatctattgagaggatcatatgatttttatccttcatcctgttactgtgttatatcacgtttattgaattgcatatattgaaacaaccttgcaacttagggataaatcccactttatcataatgtgctttcaatttggtttgctagtattttgatttttacatccatgttcatcagggatattggcctgtagttttcttgttttgcagtgtcccggcctggtttgggtatcagagtaatgcttccctcataaaattagttagaaatgctcccttcttttttaatttttgaaagggtttgagaagtatttgcattaattctttaaatgtttggtagaatttaccaatgaagctttttggtcctgggttttactttgttgggatttttaaatttttgattcaatctccttgctgttgcctgcttcagattttctgtttcttcatgaagactctgtttctcagcaggatatatgtggctaggaatttatctgtgtctgtaggttatccaatttgttggcatatagttattcatagtcttttatgatcctttttatttctgtggtatcagttgttaagtcttgttcaattctgattttatttgagtctgatatctttttttattagttaatctagtcaaaggattgtcatttcattcatcttgtctgaaaccaactgttttgttgaccttttctaatttttaatgtttttatttcatttatttctgctgtaatctttattatttccttctttgtgctaactttgggcttagtttactcttcttttttttagttatttgtaaaggtttgttgtttatttgagatctttcttttttggtactgtaggcatttattgctataaacttctttcctagaactgcttttgctgcatcccttgttttggcatattgtgtgttcattttcatttagattaattttttatttatgtttgttttcttatttgacccattggtttcccagaaatatgttgcttaattgtcacatatttgtgaatttccaattttcctctggttattgattcctagtttcatactcttgtggtcagaaaagatacttggtgtgatttcagtcttcataaatctgttaagacttgttttgtgacctaatgtgtaatctgtcctggagaatgttctgtgtgcacttgaggagaatgtgtattctgctgctgctagatggaatgttctccatctgtcttttatgtccatttgatctgtagtgtttttcaagtccactgttttcttattgattctttttttgtggatgatctatattctgtaagatcagtaacaggataatcttgctacttcttgagatcatgtttggagattctatcagggaagtgcagctacttgtgtacccttgatcacagaatggtactcctctattgaggaacgtcatcctcttcaactaagtgctcagcttcaggagaaaagcacgtgaagcagtgaaggaggaaggggatctctgcatagccagtgatctgccaaatcaaccctggtgatgaatgagttgacagatgttgcagtcagattgctttcacataccaatctttctattgctatccaatattgtactgcaagcctagttagagaaattagataagaaaaagaagtgaaaggcatccaaattagaaagaaagtagtaaaattgtctctgtttgaatacgacatagttctatgtatagaaaaccctaaagactcaccaaaatactgttagaactaataaatttgggaaagttataggatacaaatcacatacaaaaatcagtggtgtttcaacatactaacaatgaactgtccaaaaaaaaatcccacttacaatagctacagaaaatacttagaaaaaaattaaaccaaggagataaaaaatttgcatactgaaaactataaaacattgatgggagaaattttgaaagacttgaataaatggaacgatatcccatgttcatggactggaagaattaacattggtaaaatatacaagataatctatggattcaattcaatcctatcaaaatttcaatgacatttttcacagaaagagaaaaaaaatcctaaaattcatatggaaccaaaaaagaccctgaatagccaaagtaatgttaaacaaaaacgaaacacaacaaaaacccaaaaaacaaaacaaacaacaacaacaacaacaaaaacgaagatgaagacatcacacttcttgatttcaaattctgtggcagagctataataatcagaacagtatgatcctggcataaaaatgaacatatagaccaatggaatagaatggagagcccagcagtaaaatccacctaaatgtggttagctaatcttcaataagggtatcaagaatacaaaatggggaaaggataatctcttcaacaaatgaattgggaaaactggatatccacatggaataatataaaattggatcctcacttaatactatagaccaaatttaactcaaaatctattaaaatcctaaacataagacatgaaactataaaactacttgaggaaaacttagggaaaccctccttaacagggtcttggcaatgattttttggttatacacaaaaagcacaggcaacaaaagcaaaagttgacaaagggattatattaaactaaaaagcctctgcatagcaaagaaaacaatcgacaaaattaaaaggcaacctgtgtaatgggagaaaatagttacaaaccatatatatgataagaggttaatgtccacattatataagaaattcatacaactcaatggcaaaaacaaaaacaaaataacctgatgaaaaggcatgcaaagaacttgaataaacatttcttaaagaagttatacagacatatatctggccagataaaagaaggcatatatctggccaacagatacatgaaaagatactcaacatcgctaattatcagggaaatgtaaatgaaaatgaaaatgatgtacctcacacctgttgggatggctgtaatttaaaacaaaacacaagtgttagcaaaattgtggagaaaagggaacaatgttacactgttaatgggaatctaaatgggaaatttatcattatggaaaacagtatggaatttccacaaaatattaaaaatagaactgccatatgatccagaatccaacttctgaatattcatacagaggaattgaaatcaggatcttcaagtgtcatctgccctctcatgctctttgaagcattactcacaataggcaagatacggaaaaaacctaaatgtgcattagcagatgaactacaaataaaatatagcatatacatacaatggaatcttattcagcctttaaaaagaaggaaattttgccattttcaacaacgtggatgttcctggaagacaatatgttaagtgaaataatccagacacttacatgtgggttctaaaatagttgagctcatagaaacagggggttgccagaaactgcagggagaaggaaatggagaggttatggaattaaaaacaacaacaataacaaaaaacaaagaaagaaaggaaaacacaagattttattgagctcatgtgcataattcggagtattcttcccatctcaaagtctttaatctcaatcacatctgcaaagtcttttttgctatttaaggtaacattcacagattctgggagttagtatgtgggcacctttggggaaatattctgcttaccacaaccagtttcccaagattcaaggtagagttcttctttaatattctcactgtatatggctataagcagtttaacaatccattgatatttttcagaaatcgatgatatcatttatttttaaattacagtgtaatgtacactgaatagaacacacagattttcataaaacacacataatgtcttttgacaaatgtctatacctgactatcaccacaaattataaaatatttaaatcaccccagaaagttccttcatgtccctggtagtagacctagatcataggcagacactgatctgttttttcatcataatctatttgttcctattatagaactttatataaatggcagtatagagtatgtggtcttttctatgtggcttctttcacttaaaatgtttacgtgatacatccatgctcttgcatgggagtttgttaacttttactgctgagtagtattttatgaatatgaactaatttgttgattcattctagttttgggctatgatgaaaaaaactgctataaagaaacttttccaaatttgtttttggacatatatttttatttcatgtgggtaaatgcctagcagagaaaacaatgttacagcttaactgtatgtgtattttataagaaaatgacaaactattttccaaagtaattaccactttatttgtggaatctgtaatgtcagctttcttattcctgagagtggtaatttgtgcctacattttatttgccttatcagtctggctagaggtttatcaattttattgatcttctaccagcctttagttttgttaatattcgttactttttttctgtttcctattttactgacttcatcattattatttctcttttttctccagacaatatgttttatttgctcttatttttctagttttcaaagtggaagctgaggtcatagatttcagatttttcttcttttccaatacagcatttattgctataaatttccttctaaatccagctttatctacattctgtaaattttgctatgttatattttcattttcacttgtctgattttctctttgagttcttttttgacacgtgagttattttaaagtatattatttagtgtctgattacttgggcattttttcagctatctctctttaattgatacataatttaattccactggggtcagaaaacattttctgtagagctttaattcttttacatttattgatatttataatggtataattttttatctcttcctacagtttgtattactttattgtatatttacttttatgcatatgtagattctcacatttaattattaattttcttaaaaagttgaaaaattttaaacaagtttaaatgttggtatatgtttatatgtgtttgtgttgtatgtttgtgggtgtgtgtgtgagagagagaggaggggagagtaaaggaaagaaagggagagggagagggagagagagaaagagagagagacaaaatatgtacatattcatcccttgatatattcacaggggattggttttagaaccccccttaaatagctcaaatcccttacataaaatgttgtaatatacacatgtagcttatgcaatcctccgtatactttgtcatctctagattatttatcatacttaatataatgtaaatgtcaggtaaatcgttgttatgctgtgttttctatttgtacttttaaatgttatattgttgcttttttattttttctaaatctattttatctgcagttgatataatccacagatacagaacccatggatacaagggtcaacagtatacgtataaaataaagacaatttatggaatgtcttttatatttgctcacatatttaacctttctagtgttctgtattcatttgagtcgatccaggtttccatttggtatcatttcctttcaatctgaagtatttctttcaacatcgcttgcaccactgttctgctagcaacaaattctcttatcttttgtttataagaaaatatttttattttcctttaatctttggttaatattatcatttgatatataaaactatgttgacagttatttcacactctaaagatatattttcaatgtcatttttttatttttgtctttcctttttttgaaaattagaaatcggctgtcatgcttgttgaaaagatgtatattttttctctggttctttttaagagtctttatgtagtttaatgattaggtagaattcctctttttttttccggttgaagtacattgagcttaatgtgtggcttgctgtttttaataacaattggaggacttttagctaatatttcttcaaacacaattttctgccccattttttatgtcctctgtttctgagggtcctattacatgtttatttcatcacttcggtatggcccactggacattgaggactctgttcattttcttgagtctcattttcttctttgcacttttgtttttcttgccctgtctttaaattctttgtccttgacctctgttgtgttcaacctgctgctaatatcatccaaaaaacttttcatttcacacattgtactatttacttctaggattcccatttagttcttttttacactttccagttctcttttgaaattgtcacttcaccattatattcatcttttcctgtagattgtttgacatgcttataattatttttcagatttttgtcttatacttctgagtcatttgtgagtctgtttctattatcttatttttcacttgattatgagtctcttttttctgcttctttgcctgtcttgtaatatttgatcatcttctaggcattgtgttaaagaaaaagaaacagtggaggcttaaaagagcttgtttctttggagtttaattcttttaaaagtttctttgtttgtgaagttattcaattatttaaaggaaaacatgcttctctggggcttctttggttatctattgttactttggcagactgaaggttttgcacatccttcttcttcctagtcaggtgtggatctccaaaacagattcatatttgagaggggtgttgaagctctttgttgtttccaattttatgggtcatactcataaaggacaaagtcaagtgatgacaacaggggcacatttatttatttatctatttatttcttcaacttaaatggaggataggacaaatatgttactaaatactttctgcacatccactgctgaaaagctacctaaatatctgagaaagggataaatcttggcagttatacatttactttgtgggaaactaccttgttttcaaccttcttgcctcctgttgtaccagtgctccaactctttctgaaagcttaagttagccaaattatggactgacttacaactctgaaaagtttcaaacaaataaacacttaaaaactttgggtgaagtaaaaggcgagagtctagctattactaagattttttgttcaggtaccaagacctgtcagctagttgtctggtctatggtgttcccacaccacagtccatttccttctaggatgttagtccctccgtctgcatttctgaagactaaaatgtcagtttctcatttgtagttttaactgcctgctttatggtaattggatctgcctatttccagcctcttcatctggctcttggcttcagactgtcgggatttcattacttatatatgctttagcttatactgactaaaaattgctgcatctttcttcagactctacatcactccccgctctaaaccttgctgagcttttctcagtacctgacacctactttgcacttttaaacaaagtcctgatattttaaaaataacataaatgggaaataatggttcctgaaataaattatagtctttagcatttacttacaaggttttctactgctatatttttacctgaatatttaaaatatagaacaaataaataacataaaatgaaagatatcttccaagtaatttatgtttgtttttatctttgatagtattaaatttgatatctgctggtttatgtatattgcggatgttccttgcttttttgtttcaatctctgcaaaagacattgtttggcttttttgataccagtgttcagattgtacatatcatacacacttggagaacattagtatttttcacctctgtaattttatatggcagcaaatttcattcacatgtgcatgctcaccccccaccccaacttgctataaaatgaaaaggctggtcaattgctttgatgttctttatatataatgctattatgtacctaatgccacataatttaatttctgtggtcaaaatttgtattcaattgcctagtttttactaaattgatcacatttacttgttggtagctattctactagtgtatagccttggaaaattagagtttaatgcaggaagaacatttagaattagaataatataatcaaaactaaaatcatctatccaaagaacctagacattttgataatagttatacaatgtacattgcaattagttactctttaaatttttgaaattttataaatctgattgaaaatgtttataggtaacgaatgatggtgaaaatatttgtattactgttgattgaaggcacatctattgtagtaaaatatgagtataagagaaagagatattacaatggggcattcgttggtacagtctttatagcccagtataatctttgttcaagtcatgattattactcttattgtgtgttatgatcttcaaaaaggctatgaacttctgtcttaaaaaaatagtgtcttaaaaacaaaaacaaatcttcttcttccctaatttattttttttttgaagttttgcatacttgggccatatttatatgacaaaaaatatctgatttttttttgatcaatgtgatccaaaaatcagtcatgtttcaaaaaatttggccaattgaattgttgggccttatgtcaaataaaaccactgcttgaaaactaaacaaattgctttcaatgggttattattgccttaccaagaccacatcctgatgatttcccccgtcacaacaagactttcttcatagtggatccattgttattattttcataaaaggctcaacttaaattacatgcaatagaagcaccatcatcaggtgccctgtctccttcctaacagaagcctggtttttcacgaatgcatttagtcctgtctgtagccccagttttgacaggctgaaggctgtaggcatgatgggccgcagatgccaggcttcttaagaactgttttccagtgctgtcaacaaactccctccttccagattctttacagagcagggctggcagctgtgcataggctttgggatccaccatccagttacatttctaatgctgggctcttgttttcctggctcccttgagctggctcaaagaaacaaaatggtattcccatatgtcccttattgttttcttggcaaatatccctacttccctgaatctcccagattccagcatgtgagagacaaattttctttgtgaaaattccctccctcaaaggctgcagattaatagcattgattctaaagcaaactgtctttttataaggtcttttgtaaggctgaagttagctgggtttaggggctatgttagcatattcggaaatattatgcatatggtaaaccatagcaatacaatacaaaggcaatacaaataactgagcttgatttactaatttgaatgtcaataccaatagttcagatatgaagagatgcctattgactgagtgatcctctttccctttctcataaagatttatgtgttaaggcaaaacaactatctacaatctttagtagacatatgcatttatttttacttctaagtaaagcttaattccaataaattgaagttaggaaggaagcattcaactttcatattattgttgccataatataaatcacgtggaactatttttcatcacagagattagtgtagctaaagaggaagactttagaacacatcaaggatccatagttactattgaacagcaactttgaatgtgagctagtataggcatattgaataaatgatgaactgtatcatattcatactggttaatttgagattgccagttatttaacaggatattaactgtagctatatctgagccatttctgaaaagaggaatcggagccaattgttgcacaagctcttacaaggtcaacaaaaccaagggaggtgatgcaggaggaaagacttcgttttctctctctgctcctaaattggtttctggtcatctaaatcccccaatccattaccagagagtgagagcaggggaaggcagtattcattcattccaattttcatgcatgatctaactcaacaatttttaacgtaccagtgacttcaacaaagacactgtgtttaatttccacggaacaatgttcagtttctttagataaaacaaaatggaatcccatatcactatgttaagtgtaatcaacaccattttggatggggaagcagtcacatataaatgacctatcagaggtattccacaaggacctaaagaattttgattgtaattttttgggccctattcaactttacccgaataaaagggggaaaattcttataaataaacgacttaatatacctaggtgagaagttttttgttttttttttttttgaaatggagtctcgcgctgtcgcccaggctggagtacagtggtgcgatctgggctcactgcaagctccgcctccggggttcacgccattcttctgcctcagcctcctgagtagctgagactacaggcgcccgccaccacgcctgcctgattttttgtattttttagtagagacgggtttcaccgtgttagccaggatggtctctgtctcctgacctcgtgatccgcccacctcggcctcccaaagtgctgggtttacaggcgtgagccaccgcgcccggccgagaagtattatttatattgtaaggcctgttacaacaaatatcacacactcattcccccaaaacaaaaacaataaaaaaaacccaaagagggttcaaccaataacacaaatgcttgaagcagtgattttccagaacaaaattttagtgtaatagaacatttggatcttttttccagttaaatctttcaaaagcattatgtcctgaccatgtttctgatttcttgacctctgtacaacttaatataaaaaatcagaagtttattgctgtaaatattttaaaatatgttaaactagctaatgtatactttattttcattatgcttttgttctgtcatcaggtaagagacgtgtacacatggcaagcaagatgattgggaggttagaatgggcacttgctggcaaacctatttttgacggagaaaaactgtactatcccagcatagtcatagaaactgcaggttctggctgctttcaacccttcttttttaaaagacccaaattgcctatgcacaaatatatttaataattataattatcattaagtagcaaggtagattaaatatcctcagtcattcttcttaaaaaataaaaacaaaaacctcaacctacatttaagcaaaaaatgcttcttaaagtcattttcaaaattgataatgcatcgatatgaatttgggtagctgaaattttggcttccagtgaaatagttcacacacataaaacatcgcatgcgaattttgaattcagcaaatgtattggaagtagtaattcaaccatcacatcttcacttggaaatacatgctgtagaatttttccatactgtgcttgcttttgataaatattattttactgagcattgatactttcggacatttagaagtaccttagtgctgatacttaagcactgggaggtaattattgaactctaaattaccagtacactcaaagagaaattttaaaaacagaatcccgatcagctggtctgatatgctcaattagtttttggatagtaggcagttatattatacataaaacatttttctctgtatgattttttattttgttatagtttcctaaaatagttatatttataaaacttaagtaaaaatctaatatttgatcaactactttcaacaaagaaacacaatcatctcatctcttgtcagtttataaatgtcacatagacttactattctctgcactgcagctatacctttaccaagaataagtatataaaaattagtaagtagctagcaggactactgggtattaaaggtagtattaatttaagttctggctcattgcttagtgtttgttaaagtctgaatcatcttgacgttttgttctgcattctgtatttattggctgattctggtacacgatgtgttcttactctcatcagtggagatttgacccttatttttcatgattttgaagcctaaattactccatctaggttggaattagtagcagttcttaccatccaaatactatttggctatggggatgttagagaaatggaaatatacgtttctgttgcccatgggacaatcttaatgaatgcagcaagtaaaatgatcatattaatttgcactttcttattttctgtacctatccttgccatagcaatagacttagtttatatgaaattaaaaaaaaaaatgtctagccaggtacagtggctcatgcctgtaatgccagcactttaggagactgaggtgggtggatcacttgaagtcaggagttcaagaccagcctggccaacatggcaaaactctgtctctactaaaaatacaaaaattagacaggctttatggtgcgcacttgcaatcccagctactcaggtggctgaggcaggagaatcacttgaacccaggaggcggaggttgcagtgagctgagatagcaccactgtactccagcctgggtgacagagcgagactccatctaaaaataataataataataaataaattttaaaaaccaacaaaaaataaatgtttaaattggttccagtgatttgcttactgcctgccctttatttgcctaggcagagtttcactatgtatataaggaacacaaaaataaatctgacattttgataaatttgcccagaaaatgtgaatttcatcagttatgaaaatagactagtctaaaatgatcagattctttttttttcaaatccagttttgcatatagactatgccatagattttctttcctggataccacatggctatatttggcaatcaaatattctcttgtacttccgcatatggtcccaccggaaaacatcatttcttccctttaaactaaggagaaacatccataacaccaatctaaacaacagcaagaaagtaggaatgtgagtattcagtccttgaaagattaattgtcacttttggtgacattaaaatactgccaaagttctattattagtcatgttcatgcctgaagagaaagtaaaacttgagaagaaatgttacaaatcagtttattaaaataaaatctatgtcaccattaagttgactgaaatccacagaaaggtactataggatatatttgcttagattaactgcttggtctttgtaacttaaaataaaatataaagcaaagagtttttccatgttattatgtagaaaaaaatctaaattgtattgcataatatggcatttgtgggttttactacaacaatctaagatgctcataagtttaaaaaggttaaatatgaatatattcccttcaaagttcgagaaacagatttgttttcataaaatgaaaaaattttctatttttattaccattaaatgagaaaataagaaattaagtcactgaattctttcttgcatatgtcttctgatagttatattttgtgagactagtagattttcaagtcctttgaaaaacagtaaattaattatttaaaaaacttgttgagaaattctcattgaagagagacatgttcttgagccaaggagaaacttggttctagtataatatagaacacatctttatgtcagaaaaatactatacaaattccctgttaggagactcagaattcggtgagaaaagcagatactgtaagaatagtaatcttattttaaaacattttcacagtttcatcaaatcaatgattttattcattataaagcacaaaatattttatgtgttttaagaaagaaggtgttgtgctcccaagtctaaacagcaaccttctcccaaaacctggggtgcaaaatcgggggcccttgagagaaggaaaattttctagcaaagcccagagtagaggaatggccagagggagaggaaaaaagctagggtagtagctactcataaatctattttatcatcctttactggccactatatgtcagatactatgtaaatctagcagctaaaatggtgagcaaaaagtagatgttttggggagtggggaggaggacattaatcgtgtaataaacataataacaacaaatgtattaaataatcacaccaagaggtgtatcattagaaatagagatgagttctcagaaatcggggttggcaaatctctaagggcatattatagagtgtcttagtccatttgtactgctgtaacaaaataccacagatgcagtaatgtatgataagcagaaatgtatttactcacagttctggaggctgggatcaagtccaagatcaaggtgccagcagatttgattgtcttgtgaggtctttctctgcctccaaaatggcactttgttgctgcagccacctgaggggagggacactgtgtccttacagggtagaaggcgaaagggcaagcccaccaaaggctgcaagaagcctattttataatggccttatccgatttatgataggaaatgctctcatgacctcatcgctgcttaaaggccctaccatttaataatatcatattgacccttaagtttcaacacctgaattttggagggaacacatttaaaccagaacacagaggaacttgatggtgactgatagaggcttaggaatggtttctctggtgaaatgatgttggagctgaaatgtgtggataaggaggcattattcaggcaaagggagggagtgggtaagtggaagacatcccacatagaactaggagcataggcagagccttgtggctgcaggaaccaaaaggccagtgtggctgcggtggagaaagcaagatgaatggtgatacaaaataaaactgatgcagcgggaaaaggaagatcaactgtttttctgtatattcacaattaacatagaacacttcagacaccatatgtatgtgttttttcctacagccagcaattctccaattatctgcagacactgactggatgtcctacagtttaactcaattctgacactctctacctgcagatagaatcagatctcacaagttaagggctcaatcccacaagactgtccccacttcagatgctggttgcatgtccaggttttcatctgtgcctctgcccagttggctataaatcagatgttattacaaccccctctttgtgtttgattatgctaggataacttccagaactcaggaaatcagtttacctactagattactgttttactatgagagacacaactcaggaacagccagatggaagagatgcatgggaagaggtatggaggaggggcacaaagcttccattgcctctccaagtgtgccacccttgcagtttctccacatgttcaccagcctggaaactctctgaaccttatctttttattctttgtggaggttccatcacatgggcaagattgatcaaattattggcccttgataatcaactctacctccagcctctctctcctccccagaggttgggctgtggggataaatatttcaatcttctaatcatattgttggttcctctggaaaggagccaccatcctgaggctatccaggagcccccagcccccagtcatctcattaacatacaaaaagacacctttcacttcagagagtccaagggtttggtttttgtttgtttgtttgtttgttgttgttgttgttgttgtttgagatggagtctcactcttgtcgcccaggctggggtgcaatggggcgatcacagctcactgcagctgccgcctcccgggttcaagcgattctcctgcctcagactcccgactagttgggattacaggttcccgccagcacacctggctcatttttgtgtttttagtagagatgaggtttcaccacattggccaggctgtcttgaactcttgacctcaggtatccacctgccttggcctcccaaaatgctgggattacaggcgtgagccagcacacctggccacatatttcttttttatgtcataggtgaacagagaccagatcaggcagttgactagtcttaaatgacttttcttctgtgccagattgcctggaataggatcccagcactgtcacttgctagatatgaactttaggcaagttctttcatctttctgtgcctcaatttcttcatttgtgaaatggggataataatattatctgcctaacacaagttgttaggattaaatgggcaataaaatattagattttattatgtatcatagtatttgtattttgttatttttgtattatatattctgctataacattatgatataatacttttatttgtcattttgttctgtttttattaagacttaatatgttttttattctgatggaaataacccaataaaagaaaacacaggctatcaaagagggagagaggaaagctgtgagtgagatgtccttgaataggtgagagggactaagattaagtgcacatgccaattaactgttctcacataggatcagggatggtggggtaggtgggtagaatttctggtggaagaatgtagacattgtatttgaattgctgctactatctagtgaaataagaagaaaagtcatcagcaaagggtaaggaatgagcagggtaggagattggaagaacgaaaggaaggtagaaatgctcatctgaaaggatgggagagttcattgttaaggactatagtatgattgctgggcaccacgtagagtttatttaaggttttgtggttgtgaatttagacaagtcatgtggcttttagatatgcttaggtgcggggacagagcaggtgtgacttgtgtttaatcaggatggcaattttaccatgggagtatgttggagggagaaagtgacaaagtgattgaaagtatgtctgtgcctccccaaaattcatatgttgaagccctaatctccagtgtgactgtatttcagtacaggcctatgaggagatgataaggatcacatgcggtcttaaggtccccagtgagataggctggtactgttgtaagaagtggaagaggccaggcacagttgctcacacctgtaatctcagcaatttgggaggctaaggcaagtgatcacttgagctcaggagtttgagaccagcctgggcaacagagcaaaaccccatcttcactaaaaataccaaaattagccaggtgtggtggtgtgtgcctgtagccccagctgctctggaggctgaggtgggaggatgactttagcccacgggttgagactgcagtgagctgagatgatgccactgcactgcagcctgggtgacagggcaagaccctgtgaaagaagaagaagaagaagaaggagaaggggaatgggaaggggaagaagaggaagaggaagaggaagaggaagaagaagaagaagaagaagaagaagaagaagaagaagaagaacaagaacaagaaggagaagaagaagaggtggagacaccagagcccgctttgtgagtgctcagatgaaaggcacttgagggtggcagagggaagacggctgtctgcaagccgcaaagagagctctcaccagggaacaaaccctgctggagctgatctgggacttccagtatccagaactgtgagagaggcatgtctgtgtgcaagccacctaacctatggcaacctgagcagaatacacaaaggaagtatgctggtgggagaaagagacaagatgactaagtgtatatgcaaggaagtaaatttaatgatgggtctgaagtttaacccagataagaaggaaggcaaacatggtggtgggggtgattgatggataagcaaacataaatgagatgaatggattggaagtcccagtgcagatgaagctataactggaatgataggataggagagtaggatgcttgacattgaaatcatgaaagtgatgttgctattggtaattatagggtctaggaatatgactgtaaaaaaagactaatgtattgaaagcaaagagtcagagaactgagaaatcaggatattgaatggattgtgtgcatgttggaatcatatagtgagagctctctttgtggcttgcagacagccatcttctctctgccaccctcatgtgcctttcgtctgagcactcacaaagtgagctctggtttcttatccactgtgtggatgtaagaataattactggaggagtaattcaaaaggcaggaattcaaaaggcagcatattcaatgaatgcattcagatataactgcatacatttgagtgatatataaaaacaaaatcaacaggaatttgtcatgaaataaaaggggatggagaaaagatagggagaaggtgccattaaagagaactcattggtctctgacttgagccactggatcaatcatggtaccatttctaagttagagaaggctggcagaaggccagaagtttgattttggtatagagtttcaagtgactttgatatatccaagtgatattgagtacatgggctaatatatattgggctggttcccagagaagagtccatcttggaaatagaaatctgtgaagtgtatgagatgggtgatggctgaattcataagactggtggccttgcctaggaggtatggaaagagcagaggaaaagacaaagacttggacttgagtaatttcagtatttaaaaatgagaagacttagtatgagcctccaagggagattgattaggaaggggaaaagtagaggaaaaccaggagagcatgaaattatagaagccaagaaaagtcttgtgaaaaggaagatgcagccaatagtgttgaaagtttagggccagaaggctgagaggaaaaaaaaatgaccttggagttagtagcatggcggccattggtgacttttgtaagagcttctttagtggactaatgaggttggaggagaaattagaggttgataactgaagcagacatgaggaaaaggagaaagtaggacagaccaccttttcaagaatgttgactattaaaaggagaagaagaaaaacgtgggagctggagggattgatgggattaaggacaaagattttatatatatataaattataaaaaatatatatttgtatgtaattataaaaatatataattatcaaaattatatagatatataaaaccttcacatacacatatatacacatataaacaaatacacacatatatacatatatgcacataaatatacacacatatcgtatattatgtaatttatatttatataatatatataatgttatatttatataatatacatttttaatatcagaagcttgagcctatttgaatctcaatacaatgtctataatttggaggggaattatacaaatgtaacatgttagtgcgaaaagttttataagggatggtagaaaagcaggaaggttggggtccaaactgcaggcagtgacacagattttagaaggactaacaccttctctagtgtgacagagaataaaggaacccagattgcattaggactcagagtcaggcatcttactgtgttctatcttctctttttctgagtgatacaattcatttttacaagaaagtattgtgggggtaggtgcagtggactttgtgctctcaaagcagcagtgaagaaacaaggacaccaactctgccttctgctgcaggcaggtttgtgaggtatgagagaggaaacagctaccacttgagcagattgtgggagaagcagcgttttgaggtttcagctaaggaaaggggggcactcagaaaatatatggaaaatgtagaggagtttgatattcctgagagcacaatgcgaggtttgggtggatcatgatgactgagaaaaagtttgttgattttggcgagaagaagatcattttcaacctaagattaagcagtttcagaaatagtttagcagaatgatggaggttcccacaaaggattatgaagtgaaaagcagatacttcgttcaaggaatttggctgtaagtgaaaggaggaagagagaattcaagtctttttttttttttttggttttgttttttttttaataatccaactaattacctatgagatttcatttccattttgtttcttaacatgaactctagagtcaggttgactttcttccataatgctttctaaaatcctttcttctttgttgtcatgctttaactcctgcctaggatgccctaaatttttttttcttcctttgtaaacacaacttttctggtaagacccattaacatctacctctcaatattatctgttatatatattttttccccattagataattcatttttgttataaaactattggaaaaatatgtgaaatttagccgggtgcagtgctgcacagctgtaatcccagcactttgggactccaaggtgggttgaatgcttgagcccaggagttcaagacaagcctgggcaacatagcgagacctcgtctcaaaaaaaaactatatatatatgaaattataaattaaaaataaaataacccacattaaaccttccttcgtatatattatactatgtatattattaatactaacacttcaaaaatttacatgataaagtctttttgattccactaaatatttataacaaaatgttaaagactatctaatagtccatggtatttggttttccctattataaataagacactatcttttacataattgcttgtgtacatagttaatggcacccttaaggcagaaattttttaactagatgactaaatcagaagataagtatttttttaaggctctggatatatagagatgaattattttctagaaagtatctaatgaattatccttctacaagcagcatatgagcatttagcgtacccccctccattgtcagcatagaacattttctaaaaatttaatttccagggtagaaaaatggcttctctctgggttctaagctatgttcatttaattactaattaagttgaattttttaatagctactggttactgggtgttttcttctttgtgttgttatgccatacctttaacccattaaacatatttttaattgaatcacaaaagttttagcgtggttgatctaatcataaaagttctttacatgctaattatattcttgtattatatattgttattttcatcctattggtttcccagtgaaccatgtgcatctgtcataagctttaccaaattctctattctcagaagtcctgcagcactctatagtgtcaatctaccatcttaatgtttcagtctctattatcttgtgttgttcattgatagttcctttcatattaatatattaccatcagagcgatagtaagtgtcttaagaataagaacagggaatatgtttatcaccattactagatttctaattgacattatgttatatgattctaatttgtttattagtgtattattatatatattcaacaaaatatatagcaaattaactcattgtgtgttaatgaccataacattctggaaagatatgtgtatgtttaaagacctagagaatagattagttttctcaatatttttatatatgcagtaaaagttttgaaaaaaagtctttggggtaggttgaaattatttcaaaagttttaggattgtgtataaaacagcattaacatgctcttttgagcatgttacttgaaccatagttgagtgaaaggtggtgtgaaccatgtgataaatgattacttcacgtcaaacaacccaacttttctgagcatgctggctttgcaaggatttatagttccctgccttcatgccggagttacttcagctttccgtgatgcattccaactaatctggaggttaaggcatttcttgatcatggatagatctgcttgcttctcagccctggaattctttataaaattccagaatgcaggctagaaattgacttagggaatccaataaagttgcaagtcttggcggtcatccaagctaaatttatagactggaagaaatatgggctttccattgttctctttttcacctttctgggatttcttttgtgtctatgtgagtgtgtgagtgtaaatttatcattttactgacattggagtgtaaataaccatcaaggagatccagttaaagaattttcactttggatcttctctggtctttccaaactttgacccaaacctgcaccaagagtgaatttcttctccctctgtaggatgttgatgtcataaaataaggagttgttcttgaaaatgaatcatgctagtttaacagctgacatgcatgtttgccagctagctgcacctccccaaatcctgcccttcccccgactcggagccttcttttgggacatgatctgagaaaatgtgatcacatgtgttgtttctcttcattctatgactggcaatgggggaacaaaaacaatctcggaagcgtatgagacttcagttttgtgtgtgtgtgcctgaggcactgttgtgcctggagatccaagcaatccctctcctaccctctccattatatctgaccattgaaaacctgtcttgttttcacagaatgggtttgctgttgtgaggccccctggccatcacgctgaagaatccacagccatgtaagtaccagggactgttgcccatctccaagcaccacggttcctggcggtcacctgccccgtgcatgtttctgaagcctctaattgttagcagatggactgaaaaatcttgcgaggtactcccagaagcagatttatggcttcagagatcatatagcatttaaaaaaatgctctgaacattatttataatggttttcctggatgatttgctttcttatttctctgttcttctctattccgcagggggttctgcttttttaattcagttgcaattaccgccaaatacttgagagaccaactaaatataagcaagatattgattgtagatctggtatgtattcctggccagagctgcattttcagtgattctagataaaggggagtggatttgtatttctctgttaggttgtcttgcttttagcacttgcaaacaactgaagggtgtgttttcctttgaatgtggaaactcattaaactcaggattgcagttctgaaaccataaacattcacgtttcactttcatggtgttaactgcaatttaatgagaagaaggcgcagatcagggcaacttttatgatccttaaatgaattgatacttccacagttaaaataacccaacagaacctgaatttacttttccctacagaatatagactcaatagtcagatgtgctggaaagaatgctgttgctttggtaaccaattggccacttccccctggttagaaatcatgttgcttgttgtgcaacagtggtattattaaaacaagtcggcatgtcactcttactgaaaagatctccaatctcagatgccagtttgggatgattctctgcaggaaccctgagtgactgaaagttagaggcactagattagtcttgtattttaacgtgatgcattcttacacagtaaagttagaatttgtctaacaaatggtttgtttaaaagcagatgacacttggcatattgtccacagtatattcatgaataatgagctggagatctggagatctgccccatacaaaaaggaccaacccaggaaagggcgaaagagaagtgaatggtgatttatgagccccgttttcagtttgcctccagttctcaaggaggtgtaataggttgtctgacaaagcatagacaggaaatgaaccctggcatccaaaccgaacctggtacatctgcacttaattaatttttgcaggtgataaaagatttaaaggcaaaatatgctaaaggtttttttttgaagtgcaagccttaatagtctaaatcttgttcatatctgcactcataattaaatcttattggaagtcacggcctcgccctccagccttcgaatccagttaagcaggcacaccaaagggttgagagagcacaaacaaagccatgtgaagaaatgcttagttaagtgaaaacgaagataaaagaaatggaagaacgatacccatttgttgtgcttcgttgcaatgggtatttttcacacactatattgaagcattcctgcaagcactttggagagaagagtattgaaacctaactatccatgtattttccatacacgcctgagtctcaatgtcaggcatagctcaccgttaaagaaatgtgttgaaggcctagatatactacagcagcaagatgttacaattttacaaaaatcaagacatcagtacccattttctcatttatatgcaaaatgacagctaaagtaattaataattgctgttctgcataatttgtaagatattaaaactttaaaaatagtatgctcctctttctgtaagttctatgccagggagataagccagaaacttaagaaaagcagataaagagcaaagattgtagggaaagaatttttctaagctttctcaatttgtcaaaattatgtaagaaggtgattggtcaacagtttgtcctatccttagggatcttttagtgtttactttctaaagaatcttctctgctaccattttaaggttctaggaggatagtcaaaaactgttaggagtcccctttgaaaacacatttgtgatatctagactcaaaagtagtgaattgtacaagagacttgaaagctaaaatgcctcccttgtgataaatggatactttgtatttcagaggatgtatatgtaaagttttgtttttgtacagtaatacagtataggaataaaagactgctggaaaaatctgatacgatttataaaataagttacttggtagctccaaggagtttcctgtaagcttcctggcctttgattatgtatttgctccattatccaatcagaaaggatactgatttcccaacaggctgtagtagacgagaagtttttgtttcaaattatctaaatatatggagttctgtccaaagggttgcctctgagatcaccaccagcccacatattcttactttcaagtcttccaaattctgcagctgcagggctactttgaggaaattcctgtttcttccagctgctgagaaggaagttttaaggtgccacgtggccttgagacatccgttctccctggctgacaggtctattctgcaagttagcaatgaaaaagccaatagatggcttttccgtagccaaaaaaaaaacaacaaaaagttattcctgcaaatccaaagtcattaatgttagctggggggtgtgaactaactccacaaattacagcgccaatagatggcaaaggtactcctttgtccagcagtttcagcatttttatatgtttagtaaatgcagagctagagttctaatttgcctactactttgggtcacagccaaattcagcagcgttgagtattttaggcaagaatgattctagttgatctgtggagctcatttattccatgttcctttctgaggcagatcccaaacatattcagactagtgtggacagggagcaggtgtacttgcttttcaacttgcaagagactgaccattgtgtttaggggattaacttgtcctacaagtaagactgtatgactcaggtagcttttaggtaatgtgacttttattttgacaatagtactttttaagctgtctttgtaaaaggaaagttaattcaaatgtccttagattttgggaaattgcgttgttgatcaagtacatttagatctttattacaagtccctatactgagtaactaggagtgataacattagctgctagaatatatgatttattcaaggttactcaaagttattttaacataatagtgaaaatatacaggttctaaatccttgtacagcatcaatgtttgcagtatgctttttaaccagtaaaatatttaaacaatttttcagcatttccccacatatcttagatacaaggtctattttgggagttttaatgtttcattttatttcatttctatagtaatttctcacaatcaccaataattttcttatcttagtttattatatatgtgttgccatgaagaaacaagctttagatcatacctgaccaatcagtactttgtatgaatattttacagcaaggaaaacaaacaaaaaaatgatatatatatattttttttttcttgagacggagtttcgctcttgttgcccaggctggagtgcaatggcacgatctcggctcaccgcaacctccacctcccgggttcaagcgattctcctgcctcagcctcccgagtagctgggattacaggcatgcgccaccatacccagctaatttttgtatttttagtagagacggggtttctccatgtaggtcaggctggtctcgaattcccaacctcaggtgatctgcccacctcggcctcccaaagtgctgggattacaggcatgagtcaccatgcccagccttaaaaaaaatgatattcttaaggctatactgtgagttgttcccccaaacaaaagacataattgagtttaacctttatcactaaatatttggtgaatatgaatacagaatcaagaattgccccattagaatggatttatgtattttaataataatgtctgttgaaaatcttattatgctgtgaacaggattttatttcttactcagaaatttatgcactagtaagtacccaacagatttttcaagaacaaataattttatatctgagagaacatatcattttatatttgactgttttaagtaaacatttacagtgtccccagagaaacaaaagtaatcaaagcaatatttttctgctgttcaaattgtggatgcatttatgctcaaaccaaatgtgtcttagaactgattaaaattactattgtataggggaaatacaaatatccccttaatgttgtttttcaaaatattttatttgtccattttctagatatccagtaacaaacacaaaagacattgtggctttaattgtttcacccttgtttacatacaggaaaatagtttttttgtctcctccttcctttccttgggatattcagaaatccaggaattgatataatttgactaagttattttttttcctgatgatgtatgtctttagctgaaacaactttctgggatgatgtgtatgtgccccaacattatgatttcttaattttggatatgtgtaccattcaaaaagggaaaaggattattgtatgtctacaccgtggatggcaagatcaatgcaggttttcagaattcaccaaaagaaggctatgatagtgtctagtgaaggagtactgggctggagattggcatgaagacaggtcatataagtctcctatggagcaataatgactgacaacccacctcacaggtttgccaagaggatcaaacagattatgaatgtaagtttcagttaactgtgtaattgttaagagtttggcctttggaataggaagtagattcaagacccagtcttgcaacttatttcctgcatagtcttagtaactgaaactctctgagcctcagtttacctaataatccataccagatatttatatagtgcctgacttaaaaattgtagaaatcattgttgaaaatagcatgattctatatcttgctaatataaagtaagtatatagttacaagttttaaaacttttaaataacagaaccggaaactatgtatgtttaaagtatagcagtaatattctattgaatacaaatatataaattatccacttttggagtggctcttttttttttggtcagaagatattatgaagcatattaattgaggtgttttttttttacacttgaggtctttcagtgaagacatttaaaataatgctattagttctattgactttttcatttcttatatcaattctggcacgtatctgtatcataaaacagtgagaaaaaagaactgtcaagttttatatcaggctttttttttttttttgagtgggaaagaggactggtgtagggaaaggagaaaagagcaggaagaaggctgtaaagaaagctatgatatgatattaaaattaggcagattgcacaagattgcataaaaccccatgccatctttctgctttggcccaaatgatttaagagctaatgagctcatgctcctgcgtcttcgactcttgtgttaccgttttatcaaaatgaagtatgaagtttttttgcatctggcttctcttttgaagtgattctaactgcggagggattgctaactgaactgaacgcttcaagaaagccaatttattcagctggttgcaaagcctttgaccttaatggtgggacttggcaaatcaatgcatacacgtatgtttagcgttctgtcaagaattgcgaaaatgctctgtaagccatagatccttctgcaaaatactagtttgtagtttagtttaaacattagtcttttttcagaggccaatgaggctagttaattaagcctgaggggttatgaactgttggcagttaataagtcataaaattcctccataaaacaggatgcaagattccatcactgaagcaaagagtacaaagagccggtgtataaatatctaattgtaccaaaggactgggctttctcaatgactgctcatctggagtctccagggcatgctcgctgtggtttcctgatttttagaagccagtttaaaaaatgagtgcattaaagggtaatttgcctgaaagttcaggaagtaaagggggtggtgtggaagcaggctgaaagggagaaagaaaagaggaacgtagtgagaagacagaaaatgagaaagaaagtggtagaaagacagggaactagaaatcagaaaggttgtctccacacaaagttagacatgactgtatttgtcgtctgttttcatttccctgtaggatgttcaccatggaaacggtacccagcaggccttttatgctgaccccagcatcctgtacatttcactccatcgctatgatgaagggaactttttccctggcagtggagccccaaatgaggttcggtttatttctttagagccccacttttatttgtatctttcaggtaattgcattgcatgattacccctaattttcttgtcctttgctggtgttttaaattacacgagattactgaattgtcccatgggaccaagaaccagtgcagaacaagtgcataacccagagcactgtttgtcagggaaggttgggctgatttgatgtgttgtttgatgtttatttcaagagctcccatgtgcttgttttcctctcttcttgctttcttccatttgctctcttctctgcccaccgtggtgtgtctttctcttcccaggttggaacaggccttggagaagggtacaatataaatattgcctggacaggtggccttgatcctcccatgggagatgttgagtaccttgaagcattcaggttggtacttctttctctctgaaagtggcaaattggaaaataaatgtccattgaaataacaccaaatatggaagagaaatgtaaatgtctaattaaggtaaattatcgctcaaagccacataagaatatgtataagaagaaaagatctatcaagacctggttttgattatacaggtatattggccaatggcccattttcccccttccctcccaaataaggaggaaaaaatattttattattaaatagttctctctggaaaattctgcctattttaacatatgatgtggtttttacagtagacattagcatattcattgccctgagaagtccttcattacctatttgattttgttgaacaagcatttctcaaacttcattggactacagaatcccttttttacatagcaccatttagcattcctagttctggggagctcactcattttcatgacattggccaaggcaatctcatttgatggtagggtaaatgacttttgtatagttttcctttcacatgaaaacattaactaattaattggttgcttccattttctctggaacaaaatctacaaaatgtaacattaagtacagtgtattcacatagcattctgcttttgtctaagcaaataactaaatattaatataaataagaaaaagcaaatcaaaggcttctctttgagagaattttaaaaatgagcatttcttctctggaattaagaaaatattagtttgtagtttaaacgttagtctttcttcagaagccagtgagtctagttaattcaacctgaggagcctcccttgcaagatttttggaagaggttttagcctattggtaatgcataatttctcgaattttttatttagttgaaagcaaaacaaccacatgaaaaaaacttacatgtgttcatagttttgaaatttgccatttataagttcccatgaagaaaatcctgttgataccctatatttgaaacttgtggaaataatagggaaattttttaattaatgaagttttggtgggtttcttttgtcctgtgtgtcatgcatacttcgttgtcttatttgaagttcatttctcatgagaaagcaggtccaggaaaaatgatagaaaaatagctatttaaaaaatacatttaaaataaatatgtttggcttggcattcaagatacaaaggaaaattctacccacattctggaatgtgtactttgggaaaaaatatacacaaagatatccacaatgttgtagaaaaaaatggctggaataaaattttctaccgtcaacttgggttgattgtgaagatattttgctttaattaggagcaaaataaaaaattatgttaaaaaacagaagttttaatgttatgaattctctttttcaacatcacaaataccattacatttgcaaatttcacaaacattattaatatcttgtaggaactttaacaggataatagacttcaatattatatcacatatgaatttatttgtctgcctcccaagttaacctggtaacttgcatgatacacattaaattcatgttaaatacacattaaattctcaaccttactatctcatataatcatatccattatctttgatgcagaattcatagattttttaaattatcgtaattccatttggggtactatagctttatataaaaataaatcatgtatgcacagcaatgaaaggcaacttctattttgtgcctttgttttcccatcacaaagtgagcggtggatgagatttttttctaaagaacctctttgaacacaaccattccattacataatgtaaacgcagatattaagtgcacatattgttttgtgatttaaatggtaaatgaatgaagtactcctgaatggggttgacgattctcagaatggcgccttctctttgcctggaaggtggacactttatattagcaaacttttctaagcttcccagtgtatctccattacttgagtttcattagagaagtggcattatctagctaggatgcagaaatgtaaatttctggctttcaatgtccatatttatttaagaaccagatttaattcataagactcctgccattttgaactatggcctgtctgctattcatcatttatgaccagaagtacttgtgaatttgttacggctaggtcaaacaggtaagtcattcatttcaaaaaccatcattgaacacatattatatgctgggcactgtggtaagcacttggaattcagagctgttgttactttcagggatcataatatatgtcatacgtattattctagagaacagaagcgctcagagcagataaaatgattaacttgtcctcaatggtttcaggaaaggtttcatcaagtattgttcaacctgtgcttctaaagatgagtgggaactttcaaggggagaagaggagttggagtcgggggtattcatactgactgggcagagagagtgaactgtgaaatgcatggagccatgaaatgatctttctgtattggctcaaggacatgaggtgggattggtagaaagaaaatgaatcatattttgtaaactcttatgcaggcaaaggatagcccatctatatatgtatatactcctttgtcaatttgggcttagtcagatagactgccaaataatttttaatgtagtattattttctaagcttatccttaatacacttcttgtttcctagtattgaaccagaagatctttctggcatctgtgtgtgggtgcaggaaatggaggtgggggaaagagtaaatggtgccttttcttttctcttagtttttaattgtttctggactcttacaagtatcttttgaaggaaaatctctctccctgtgaagctacatttatagtgggatgtaagatcgctgcttattttactagccaaaatttgtcacatatattgccttcatggtttctattatgtgctttttctatagcaaaaaaatcatagacaaaccaaagatttcacatttactgtaagctttaaatagaatttaaaaaatataatagaataactaaattatttcaaatgactagttatttcttccaagcagttatcattcatctctgaaataattgaagggtatacttaagattcttcacgagaattcttaaaatattcagtatcaaatatcttttatgttcaactaaaatatatttccgaggttaccattgtataaaataattatgactatttttattggggtcttacatgccaggtcctagattagaaactttatagacattatggctaattcttaagtgctttatataagtcacggaactactaattggaagggcagtaatttgaacttagtttgtgactctacaatctatgctccttttctcacaccacattgctactctcttctgtttatgacttaaaatactcaggagtaataaagcacagtgactttttaccaaagtgtaagaccttcatgcccgcatagcctcccaacctaaggcacaaatgcctagtgaacaacatggcagagaagagctattcaataatatttggttgaatgagtcaatgaatgaatgaatgaatgaatcagagaagaaagagggaataatgttgtcaatgggagcattgtcaagctcaggtattaagcgaacctagcaaaagtctgagggaactaccttggcttcttaaaaactatgctctacaaagaactctgaacatctattcattttgttataagaatgtcagacttgtctttattgaacaaatcttttgctgaatgcctgctaaggaatctctgtttcaatcatttcaaaaggatgttccaatggttttatactctctacagtccattgatgaggattgggcacattattttttctaaagactaattcttttaagagtactgcaaatgttaaagtgattatttatgtcagaccatttaagtggtttgtttatagtgggcaagagacaattatgaatctcatgcttctgtttaaatctgagaaaaatatcttcaaatgtttaaaaaataagtagcaatttccaacgaataagattttatttagtagtccttgaaattatgcctgttttattaaataaataaacaaatgagtgaatggaggacaattcctttgtagccccttttaatttcaagaaaagaaatataagccccttcaatttagcaggtcttaatgaaataattaaagtgacccatctggcatatactgaggactagctaaagaaaggtcatagagctcttgatctgggttctttagatgcaaacaagttctaattttaaatatcatcttttcatgtcagtatgttgtagtatgtagctaccttaattaatatttgttgttgatgcatattttcaatagacagtgaatctgtacatatcagctcttcagggaagttcatctcaggggaaaactctgacccagaaggactctcttgcactgaggttgtcagtatgccaactgaaaaggggactttgagagagttgtctagtagaggtagtgcacatttagtcaaaattttgggggttattattgaaaactacctatttttattttattgacttatgtaggtagtatctgtatttaatcgaaatgctatgtgcttctaaatttaggcattactaaaatattttggacatatcattaactggaatttttagaagcttaatgtttttgctatatagtcaaagccattgaaccatttgagcacatacaagcagcccagtgtctatctctttctcctgtcttgagttcatatctgtttactttaatgacataagcaaaattaaagtccattaatgcaaaattgtgattggaaatctgtccagatatcctgtctattcttagttcacagtcaaagtggcaattctgttcctgatgctgagtctttaatataagaatcatggcttccggggattcctcccctgcttgtgacaaaaatgtagaaagggcatttaactcaagtgcagaatgaaataaaaccttttattgtcatatccacactgcaagtgctccttggacaagtcaataatggtcagcctagagatttcttagaatggttgggtttaccttggaactatagtagataatttggggcagggcacataaataagttaaatatatttttctctcattcttattttataaaatatatcatcattattctggctaattcttagaagattaacttctaaatattcttgttatatgtataaactgaaaaagaggtttctaaattctatttaagagataaaatgggaccacaagtaaatatttgcattcactcttttggtaatgacaattaagtaaatactgtttggattttttttgttcttgttcttatttttaatattttaatataatttcatgataagtgaatgtagaataataccattgtaaaaacaacaatataataataataacacagtaatatagagtattcgttgaggctttaatttttgctagttgttcatttttttaaaaagcttttcaagtccttgagttaggtgcttttgttttccacaggcagttaccacgcttcttgagcttcggtaggtttcctgatgtcacacagctggtatatggtgatcagggcttctgaggcagcaagtgtgattttggagacagtactttgttggtcccaaaccatacaggaactgtagtccctgtgtcaagagtatgggataacaaaacaatcatatagcgaaaaattctttgcaatgcattttagtctatttaactttggcttggacatctaaactggtaagtgccccaaaattgaaaatttagactttcactacccttgatatctccaagccacttctccttgtgtcttctcctcatctgacatagtaagagagcctatcaaattaaacccttggttctttttttccttttaataaccgatctaattacaacggggatataaatgttttcatctttgttaaaagaaatattcttcttatgtatgcatttagattttgtggaaaggatatgtaatagaacttgaaaataccaaattaaattttaatagaatatatagtgaaaaatgaacatttagatttaactttgaaataaagcatgatttcgttgtcatctaaaagtcatgcttaacaatgtcaaatgatttgggatcttaatttgtcaatgagagctgtggttgatgcttcccagtcttgcaatggattctcaattgttagtgacaagtaaatatattaagctcatgatatcatgtattttcccaaggatgttgaagacagtttgagaaagagggtggagtttcttgaaacaatttgccaatatgaaatactgtacatatcaaattggccctactaccatctttcccagaccatttatcatacctcacaaatccagcccacattttctctttctgaaagacttgactaataaagaagatgtgggcttcaatctgaacttgtcaatcaatcttagtaacaaagcagtaatgattttcatctattaatgatttatttcaataaaaagcaatacatatgaatttattgctagtgtgaaccacaattattcactgtccagattccattctctattttccgtatgttgagatgtttcaaaaagttttatcaaagcgggtcacaagaaaaaaaatccataggaataaatttgagaaagctgtcagctctatctgcttttcagcttcaaaaataaatatagtttaaggacattttttctctcatctgttcaacatattgtaccaattttcatcaaaaaattacaatttctaggtgtgtgtctctagatacccttagaatttctgctctttgaccctgagagtaaattgatcttatgcacacctgtcttcctagggaaacttgcaaacttgatttttgagccaagcatcaaagagatatgatattattagacagtatagagctcaggtaaaaagtccaggaagtatcttgaagtacttgaagttttgaaagggaagtgatatctgcagtgaagagctatttaaagtagatcaaatgctacaacttacttcttcttattgtttttaaaaggtcggatcagctataaaaattttaagacaatattttttctctgccttaaaatggttctaaagccaaaaattttctggaatctgtatagcaattaaacaattttccaaataatggggactaattaaaaggatatctatgtttaattcttttctctagaagttctttctaagaaaaaggtaatttgtatgcctagaagtgatttgtttttgttttgcagatgaaacactgaattatataacccttgcctgcacaaaatcctctcaatgtatgtgtaatactttgaaatatcaggaaatgaaatctttttatgaaatattattgtggagcattttaaggccagaaatagcagacattttggactgtcaaggagcttacgtcaattcattgacttaaataacctaatctagtaatagtggaattgtcgtgtagttaatgctgatatgagatggccagaatggaaggtaaacataattaataaattatagagtcacacttttcttcatagttctagtgaatattttagaatttgcttcatttactggtaagataaagctctcgctcaattaaaagttacttatcctttacttcattgaacagctgtttttcaaccaaatttcaatgtctttgggtcatagagtgaatttttttttttgaaactgagcaattaccctctttttctatgattttacatctaaagtttactactactagacttattgagatgacaaataatgtggaaaaaagagattgaatgtttgttttaatatactgtaaatataaatttgtagtcccttttttgagagctagataaatataatggcttactagtattaaaatttacatattgactttcccacgtggaggaatcatactcgtgaaaactttgctcaactgaaggtctgttcagatattacatctgagatgcagagctgaagttcacactgttttctgatgggcaggactttcagagagtagttcaagtctttgcatgacatcaaacatgtggatgatagactcaattttccatatttcatcccaatgatttggtgtcatatagatggaacttataaatcaacatctgttttcgtttaggcagaaatttaaacttttctggcactattctagaagggtaatggcttgttcttgtatccattaggaatctgcccatctttcttgtgggcactgcagtactgggtattggttatctaaacatctattccaaagagcagcactactgtcgtaaagccatagggagggtggtgagcttatgaacgacaaagcttctagtgggaaagacttaccaaaatggcatttgtcccattatcactcatatctcaacttcaaagtggagagaagaggacaaaatagattattcagtccccatttaagcacagcagaattgtaaatctgcatctcaatttgaagatatttttacatcccaaaacacttgtatgaaaggccatcaagaaaataacatgtacacattatctttcccattaaagaaacatattgttgcacttgaaaataaaatgttggctcgcctaggatgtatatttttagctggttcttaactcttttaaaattaaagtgatgctggagttaccgaaatggactgaatttcagaaacaaaagagcatttttactggaacagaagccaaaagcaaataaatgaagaagagctcattcaaacccaagagcaagaatagaagaggcacagatttataatttgaaagttttattacccaaagagatctgggtttcttatccttctgtacttttagtttcagaaagtctcccagagctgcctcattaggcctctgattttgctttatatacccatgttgcctcccctgtagaagtttctgacactgtagattcttttatgtttcagtacttctaaaatgaaaacagcactgtagaaatgattcagtgatggcttcctttccggtaaatatgacaccgtcgtagtaggtgaaacggacaggaacagagataataaaatctgacgtgtcatattttactgactcagtttcaatgaactgattacattctaaatcattagaagaactgaagtctgccaaaagtttgttaatatatactatttagtttggttttttgagggtgtgacaattaatacaaatcaaatgattgtatgtagaataaaaaaattaatatgaaggaaggctcactcacctgttaatttactagtctcaatttttttaattaacaaattaatattattttgtctctcttctaagatacacacagaaggggagagagagggtgagtctggcacaggtctctaaacatactttagaagagaaagaaatcctcccattgtcagagctgagcataaaatctgcaccaagtttgaagggcttatgtggcccaatttaaaattttgttgttttataataactttggagaattgtattgttccttataaaatacccacatgttctcctttggaatagctccagagtgtaactgaaccacgaggttgcctcctggtgctttatgtattgtttaattgtttgctttggtggatgtttttattaaaagcttattatttaggataagaccaaagtgtcattttaagaacaacagaagcagagctgtttggtctcatagttctttttcataggtgtgttagtgaatactagatacagctaatgaaccagctgaaaattgttcttgtaatacttcacaaagagcaacaacgacaacaagcaaaacccttgatttttattttccttcaataaaacatgaccagattggctagaagagctaggagtctccatggctgtgtccaggcctcgaaggaagagaggtatctgtgggtgcgcatctgctctgtctgtgttttgttccaggaggagtttgcttggagtcacgtgcactgtggtacacaaggccatagcaaacctcaggagctgggaggcagtgaagcccctgtgtcacaagggccgtagtgggcttcctggggtgtgtaccaagcctacgaaggctttagtggatctcagaactacaaagttcttcatgtcctccctctgcccacaatttgattgcaagataattatcttagctgagatcattctgaatataaattaggtctgggaaaagtttttaattcaatgattttaattctcaatgttcttctcctccctgaatattttcttttctgaagcagtatcaccatatcactcaccgactcctcagaagttggctctggaaagaattcataatgttccctagcagttccttgccacaaagagcaagcaagagtttgattagtccatgacttcccaagctagtctttgtgactgggacccaccctcagacaaaaaacttaaaggcaatataccttgagataatttctaggacttacatgacctcattaaattccgactctagatcttatgtagacatttgaggaaatatggttattgacaaaatgtaagcccattatagactatatcacttcaaaaggagaaaggccattagaacataattacatcagaaacagtatacacgtttggctggtttataaactgtcactttcagaagtacgaagacttataaaagtttccaaaggttccattataaccctatttccaacagtattctctgacaaactaaataaattactgcatgtattggacctttgaggcttggggcaaagaatggaaaaattatttacaaaagcttgaaaatatttaatcactagaggcaggggggcaacggtgttttaattagcaggtcctcgggccattggctgactagaggctttctcaaacaaccacacaaatgcactgaatagctgtttgccagccttagggtcaggcctgagatgaaacagataagataattggctctaatgaaatccagaaggccttggctttcttgtttgagcttggatttgaaaagtgcgtgtggaagtgaggcttaattcaaaccagaactgagctaggcccgtttctcagtgactttgatattgtttgaagttctaaaagtgttcgccacaccactagcctgctgggctgggcctccctggtacccttaattactaagctttattgctgactttactacacaggaaaggggccattatatgttccatcaacatcagctcttctcagattggaggaaagggcagggttaaaggccactgtaggaaggcaaaaacttcactttgaggtagtcagatcatttaccagtgttgaatttcaccgttacgcacatacattccttacaacacagaagccccaatttccattttttaaacaagtgattacttttcaaaacatttttgtttgtgcctttttttctttttcctttcttttttttagagagaacgtttatttttaaggactgaaatgattgcacatgatacactgaaaaaaaagagtacaacacctcccaattaatcatcacaccagaaggtctggttggattctgtaataaggaggattattattaatgcccctttgaagtggaaataagtgaggaaccctcctgtggtgtgagagttgtcctgacaccctgaggaataaagacgcctcaggagactctacaaaattaaatcccagcttctagagtctctcacaaagtggttacacaaaagggctcccaaaccagtttgaagccaagaagcaaaaacgaggaagtctccccctgaggggtcagctgtggtgttactgaggattccatcctccccattctggccgctgctctgcctttggtccaactggtaaaatggattatgcatacatatgaattagtaactattcaacacttacccctctcagatgaggagatctggttatgctatgaaagccaagggacacggagtccagtcctatttcctgccctatttatcacctctggttaggaaagtcatgagcgattctatcagacttaactcgttatgaaagaacaagttgagtatattttgcattatttaagtaaacttgacattaatatgatccaatttcatccatgatcctgctaaccatttatccaatactcttttctgggtattgttatgcacaggtggactgggtcctaggtctccactaggatgatgtgtgtctgggcctaaggaaccatattaggaacccagggagaccagtattaggaagacaaaactgagcttctgcttcctaacctttcctaagcggaattaaggaggccctatacaaatttttgccagtgatgaacatgatatcagctctgatcagaagaagaatctgatcatactcagctcgttttaagtatgtatgtttttcattaggcactgttattgtctaaatgtttgtgttcccccaaaacatgtatgttgaacccctaaccctcaatgtgatggtgtttggagctggggcctgtgggtggcaattagggttagatggaatcttgagggtaggtgcccttatgagcagtgacaccagagagcttgcttccttgctctctctccatgcacacacaccgaggcaaggctatgggtgcacgcagcgagatagggctggttgtaatccggtgagagcgctctcatcagggcccaaccatcctggcacactgacctcaaacttctagccaccagaactgtgagaaactaagtttatgttgtttaaactactcacctggtggtatttcttttttaatggcaacctgagcagaataagacagacactataaagatctttaatatgagaaaccaagcaacccactaatggacttaaattaccaaaaaaagtatcttccaaaccatattttgctaaacactggatacaagaaatgttaataagtgtttctcaacaataaagaatatcctatagggaaaaatctctaattgaagacatataatatgtaaattcatgttaacaactgcaggaattccagtagtaattttacattatttaatgcattcttcctcaaattatttgaacatgaaactcccagctccccacatctcttcacccaacatctgtaagtatcatgaaaactaacattctatagaacacagtttgaaaaattctgatagatataagtagcaaacttagtgggcattttaaacagtccatcgctaattcagtaaacatgataaaagtaagtaaaacacatctgcccctaagattctcacagtcactttagtaaaataagtacattatattacatgtcattataatattgtgttatcacataaactgagcataccacaatccatattctacggactgtcttctcctttttccactgattacatgtgagtggttcttagataacacaccctaaagacaaagaaagaaaggaagagaaacagaattaacaagagagggaaaagagtgtcagtttcctttgctatgactattaaatgactcagtgaattttcttagggtaaagttactgccattcaaaattatagtaaattggtaatattttacagtcatatattttttgtttcagctgagtatattttgtttcagcttaagtatgggcacatatctcccacacttttttagatcagatatgacacataaaaaagatggctttggttttttaaaaactcttacaattagcaactaatggcagtgtgaacatataattggttttataggtaaatcaatttgtcgacttacaaacttttaagacttcatttgttattcataactacattttgctgaggaaaaaaatacttgtttatgtcaaaaaggggagaatttccattaagttcatactctccatgatgagaaagcacaccccgaaataagacattaaatgttagaatgtattacttttcctggttagaaaagaacttggctttgggagtggaccctatgcgtatcatggtgtggcaatgccattttgtttccaaagataacatttgtagatgtacagatgtcctgaactttattaaaccacagctgtggttatcacatatttattcaaaagatattacagctatcaaagcagtatgtcagcaaagtccttagtagtttgcttaaattgccctttcattttactgtatctgtaagtattcaaccaatgtctttaaaagcctgagtaaaaaaaaaaaaaaaaaaagaaaacacaaataagcaaacacgaagcattatttacatggaagcattcagaaatcatgaatagcattatcacaaatgagttatgacattttataggttcacaaaaacgagagagagaaaaaatactttccttgaatagcacaaaagcatgcagctttctttagcacattgattcttattccaacgatctgaatgtggagtgtgcttggccaatgatgatgtggctgaaatatgcaatatttatgaggcacagacccttgtacttcttgttcgaggagaggcagaagtgtgacaatgtccttccaaaaatgaaagcgtaggggaggattcttccctggaataaacctacagaatgctttcttctgtggaccattagtagattttttcctgagccaaacataatgaagaagtattttttatctcaaagctcaaaacctctgcatctattgtcatattgtatttgtcctcaaatatccttatgaattggacatgatacttctgaaaatcacacaggaaattattcacatgtctagaatagaggcttccctcgccattaattcaaaatgggaaaccgagtgcattcctgtcttgcttcattaaggctgctgtcacaacatatcatggactggatggcccataaacaacagaaatgtattttgtacacttctggaggctgagaagcccaagattcaggcgtcagcagaatcaatgtctgttgagggctgctttctggttcatagatggcaccttctagctaaatcctcacatggtggaagggtgaggcaactctgtaggttttctttcacaagggcactaatcccgttcttgagggctctgctcccatggtctaatcaccttccaaaggccccacctcctaatatccgtctgggttaggattttgacatgtgaatttataggggacacatttaggccatagcaattgccaagacaaacatgagtggattttgaagagtagtgagaattaaccaattcttgtggttgcagtgcttccctttgcctagcagcagcaggtctctgctctcaccagatttccatgaggagcagctgagctgcagtatctattcgctctactttcttgggtgctgatacggtttggctctgagtccccacctgaatctcatctcgaattgtaatccccatgtgtcgagggagggacctggtgggaggtgattggatcatgggggcgatttccccacgctgttctcattatagtgcttgagctctcacgagatctaatggtttaaaagtgtttggcagctcctcctttgctctctgtgtctcctgctgccgtgtatgaagtgccttgcttctccttcgcgttccgccatgattgtaagtttcctgaggcctccccagcaatgtggaagtgtgagtcaattaaacctcttttctttataaattacccagtctcgggtagttctgtatagcagtgacaaaacggactgatacaggtgctctacgttcgtattacctcttagtaattatcgtcttttatttgccttcccatgaaactgcgtttttaattttcaaagagtggacttgaaaggttaagaacacatttgtacgatgtgcttttcctgaaatgttagttagtatagtgatttatattaaatcatccaatctactttttaaaattccattaacaccaaatgtctaattattcctgtcttgtaaactgcatttatgaaagcaaaccattttccgtttttctttcttttacggaaacatccaatcaaagttggtttcctgaatatttagattcattagactttcttcatttgtaaaactataggagcagctactcagcaatgccttcttcgctccttgcaggcaggtaggtgcctgtgtgggaaataccttaggaaccaaggattgttggaaacttgtctttagagacagtccttctaacaaggctgctgaggggtgcagaaatggtacacctctgttctggctgcttgatcagtgtctcaatttagcctttggtgctttgaggtatctttcatgtgcgtaaagctgccttacaagtagctgactttctcccatgtgcttaactgagctagttgctgtggagaaaaatgcagaagcatgtaacagtcggggctgggagtgagaatcactacaagacaattagagaatgagcaaagcctgatatattgaccatgcactaggagaacaaagataagggaaaggactcttaatccaagtcttgtgagtagcccagtgtcctcctggcatgtccaggaacttgaggacgattagagtcaggcgaggaggcggaggattatagacatactatcattcctattctgaggccaggcctgatttgtgggtgttaatcttgtacaattacagaaactctctttcaaagaaataatacaaaggcaaaaattcaaaaataggtacagggacttggaaaaggtccatgtgagtgagggactttgaaaattaagattcattagctttatggtaaatatgccttggtacatatagtcctaacaccttgtattgccattaattggagtgaaacaatggacactgcaccatggaatgagccttaagtaaaattaatggctatgctgggtagtgaagagaaacagacaaattctgcaaaggtgggggatttcttagagaaactgcactgacagggaatgatcttgacataaaaattcaactgggatacatttttcatctgagggcacatgctgaggagatcaaagtaaaggagctttttttttttccctctctttctttccagtgtatgttaaggtagatttttaaaaatatatataagaagaaaggatccatcgaggaaaaataatgaagtcaatccaaaccaaacaaatcatagtaggggtgcggggagcaaccagtatttacatggggagcgcacactcttcttttgggtttggtgtgaagggtcttcacctgtttgtgaaagtgttcagaatgtggactgaggctagtccctgagtcggcctggctccgactttccaccgaaggggtagagttgctttaatgtggttcacgtgtatggtgtttcatcttaagcagagtgatttatgttaatgaaatgaaacagaaaaaataccctttacatcctagtctccttaaaaatattaaataaatatgtccaggacttttgcatgattatatttattaaaacaaatggaagacttcaatccataccagaataaatttgtaggtgaccctggggagggttaaatccattaggaaaaaaaaatgagtttgggggtttcttaccaattctgaaaagaaagtttttaaagccattaagttcagcaatataatagatggttacaaaatgagcatcaattgtaagataatttgttctgtaatttagaatattgttttgtttggcttctgaaaatttaatccccaaatcatggttcacaaaatatattcagaacatctttataaattgaatactagacttcttactgtgttaatgagaattaagcatgtgccatctttaaagtacctatttgaaactgttataatttaagagttcagcttttaattgtttgtcataactgttctactaatacagaactagtcattttaatagaacttaagggcagcagaatcttttcaactcttagatttcattagcgtgcatttacctatacctttacaacatgattatataattaaatttcaaggaaattaaattagccaaatgaatacattttaaaaaattagttgattggcatttttctcagaagttacctatctgatgacaaacattagacataagaataattcacatgtctggttatcttaagtgttgattgaattgtaatttatccagctgactgtaatatttagtaaaagtggaattagccaaggaaaatgtagttcacttgcttggaacatagtgacatactcttaattcctctagtataaataaatagacatctatttttgaaatactttttaaaaacaaggttaagaaagtaatacaataaaacttctattttaaaaatctttctgttcattgctatgtgggaagacttcaccagaaatgtaccagaaattttccttaatgtgatgtacctgtgggtatttggcaagcatgtcacttggcagatagttgctaatatggagcacaagaaaatgaaatgtaagggtacttttaaaacacattcctgagaaatgcttagctctatctgccaggtgatatatcatttactgtcatatattggcagctgaaaaactgaattttatttttgctgtcttggctacagatattatgtaaattatattcttatggggttcaaggtagtgatcatgattgtaatgacgttgataatggtcatttaatcaatacagagtctgtcggtgtatcttactgcaaagaaaaataagtttatggtaattcaggtgtatttccaattaaacagaaaggagaatcagaagaagagtcaataggagggtagagaaaatatagaaatggctgtaagagaaagaaacaaagagaaatagaggacaaagacactactctagtctagtatgggatgctaaaagaaaaaaatactgaatagagaaaagtataaaaagtctaatagaagagtaaataatcaaattggggtaattttttaaatgggtgggagtaaggagccactacagcaagaaaaaaaacaaaaatagtaaatgccattattttcaataaatgctaaaatttatgaaaatgggattttatcacggtcattgacgttatagcattaatggtctatatattttgacagcgtacttaaacccccaaggtaggcaacatggtgagtgcctgcgtaaattggtcagggcttgggttgttattgttaaatgttttgatgatcacctaggtttaaaataatgctttcataatataatgggaaaatggatgcaattggctgctaagtgattggcgtcagatttcagaggtagtatgaattagctagaaggcgtcccttaatctcactgcactctactctccagaagccgtctctgaaaccagagcagtaataggacatgtctctatcacacaaccaatgaatgtcacaggctggttttaagacttccagctcaggacttgctttacactaaattacgtgcagcagacattttccaaatatacaccccctaaagatctatcgtgacctagcgtagtgttattacagagaagggagttggaaagattgactgattgattagtggccattctctgtaaacctgacataaatgcacatttcctctatttacagaaaatagttgcaattgttattttattattttttatcctggcccatggtcagtagctctatccacctcatttctatcattgctagagtcttttgctttaagtcttcatcatgagcatgcctttcctgcttgtcctttgagaacactgttcacagttcatggcactgactgtgtttaggcatggtggccgtgctgaacttgagcactccttttcaactgcctgtggtttcaccacttcttaatatgttaaatttatttaggctgtggttgttagccccttatttttctgcttgccgttctgtcagttaatgtttcccttgcataggtcagaaggtggagaggggaagaaaagagggagaagggattcttagccaaatccaggtcaagctgtctaaccaaacggtagctgattctattaccaacttggtctctgtttcccagcctttatggtaccaagagacttttgcagtaatggaaacattccttcttttacttctgtgcaccgtcatcttccttgacttcatgcagagaaacacaaggagcaaaataattgtaagcattacagccttttactctaatgaccttgactctgcactgggatagatgtctaattacaaagaattcagcacagaccacattagcgaggctggtgtttgctttgcacacagacccaacatctgttggatctttggagcagagatttagtcatgggagatgaatcctgctgttctcttaaaatgcatgctttgaaaagaatgctcttataatattttggtcctgagagatacggcatcataggttcacgctaaggctcacagcccctaagaaattatgagtaactgattagatttttataactgcagatcaagtccctaaaataagaatctattcttatcttagaaactatgagtattatttagaaaccatgagtaactgattagattttttaactgcaaatcaaacccctaaagtaagaatctatccctaaaaatcaaaatctattttgctattttggtcactataatgaacagagggagttgaacacatggttatctctccaccactcatggctgctgcatagaaattgcccctaaaggatgttaatattattgattttataaactatgtaggtagaacctctatttttcttacactgaacttggagtgggcaaaaagaagcctacaaatgcattataaacattgcaaatgtacattatgaatgtatattacaaatacattacaaatgtgcaaatgcattagtagcttcccttaatttcagtttatgagtttgtgatataaatggcagggaagaaaaacatttgtgtgcatttatctttggaaatagcacaacttatttaatcaattgctttctattaacatttttttggtgaatgtgaacaatacaatcaaatgtaacatcgatttgggtctctgtgattttccctgtcacctcaattcattcccgccttttctccacattactgtctttccctgaagcataggtagtattcatttgccacctgaatgatcaccgctgggtcactgttgtgaaaccataaagtgccttgaaggaaatcacagtgcagttattcagtctgttcatatattcttctcctacctctcagctttatctttttctttctccgatttcttcagtccagctttcaactcttcactcccatatatgtcatgtttcaacttcatttaaatttttatctttttctctatgtgtcatagttttggtaattttatgactaaaacatgcttttccttttgtctggaagtatttattttctttcactgaataattgcttctctttttttatttttttttaactgtgttgcagcacataaaaagtttatgaaatcaattcagagggtcaagattggcattttaatagaatgtaatagaagataaaagagtgtcacatattgtttcacaaaatatgttttagttgtgtgtgtgtgtgtgtgtgtgtgtgtgtatgtatgtatgtactagttcctggagtgaaatgtacttttttgtttgttgtggtttgagaattttgaaagccactgtttaaacagccaattaaaatatcattttatctataaagttttgtctctgttctccagaataattaataagttcattttctatgtccacatttatagctgtagtttctagagtaattattgttttgaactgggagaaaaaaatcaatatctgtattaatgaacgcatccctttgaactggaagaaatttgtttacagagttgcttcatccatgccatctgaacttgttaagtataggaatcataggaatctgtcctgacattatgaaatctagcacttggcaccttggcattgagattcactgtagatgttcaatgaatgttccaggaataaattaataaatgaaaaaatctatgaaaagacaaacttgacaaagttgggttcagctattttgttttcaaatgggaatgtgacattcccattttcaatgggaatttgaaaatatttatctaatatctgctacttgaaaagatttttaaaaacaagctaattttttaaatatgagggtacagtactgatgtactaataactgtggagtattatttggtctaaaacaaatacacatgcacaaaagaaaattagttttcaaatgtttatccattgaaatcttggattctgccggctgtttagtggttcatttagcatgtcacagtatcatgacagcagtgtcgaaataccaccataacattcccttttcaaaaaatgaaaataatcagtgagaaagctagctatctgtgcatatggatccacatggttgcatatttggaaaaatggataatcaatgtattactcaattcttaggctgctgtgaagaaataccctagactgggtagtttataaaggaaagaggtttaattgactcacgtggctgcatgttctgcatggctaggcaagcctcaggaaacttacaatcatggtgggaggcacctcttcacgaggcagcaggagagagaatgagtgcccagcaaagggggaagccccttataaaaccgtcagctctcatgagaactcaatatcacaggaacaggataggggaaatcacccccatgattcaattatctccacctagtccctcccatgacatgtggggattatgggaactacaattcaatatgagatttgggtggggacaccaaagtaaccaaatcagcttatgttaacatttcctatctagaatgtttgaatgtactttactcagaaattgctttcatgctaatccaagtgacaacccatagtctaactagtcagagtatatttttatcttaaataataaaactactctatcatgtcaccatggaaatttcgtactttgtggagtgaacattgcagttggaattgtacctggaaataagttgctgctgaataaatattgacagcagtgtctcatttttaccatgtcctgatctcctgtgaagtttgagtggcatacctacttcccttctaactcacagaaacactgaagtgattgcttcaatacacatgatatgccttcattgcctcattgaatcagagcacttagaaacactattttttcatccaaaaatgcagttaaaaggcagtgaaattgtcaagcttccgagaacgtgatctttggattcagacagatatgagtttgaatcccaagtcagtcagttatttgctgaaacaacttgactgattatcttaccttcattgagtcttagtcttactgtctataattgggatcaaagtacataatttcaagtatattgtgatcattgcaacattagaaggaatgtataaacttcttaacttcatgcctggcacctagtacattgtcaaaatggttgatgattttgttgttgttgctagaagaaaagagtttccttgcctccaacataaactatttttttagttttggaattaatcctactctcctgttattttagctatgaatacatgtaacactcctagatcttgggctgatctcctgattgagaagacagcctgactctgcacttcagaactctattcaggccccaagttctttctttcttctcagtctctttctggctatgcctcagggaacaagtaaaatgtgttactaaatgagcttgccttttgtcttgttcatctcacattgctacgcaattaaaaaaaaaaaaaacttgatgatgctgccttcctcagaaaggccacatcaaaaggtagagttaaccaaaaataatacacactttttccaaagacacaaacagttccttgaaaaggatgtcatgctgtaatttgttttgtgaattctataaaccacagaacatttacttacagtaatgtttgacctttctttttccttatttttatgcctacaaagcttctttttctctcctcttgagaagaaatataaaggctaacgctctcatatatatatatatatatatatatatatatatatatatatatatatatgtgagagaatgagagagagagaaatatatatgattttattggaatactgaatttaatttttagccaaagtcctttggctttatgcaataatattttatggaatgcaatcacttgtgcaaagactaaagagaggctcatttgaaactttgcaaaaagaatatgctgctcatagggtaatgggaaatgcaatatgtgtactaagctacacactgcaccccaccgaaaggagagaaatccctatgactgatttgatggtagtataatctctttagggattttttggataaagaaagtaataacaaaaaataggcacataattaagtttccaaagtgcacgtgtcaccagcatcttattgtccctctggaggggaaatttactaatgacttgggtagacatttttcctgctatgtgcccaactgagaaaaaaaaatcagcctttccaaattttctaaataattctctgctatgtaagttttaagaacattttactgtcatttgtgttctattttctattcattatggcaatgttttacaaccaccaggttgctatagaaatgaaaataaacaaagatttggaaagatacatgttgcaggggcttgttctgcctctcttgcctaaaccatgaggattatgttattctttaaatatactttcttccttggttatccagttggtcttaatataaggaaacaaagttaaatactttgttctgacttgtgtcaaatttttctcaatgtcttaaactcttttcctgtcctttaagaataaattgggctaaaagaggataaaattagaaggaaataaaggaaagaaaaaaaggaagacggaagaaaggaaggaaggaaagaggaaggagtaataaggtaggcataagataaaactaaaagttgctatggagctgacctccttgtcagcacccactggaactataaggaagggtgtattttattgagcaatcacaggcaattttgaaggggttcaagaagaatcagtagttctagtgcattatgctggcaaagacccttgcccgctctccacacccttgtagctcagcctcagttctctaggatgtggtcttttgttaattggatagtagcagagcaaagtcgggactactgatcctttccagctctagtccttacaaatatggaaagactgatttagtaatgcttatgaaaccaaatacataacagcccctttatgttactggactcacatttgaaatcataataaaatatttcttgagaaccactgttgcaaacttaaagacacatttttggcatattaaaattcacggtatttctatgcttttatacaataatgactgggaagggacatatataattacattctacatttctcagcaaaagagtgtttacttcagtacaattttaatattaactcttaatgacttctaccaactccaaactaagcatgtttcaacattttgttgtttctttctagactagatttcagtacagagtttaacgaaagcaaaatctgttaattctgttgtcattgttttatatatggtaattagataagaatcagtttatctgttttgataaactagcaatcttaccattttgcccagctccctatgcttgcgtataggattttgcctagggaggtggcatcattctctattcagaggcgttccaaatataataatataaatacactaatactattctcacagacaatgtcccaaagtcaggaagagatactgttgagaaaaatttctctctcaactcttagctcagagacacattgggcaatatctcagaattagtcagaaatgttactggctacgtgacacatcttaggcaaggaaagtccctcattgccttcaaatatcattattttttaaacacatagcatttaaaattagcattggcttcttaagcactaaagcaatataaacttactaaatgtcatatttgaaactctaattaaaagaatacactttctggaccaggtatatatgtgagtgtacacacacacgcatattcctaattatgatatattgcgttacattatgatgtatatgtgctatttgtttgtagcttccttattctcatcaatgattcatttaaaagcacagagtactataattaggattactattttgatgtagtgaaatgatatggactcacaatgtcacatttagagctccaatctctttagaagtgataatttagcccccaaaatatagcttatacaaattttgttcttgcagtgaaatagtttgctctccactctagggtctagcgtcatcaaaggaaagacacactttagaatcgttctgaaaggccaggggcaaatcagtggatatgtaggcaaagattttgatcagcaaggatgctgagcttcaggcaacaacttttcttatcaaatgcaagagaaagagaatgtgaagggggaaaaaagtgtccctttggtgtattagatctggaacatagaaaaatcatagaataatagagccgcatatgactttagagttaatctaaatgaatccccccagtctcatataatagttgaaactaagacaatttactaaggttacccaagtggaggcagtgccaagaacagaaattgaatatcttgagttggaatcaagtgatttttctaaccccctacaattgtacactgaagccagataattcaattttgagatggcacactgtagaaatcattgcagaatttaaccccctttttgaagacttttggagaaacctcacctttccccctctccatctggttcatacagtgttccaatgctcatcagaggaagatggttagagaatgttttcctttatactgacagagttcccatttggataattaatttgtaaaaatacagaaaaaaacctagctagcttagaagcatatctaaatcaatgaataaaaatagggcaagataagaggaaattcattttgagaagaattatgaagacagaaagagaaaagctatgtagattcaggagaatgcaataaacaaaacatggaaaaaatagaagccgtatcatatatatgtcacattttctgaaggtgtgaaaatttttgagcccaattttttccttttctcctcattacagtagtataatttctagattaaaaatgaattaaatgagcatttgcatattcttgtaattatcatccccattctgcttttgtgtctggagagatttggaaccagctggacaagagaggaaaggacgattttctgatgtttgcatttaaagcaaaggctcataaacagtgaagccacagtagaaatgggaatggcctttcactaaaagagggattttacatacatttgtgaaacgtgcagaggctgaggaagagtgaggcaccaagaaaatctgacctccaaacacgaaaaaccagagagggcatcactgggtataacattcaacaactatttattgagtatccaccatgtgctagactttagcttgtccaacccatggcccatgggccacatggggcccaggacggctttgaacgtggcccaggatggctttgaacgtggcccaacacaaattcgtaaactttcttaaaacataatgtttttgtttttggattttattttttagttcatcagctattgttagtgtcagtgtattttatgtgtggcccaaggcaattcttcgtcttctaatgtggcccagggaagccaaaagattgggcacccctgtttggacactcttttaggtccccaaaatacatctgtgaacaaagagacaaacatttcttccctagagaacttgaatttagtgggaagaagcaatgaaaaaataaacattggacataatatataagtaaatcatgtatgactttggaaggtaagtgttatggtgaaaaaaaaccagaagagaagagttaggaatgacagaggtggggtaggcgtgggaagggttgtcaggagaaggtcttactgaaaagataatagacgactaaaggtttgaatgaggcaagggagctaggcctctggggaaaatcattcaggcgaagggaacagccagtgtgaaatctccatggccactgtgagtactgctacaatgagcatgggagtacaaatatctctttgagattctgatttcgattcttttggataaacatccagaagtgggattgctggatcatatggcatttgtattatatgttttttaaggaagcttgcactgttttacatagtaactgcaccattttacattctcaccaacagtgtacaagtgttccaatttcttcatattaaacaacttaagtgtccctggatggatgaatggataaagaaaatgtggtatatagatacaatagaatattattcggccttgcaaatgaagggatcctgccatatgtaacaacatggatgaacccagagacattatgctgagtgaaataaggcagaatcaggacaaatactgcatgatttcacttacatgaggtatctaaaatagtcaaactcatagaagcagacagtgcaatggttgccagggactgggaccaggggaaaatggggagttgctcaaaggatataaagtttcagttatgtaggatgatgaagttctagagatctgaccaggggaaaatggggagttgctcaaaggatataaagtttcagttatgtaggatgatgaagttctagagatctgctgtttaacattgtacctacaggtaacattgtattatacccttaacagttgtttaagggggtggatgtcatgttgaggattcttaccacaattaaaaaaaaaaaaggaaagaaaaaaaactaagaggattgggagtaaacaaatattttatcacccttgaacctcccaaaatgctctacttacagagacagaaattggaatggtggttgccaggggcttggaggaaggggaaatgggaagttattgagttactgtttcacggttacagagtttccctggaaagatgaaaaagttctggagttggaacggtggtgatggttgcacaacagtgagaatatatttaatgctgccaaagttaaatggttaaatacttaaaatggttaaagtagtacattttatttaatgtacattttaccacaataaaacttttagttgttaaaaaaaatccctttgaccgtagtgtgtcaggcatatttgtgaatagagtcctggccaagcttcactgaccagagactcatgggtcattaaaacaaacaaaacaacaacaacaacaaaatttgcttccaccagaagagaaatgatgaggatctgattaaacatgttaagctggccggctgccattttgagaacagagtacaggggtaaagaggtagtatgggcccctctgaggaggccatggctgtgatccaggtgagcagtaaagttggcacaggccagggtgagaacagtggaggtgtaggaacgtggtacatttctggatatattttgaaagtttgacaataggattccttggaagattggctttgggtttgagaaagagacagggagctgccaaagatgaaaaattgaggcaataaaaaagggagtggtaaaagagagaagggggcaatgtgtgtgtgttggtggtgtgaagagttggagggtgaatgctaaggaagaagagcaggacttattcaggtctgggctggtggagctagaggagaacaccaattatacctggtgtgcttagcgctcctagtgctgacgcttttccacaaatgcccatggtaaaccttcatttagtgccccccacaaggaccctacagggcctgtgttgtgtgaggcactgggggctgttctgcagcactagcagccacaacagctgcctggaatctgtatagacagttctttgatgtgctgccttcaccactttgggagcctcttttccttgtacttcatgcacaaacataggtgaatgcatgaaaaaatgtgcagtctataatgtgcatttttgtttttgccagaaaaacctaaaagaaataaaagtttttgtaccatttgaaaaggtataattttataatatgatgctttcatgcaatgacatacaattagactatagagaaaaaaggtaggcttggattttcacctataatttacatttgcatgattataatatgctattataaattatacaggggatcagaatctgctgtctcagaggtgacatataagatcatataactgcctactcaaaacttttgagtttccactcttgttcagaatgaaatccagtgtcctcacagtggcctacgagatgctacatgaactggctttatgccacctttctcatcccatttccaaccatctttcctttcattcactttgtgtgagccacagtgacattcttttgatgccctgaatatgtggaagacccttccactgcagggctatgtccacctcagaacggccttctctaggtacccctgtctcaacgtgcaccacccccgtgactttctgtacaatttgtttttcaccttagtccttattacatgcttacttgtttatttatatagtgtcttgccatgaaggcaagagatcagggactttgctgtgaaccctggcctataactgatgtcctaactcactttacacatcctctctggtggactttcacattgtttcttccttgttggttgcccgctctcctctgtccctcagtacactgtgtgtgcctgggtttgttttccacctgcctttccttctaacctatgacctttttgaaggcagagttacaacatatttgcatttttgaatcccagcaccatcccagtgcttcccatatggcagggactcaataaattacttctaaatgaatataaaaatattgttgagtaactttataagttaagatgttgtgaaatttgctttataattttgagttgcaggctgtggaaccaagccaaagttctggtcctatgggagttcccttcttgcaactgagcacgtcaaatgagtgggtagcgtcttatgccgttcactcagcacatgctggggtgagtcatgggaaattactagtgtggttcaacttaaggacaacacttgactcaatgtcagtgcaaccaattgtttggccattgactagagatgaaatagttccagaaatctgattctgaggaagttcagaatcagaatcaattgttccaaatctcatggaaagaaatttaaagtggaattcttttctgcttactgtgtttagcatctagtcacatgatttgtatctctttatgttagtggtagtactctttctgtctccttttatttttataagtttggtttattctcactagcatgggtttcaccaggggtggagacatgcagggaagaaggaagagggttgttcttcaagaagagcatgacagaataaccattggtaggtgaggacaaaaaagcatatatgccattgttattgcttcaatcatgtgttttctagcaaagcaacgtaggtgcaaatcaccagtgaatcctccttattctcctacgatggcatatccagtacttggtcccatgcctcattctttctttgatgcactttcttgctttgcaaaagtacattgtcaagtaagttattcggaaagggagcattgaacataaatttctgagccctaaaatgttttaaagtatttaagtcacatacttaaatactagtatgtgatagctgcaagcagcattaaagtttaaaaataattttccctcagaatgtaaaaacattcagtgttactgattaggactttgctgtcaatatcattttctgattctttgaggacacgttttttctttttaaggctctcttaggatctgacaagtgtgtattttttaaaaaaatacgtagagcttcacactggttggactaatcaaattcatatacttgagtatttttagttccgaaaaattatcttctgtcgtaagttgatcatttcctctcctctcttttcttgggtctctcagggactcctattatttaaatataggacttctgcaatgaccctctgtgtcttatattttcccatctattttatactttacctatttgcttcctcttctgggcgatttcttcaattttatttcttcagatcgtctactaattttttaagttatgcaattttagtttttatctttaagtacttcccttgttctttgattgttctttttcataacagcatgtctttgtttcaaggctaaaatattttccagcatttctttgaaattattatgtttgttgtctgaactttatctgtttcgttaagagtcttctatgtatatgtttgttttaatctttttttttcttgcatacaacatggtcttcttatatgccaggtaatccctgattttccactcatatttaagaaagtagctagtaccagctttccctgtggttgtataaatgggtcaattgagtgtgtgtggactgtcaaaccccactttagtgttagcattctagaagatagcagctcttggtctctggatccccataaatgacaaaataaggaggactgtgtgttagagtcccagtatctacattagaagtcttagctttgttcacacacatacatacttttctttaagaaagaggcaatctgagtgtgttgcttggttgctggcatcaaggaaaggtaattaaggcgttgggatgtagtctgatgttcttaaccgactgacacttttttaatttcttgttttaagtcctgcctgttttctgtcaccatacccatttcctcagtggagtatatggtgttaggacatacattagtttttttctacagttcctggctcataactcccatagttcttgctacagttttttttcttagtaggttggtgcaaaagtaattgtgttttttgccattaaaagtaatgtcattaaaagtaatataatgttgggtgtgctaggcttcagaggcgggcctctgatcttctgctttcctttcacctgtcccaaggcaggactctactcttcccacccttcttattgtaggtcttaagaccctctctggaatgaaggaatgctgagtgtcctgaagctttcataaaaactcaagaggactggtttggagagcttccagatagttagaaatgtagaggttcctggagggtggcattcccagggagggcatggagactccatacgccttcccccataccttgtcttatgcatctcttcatttgtagcctttgaatgtcctttataataaagttaatgtcagtaagtgcttctctgagttctgtgaagcagctctagcaaattaatccaacccaaagaggggggcatgggaaccccaaattgaagggaaattcctggactcacaattggggtgtgtgtgtgtgtgtgtgtgtgtgtgtgtgtgtgtgtgttgcggtagggggaagggccttgggagagttgtcttggtccggatctgtgtcccaccaaatctcatgtcaaaatgtaatccttaatgctggaggtggggcttggtgggaggttgattggatcatgggggtggtttcttatggtttagcaccactcacctagtgctgttctcatgatagagttctcatgaaatctggttgtttaaaagtagcacctccttcttctctctcttcctcctactctgccatgtttgtaagtttcctgaggcctccccagaagcctagcagatgccagcatcatgcttcctgtacagcctgcataactgtgagccaattaaagctcttttctttataaattacccagtctcaggtatttcttcatagcagtgcaagaacagactaataaagagactgagtcctcaacttgtgggatctacactatctccaggtagatagcgctgaaactgaattggaggacacccagcagacatccactgcttggcgtgtggagaaaagcacccacctttgatcacagacatcttctgtattgaagattattgtggtggtgtgagagcagagaaaaaaacaccggtttagagagttttcctgacacaggctcaattggatggagtgtctctcatctcttctgtggtcccatgaacgcatatgcaaagcagtagctttcttttttgggttttttttgttttttttttttagtgtgcttccagtcaatttccttattccggaaatttgttagaaacttgtttgatagcaatggtccttaccctctttaattgctataattttatttattttgatattctgatacttgttagcattttattttgaaataatattgaaattacagaaaaagctgtcaaaataggacagagttcctgtacgccaacacgcagtgtaccctaatattaaaaacttacctaatcatagtatagttatcaaaattaacaaagtaatatgtgtacaatgctcttatctaaactacagattttatatggcactgcaaattttccactgatgtcctgtttctgtcccagaatccaatccagcatactgcattgcacttagacatcatgcctcctcaatctcctccaatctgtagcaagtccttaatcttcccttgttttttatggccattacttttgaagaatactggtcacttattttgtcaaatattcctcaatttaaatttgtttaatatttcctcattatgagatttgaagttatatgtttttagtaaaaacgccataggactgctttgcctttaatgcatcatatcagggagtattgatgctgatatgtccaatcataggagatgttaactttattcaggtagtgtctgaagttttcttcatttcaaagtttctgttattttcctttttagtaccttggagaagatactttggaattatgcaaatataatgattgacagcaaacttttgtccactaatcttatttattatcattattattgttattactattttttgagacagggtcttgctccgtcacctaggctggagtgcagtggcatgatcataactcattgcagcctcaaactcctaggctcaaacaatcctcctgtctcaatctcccgagtcattggaactacaggcacacaccaccatgtgtggctaatcttttttggagagatggggtctctctgtgttacccagggtggaacccctaggctcaagcaattctcctgccttggcttctcaaagtgctgggattgtagccatgagctgcaatgcctggctccactaattttggtatccatccttgaatcttgcctgcatcagttatttctgccttgttccaatggtaattatatattttcctcaattcttctacatttattagatgatatttttctgtaagaaagagctgttttctctcctttctattcaattattatgtattcactatggacttggtgtttgattgtttggattataatccaatactatcattatttattttgctcatcaaattgtttcagctttggccattgaaagtgctttcatattggttcacatgtcctgttgacatgtccatgtctcttttaaagcatttttttgacttctgtcaccacaagatattccagagtcatgtagtattttccctgatgcagtgctggaatcaaccacttctccaaggatctctgggtccttttattggaaattgatatgagaaagcaagatctgggtattaactctgctccttgtcactggggtgccattgcttttaggaaatatatactaacccatggatacagtcatctaaatgattcatctattatatattaagaaccatgagttcgtatgtatcttcctatactttcttttcagtgggatattggaaaagatgagaggcaaacatgtattctttgtttgctaactttaatcagaaatcccaatttttcagataaaattttaaatcagtgctttcacagatttgttttaataaaaattacattgtttttcctacttcgtaccctcaaatgcattattcaatctttcagacacaatagatctttttgaatacaaattaatctagactggcataaatagaacagtgaacacttccatggacattcgtaaattcattgccaaaataaagagatctgtggagtctcagtttcattcatttatcagagaggagaacaagagtttaatgctgacaataggaaaataaataatattcagttcaaaattgagcacatctttagaccaagacggtgtttgcaacatagtagacactgaatatatacttgttgaaatgaatgaatgaaccttaccaatgtcaccctccataaccatctgttgctatgtagttcttcaatgtaatggaaaacacacagcatgcattgcagcatgatgcctctgttctcatcatacttcactaattgattcagcaaacagcttccacccagacataattctaggcaagtatatttttaactgaaaggattctatcaggtgatgtatcctttttctaaatttcccatctttttcttactttttggaatgagttcagatatataggattaggcctataaggtgaaggaatttgaaaacccacaggaaattagaaaagacattgtgtttgtgaattcagaagtgacctacgtagcaaatgtgcaatttgcttcagatagaaaccagtagattccgtatattcagagatatgtggcatagagagctatagttcccctgtaagtgggtaagatgtctttattaacaaaatatttgcattcatcatatttaagaaaagggcactataaaggtgaatggggctttttgaccactgattcacggtagcaagattggaaaaataagctgactgttggtattttctgctttttcagttagtttctccaagaagagagagaaaaattcacttgctttttgtggcttctctgtaggcacttatactctgtagatcatctctgtgttttcagtgttctaaaattatgtgggcaatcttgtctcctctcctgtcttcttgtacttcaaaagtatgcacctatatttaatatccatgggtagagagaagcctttatggagaagatagtatgtgaattgtgccttgaaggatggggaaatactggggggaaaatgagggaaggatgaccttctgatagagggaaaagagatggaaaattgattactacgatgcttatgattgcatagacaatctggttcaatcatctacttactgaattttgtagaagcatccattctctaaaggagtacataggattaataaaattaaattgagtatcttgataaagcactcctaattctttggaaaaacttgtttcaatctctaatatcccaacatacaccacaatactatttcactcaggaaaaatagtgaatttattatgtgtgacacttaatgacaaccataatgtaaggtttgtaattactgggatggggaagaatccagtatatctcctgataatgtagctgtatttgaaatttttaattgtattgaagaaaaaacataatacaattgtgtatagtaaataaaattaggttttcacttagttttatgatcagccaattcagatttatgtggtttaccagttgttggaaggactactgtggaagtcacttacatgtgtatttatgaacttgaaggatagaatttttatgacagtggattcatttaggaaaaatatttcaatcatttacatttctaggtaagtttcaactaaatatttttattgcataactgcaacaacttcttgtttatgatatgcaataacattttttaaatataaaattcatacgtaatcattgtagaaaatctggaaaacttaccaacataaaaattaaagtaattatgtcattattgaaggataactattttaatatttgttttagttatatctcacaaccacacaagagtgattgtactactttttaaattcattatagtgtgcagtttccccatctcagtaaatagtttttgaaatttgaatttttatgatggcatactggtcttcaagcctatgttaaaaattttataaagcccagttgcattcattagtcattctttctcaaagctagcaatgatgagaaaggggtttcggagccctgaagttgagaagggaagtgttgaagtgtctgactggggccagcaggggttgctgtcatggatgaggctgccacattcctggtgtgtctgactttggactcacttaacattgtagtctggattctattaagggaactttgtgtttctcctttgcaagagtcaccccctaccatgataaatatttaaaaatgttttttttttttttaagttgggaaagcaaacttttcccaaaagaaatttatagttcaaatttacaccaagttctcactaactggagcaagccgggttttcactaaagctttgactttcctctgtaaaacattagtcactcccttggaagaagcagttttttataggcagtgggataaaacagccacagacgtatgtgtaatatgatgggctttagaatgtacctgcaaagcagttttttttttttttccatttggaggaaaaaagatgaaccaaaaaagactgaattgggatgctaaaataacagcgatttattattaaggaaatgatacgcttttgtcccattcaaataatgtttttattccccttttctttattcttgggaggttcctattgttgtgccaggtcgttttcactgaacgatttttaaaggtattcaccagtcccacgtgtgaccggttgcatttttactgtgcaggaccatcgtgaagcctgtggccaaagagtttgatccagacatggtcttagtatctgctggatttgatgcattggaaggccacacccctcctctaggagggtacaaagtgacggcaaaatgtaagtacctctttcaggactttacgaaaggctctgatatcataccatcttttaggtctttatgatagacaccaccttttacatgtgtccagtaaacttgggtgagacatttgaaaatgattcaggtggtgtttattgctctgtcggattcatgtttctgtagaaatttgcctttaagaaaaacaaagttaaagtgctttgtttggtggacatgacagcacatttcagaaatcgtatgcttttcaggagacctgttttacatttaaaggcagaaatgatagggcttctgtttaaaatatgctgcatgacttgagaggtcatgagtctagaaaagctactgtgcttttccagggagaatggaagttccattgtacatgggataaaaataactatttcttaataatattatgcacttccaagtttgaaaacaaaagtgtaattccccttgctcagagcctctgtatgtgtctatgggcaaccctcataatctctactcgtcttctgttgtgttgcaaagttggactttttggctgtgttccttagcaactggacaccacatgaagaaataaattttatgttacagtgcatttgaataatacaacctaatggaatctggctagaaagaggatttctttaaaaataattcccttgctctctgagtgggaaaaaaggtatatatatatagctcacatataaatgtacattggcaccaggggtatctatttaaaaatagaagaaaaaagtaaaattacacaaagaatagggcccacagtggtgtattttagggagcattgcaaagcagacaacaacaaaaaacccaaatacttttaagtgggagagatgagtttggagcaaatgtgctgtattaatttaaaaagaatcaaagaaatagcgtcatgccaacctttgtttttagctggcttctcatgtgaaagagttttctgcactctaattgttctagtaacattgttaggtagtaactatttttaacatgtattatttacccaggattctttgtgccttgttgtctattaaaaacatattaaaacaggaaactctacaaagacaaacaaagcaaaataattcatgattttggtaaaattgaatagagaggtgtttgctgagattaaatgtctgtatggcctttttaaaaaattgttattattatccatggaactcaactcaatggaagtcagtctttccatcgcagataaacctcacttgtgggtcagaactggtaaacagttgtctaaataaacaaagacaaagagagtttgtacatcaagttgagataaacccaaaaaaatacaaaatacctagcgaagaaagaaggaactctggaaaagttgttccttgccattaaatccaagaatctcactcagaagagaggagtgtctatgtttagtctttctccttgccacagggaaaggttgtaacaagactcttcgtcagaactagttaaagggattgatcattttgttcccttgtgtcttcatttttggccaagtcaagttcaaatctcaaatgttaccttgaaaatagtcgcatggtttcttttggccattaggtataggagacgtgggttctaccacttctaggtttagtagagtataatagcatcttcaatatattctttacccatttacatatatctattcattggagaggaagctcttcattgtgttccatctcagaatcagtttgtctagaatgcctccaactcccctcccctcgttcccagtccctccataccccttgtgtatctttcctactcaagaaccatatgttctctgctaggtgcctatttcctaggaaaatcaagcagacatattttaagtgatatcatactttaccttttgcgtatttgcagtttaataaggaaaaatatatacaatgagaagagaagtccttagagtctaaacagattgtagttgaaactcttcacatatcttatagatgaggaaactaatttattttaaaatctgaaataactggggttaaaatcaaagttcttatcctgaatcagtagttaggtgaaattgcatgaggcattttctgtattttttccattaaaaagaaaatgtttcataaaatggatgagaatagattttttttttttttttaagacagagtttcactcttgttgtccaggctggagcacagtgggatgatctcggctcactacaacctctgcctcccgggtttaagcagttcccctccctcagcctccctagtagctgggattacaggcatgtgccaccatgcctggctcattttgtatttttagtagagacagggtttcatcatgttggtcaggctggtctcgaactcctgacctcaggtgatgcacctgccttggcctcccaaagtgctgggattacaagcatgagccaccacacccagttgagaatagagaatttcgatgcacactacagagaacatattagtgcccatgacccttaatcccccaaacttagtctatgacagacattgactagttttgtgatacttaagtgaaacacaacaaagcctcacatctgggcaactgtatatattatttcatggaagcctgagtttctcagctatactttctagagatgctgccccaacaagtgggtagaagctgggattactagatagctcaatagttgttccctaaaacactccccacttggtatctttgtttgctttctaaccacctggcagatgcattcatattgctttggtcgaaaagttctgtacaggcaattaacactggactttcactgtcttgttcaggaagtcatcctttattgtgggagtagggtgatcccaaaacgaagttagaaatgggctagattctaaagtaaaaagtaggaacaagatacacaaccaagttcttctccccgtgttttccaattctagcaaaactcattcctgctccaagtagaatatttgataattacagagagtggttttgaggatgctatccatgtcagagatgctaaaattatattttcttagcacattgagtcaatcttttaaaatagttttgtttgctatctctgaaaggaaaagagaaatgaagtcaaaataactagggtttttgtttgtttttaaacattgttacctgattgaaaaataataataaaaggttggtgtaatcaccaatatctcagcccaaatatagaggtgatttaaaattaaaggtaattcttttcactagtgatgtttttctttcttcctcttttctcctctcctttctttatatattaagtgttttctgttatgaaactacaaaacttttggcattggtttctgctgaagttttaatcaacaatctgaattacttacttagtatcagtgctgctctttaaggaccaaggctaaatcccaacccgaaatgactaaatagctttttaacctgccctaaacccagcatcaaactgtaccttgaagttatcagtttatctttctaaatatgctgattcagatatagttgtcttcaggttacagcttaatcaggttgccatgacaactaagtgctgtattcaaacaataaaattaattcatcatatactaccaccccctggctttatagtgttgttaacatttttttttaaaaaaaagcttctttggtttaaattcgttttgccacaacatatattttttcttccctttcaacacatacatgcgttcactgcttttgttggtgtcaggcagtgaattcatatattcaaattgcttttgtcatgtgaacaagaatatgtttttcctttggaattatgcaaaatcattgtgagatgatagccatatctgataaaaagtatgttccttttataaacatgtgaaatacattcctttaataaacattttatagtccttgagacagaaaccatttctctcagcaaatatacaagggttattttgacaagtaaatcaataaatgtgattcatcacataaacagagctaaagacaaaaaacacatgagtatctcaatagacatagaaaaggctttcgataaaattcaacgccccttcttgataacaactctaaataaactaggtattgaaggaacatatctcaaaataataagacccatctatgccaaacccacagccaacattatactgaatgggcaaaggttggaagcattccccttgaaaactggcataagacaaagatgccttctctctaccactcctattcaacacactttagaaatcctagccagagcaatcaggcaagagaaggaaataaagggcatccaaataggaagagaggaagtcaaactccctgtttgcagacaacatgattctatagttagaaaaccccacagtcttggcccaaaagctcctttggctgacaaacaacttcatcaaagtttcaagatgcaaaattaatgcacaaaagtcagtagcattcctacacaccaacaacagttaagcctagagccaaatgagaaaggcaatcccattcacaactgtcacagaaagaataaaacacctaggaatacaactaatcagggaggtgaaacatctctacaatgagaattacaaaactctgctcaaagaaatcagaggaaacataaacaaatggaaaatcatcccgtggtcatagacaggaagaatcaatataattaaaatggccgcactgcccaaagcaatttacagattcaatgctatttctatcaaactaccaatgacattcttcacagaactagaagaaaactattttaaaatccatatgaaaccaaaaaaagagcccaaatagctaaggcaatcctaagcgaaaagagcatagctggaggcatcatgttacccaacttcaaactatacttccaggctacagtagccaaaacagcatggtactggtacaaaaacaggcacatagactaatggaacagaatagagaacccagaaataaggccacacacctatgactaactgatctttgacaaaactgccagaaacaagcaatggggagaagactccctattcaataaatggtactgagataactcgctagccacatgcagaagactgaagctggaccccttccttacaccatacacaaaaatcaactcgagatggattaaagacttaaatataaaacccaaaactataaaaaccctagaagacatcctaggcaataccgtcctggacataggtattggtaaagattttatgacaaagacacaaaagcaatcccaacaaaagcaaaaattgacaagtgagatcttattaagctaaatagcctctgcacagcaaaagaaactatgaacagggttaacagacagcctacagcatgggagtaaatttttgcaaactatgcatctgacaaaggtctaatattcagcatctataaggaacttaaacaaatttacaagagaaaaacaaccccattaaaacgtggggaaaggacatgaacagacatttttcaaaagaagacatatatgcagccaacaagcatatgaaaaaaggctcaatatcactgatcattagagaaatgcgatcaaagccacaatgagataccatctcacacaggtcagaatggctattaagaaaaagtcaaaaaataacaggtgctggcaaggttgcggagaaaaaggaacacttagacactgttggtgggaatgtaaattagttcagccattgtggaaagcagtgtggcaattcctcaaagagctaaaagtacaaccaccatttgatccagcaatcccattactgggcatatacccagaggaatataaatcatttgaccataaagacacatgctcgcaaatgttcactgcagcactattcacaatagcagtgacctggaatcaacttaagtgcccatcaatgattgactgaacaaagaaaatgtggtacatatacaccatactatgcagccataaaaaagaacaagctcatgtcttttgtggaatcatggatggagctggaggctattatcctcagcaaactaatgccagaatgtaaaaccaaatactgtgtgttctcactttcaattgggagctaaatgatgaacttctgaacacagagaaggaaataacagatactggggtctacttgagagaggagggtggaaggaggaagaagaacttaaaagataactattgggcttaattcctaagtgatgaaataatctgtacaataaaaacctgtgacatgaatttacctatgtaacaaaccttcacatgtacccccaaatgtaaaagttaaaaaaaaaattaagtgatttaaaaaagaatagttaatagttgccgggggggggggaaccaaataacaaagcttagcatcttgaattaccatcttttttttaaacagaaaattgtatttcttttcagtatcttctgattctctttcccccaccgagtgcctgtttagcaatgagaaagcataatttgggggaagatacctgtataaatgaatttagacttaacagtgagttattcttagggaagtacaaagattccttgtttagtcagtcaatgatccaaaagtaagactctaaaaacttgagtactaatccgataaacaaatgccaagaaacaaactgataaatacacaaggccatgttgtctacgtcttctgctaacaatgcgtgtacatgctttatcccaagtgcctcatgaagttttatctaactacaagttctgaataagcacttcagttttaactccagttattacagaggataagataaattagtttcctcatctatgagacatataaacttttttagatagccttgattacaatctgtttggattctaaggtcctctcttctcaatggatatttattctttatcaaggtgcagatactcaataaaaggtcatatatgggtatgtagctcaaataccctccacttttccatttcttgtgtccacagagttgaatatagattgagccagaactaggtgtgttttggtgaagttgactgctttttttcttgttcttttttactaatgactttttactaatgactctatacctatcttaaaatgtccatggctctcctaagtgtctaattttttccacattatcaaaatctataaagaacctaatcatatttacttaaatgcttcactaattacctgactatggtctttaaatgtaagtgtatttcacctaatgttatggttgtaatatttctgtaactattcagaacgtagtagctctgtttagcagttgtatcttttattacttatctgtaatcagggactcaatgccttgtcttctcataatggcatttcaggccacagcaaacatgtatggagaaaaggagtgtctagaagtcacctacccaccaggtaccacttcatgaagggtcaaccttaaacttgaagggcttcagttcttttagattagggtgaacacaggggaatactatgcagcattaattcttcgaagtattgtcttatccagctaccatcagattaacctctttcatctgcttctgtgccgtgtttcaaaaactggccaagtgcctggaacatagtctaaatagcatttttaaaaacgagtaaggctaaaaagaatccatgatttttttaaagtaagtcagatgatttcttccactatattcgatgtttcttgaaataggagttcataattttttttcttttttgccattgctatcttccccatcactgccatttcttagttttgaatcacatattcctgtgttctataatattttaattaacaaaaccttgtttttctgaaaactgcttctgacaatggacacttgtttaatatttccctttaataggaattgtattcagggaagtcatggtctccttgtaacagtgggccttgggcaaaagtgcggagacccagctgttaacacctgcttgaatctaattggtgagaaactcatttaatctctgctcagaaaaccaggacatgggagatgatagggtcctttaattattaaactggaaataaacagtaagaattaaaggagagtaaacaatagctaattttggtattggaaaatatttgttcggatctcaaatatgtttctcactaattttgtaatcaagttagtttcctaatcagccaaaaaaaaaaaaagtgggtggggaagggagataataattttacctacaacctatgtaataaatgattaggttgtgaattaatagttttgaattttattgttcatatcatttcaacaattctaaatattcagtgaaagtctgggtgtttagatgatatatttgagcacaaaatatacaacacaaattctgtagcttttttgaaggtgtttcagactcctgtttgaagaaaatggaaggaggatgggcagacatctttggaagcaatgcaggattttaggtaaatagtaagtgtattgtccatttaattaaaagccagtttagcaaaataagtgcctgcatttcacatttctatatctgtttgtattcctactttataataaatccagagacaattgaaaaagtggtaatgtttttaaaagaaaataaagcattattattttgtgatgaggatacctcagtcattgcttgcctaaaaactgtgcattttgttatgatacattgaggtatgttctgctcttaacattatgaatatgccaatgcagaataaatagtccagtgatgcttttttagcaattgactacaattttagttaactgacagttaactatctgaaacacacttgagagtcagaaaaaaacgtctcaacaaaatactaccaaatcaaattcaaaaacacattaaaaggttcattcaccatgatcaagtgggatttatctatgggatgcaaagatgattcaacataggcaaatccacaaatgtgttatacctgattaacagtatgaaggacaaaaactatatgatcacttcaatagatgcagaaaaggcatttgacaaattcaatgtccttttataataaaaactcccaacaaattaggtatggaaggaatgtacctcaacaaaataaaagccatatatgataaggctataaatacatcatactcaatggtgaaaaaataaaagtttttttcctaaggtcaggaacaagataaggatgctcactctcgccacttctattcagcatactaacagaagttctatccagagaaattagacaagaaaaagaaatgaagggcatccaaattggaaagggagaagttaaactgtctctgtttccaaatgacatgattttatatattgaaaatccaaaaggttccagcaaaaaaaacctgataaaaccaataattaaatacagtaaacttgcagaatataatattaacatacaaaaatcaatagcatttctgtatactaacaatgacctatctgaaaaatgatgaagaaaataatcccatgtacaatagctacaaaaaggaaaaaatgcaaaaaccttaggaatacatttaaccaaggaggtgaaagatctccaaactgaaaactataaaatgttgatgaaaaatattgaagaagatgtaagtaaatggagagatatcccctgttcctaaattggaagaatgaacattgttaaagtttacatagtgcccaaagctatcttcagattcaattcaatctctgtcaaattcccaatgacatttttcacagaaatagcagaatcaacccaaaaatttgtgtggaaccacaaaagaccctgaatagcctaagcaatcttgatcaaaaaacacaaagctggaggtaccatactttccaatgttaacagctactgtgaaactgtagcaatcataaaagcatgacagtggcataaaaacagacacatagaccaatggaacagaatagaggacccagaaataaatccatacaccatggtcaattgatctttgacaacgatggcgagaacactccatgaggaaaagacagtctttgataattggtgctgggaaaactagatatccaaatgcagaggaatgaaattagaccctcgtcttataccatgtaaaaaaaatcaactcaaaatggagcaaagatttatgtgtaagacctgaaattgtaacattaatagaagaaaacatagaaaagatttatggctatagttactattataaacaatgttgaagtgaacatccttttacaagtctccctctgcatgtgtgttaaagttaccttaggctgatgtttttagtcagttggggcttctgtttcttctttagtatgtagcacttgaaaacatgaagggaggcaggaaaataaggaaagaatgccttcgaccttccttacctattcctcaaacttcagtccacatccctgtttctcaatacacatgcacacacccacacaacaaatctctcctcctctctttactgtttaatactctgtatatcacacctcttcggttccagttaaaactggcagaaagggtggttctgtatactgatattcttcaagtttaatccaaactttaggggaaaagcaggtcaaaagtcatgcagtagatatgtaaaataccattttgaggtgttttcaagcaatacgttgggaattacaatttaaatagaaaagatgactttctgctcgaaacattctgcttaagttatcaaggactgcggagggcaatgtggtcgtaagggtgaaagcacagcctggtcgtccagcagaaaacatcataattctggcctgggccatcagaattatcccaggaatgccacccaacctcttgaagattatattcttgactgaaaagggaacattaatttcatcctggctgtgttgttgttattgatgatagaattataatacctgccagtgatgttgaacgttttccatgcactaggcactatgcctcaatgcttctctgcactatcttattttgtttttatgattaaatgagataatatatacatagtacctttgtgtattttttgtattaatatcattttttaagatgttctcatccctctgaaaccattacaaaattttacaaccgtttatatttctaattttaaaagtaacagaaaaattaagtaactatgcttaagtcacagagatgaagactaacaaaaccacaaccagatctcatgtctctagacttccgccttcatttattttcactaggtttaatgggttattaaaaatatctcaaataaatatgtacgcactttttaattactatagaagcttctctgaattgtgaaaatatttttcgaaaagaaaatttttccaacaatgacttttttgtgtaaataaaattttccaggtcagaaaagtaagctttataatataatagcagtttacagaccatgtttcctatttctcatggagcatttttcacaagaacgaatcaaggacttactctttgactcaaaattcctgcaaaccagtatgtctctttgttatattctcaagcaagtacatggcttcctgcaaggacagaggaagggaatatgcaagacatttatgattgcatgtaatagagttcactcatatatatttaacagctaacaaaaaaagcaacatggctgattaagaaggcaaacctgtcaggatataaaaacacaaatttgagaatgattttatttttaaattacaatcaaaagatttattcaagtgaatgagtgctccatgttcgctcttactctgcattcacttccttgctcaattgcctatttcctcataccacatgataactcagataccaaattgtagaagaatattttccacctgcactgtttagttactgatgtcatgaaacaatccttaggctaggatgactgctgcttaactttgaagaacacagttactataactgtaccataacaggccatttcaacattgcttatgaaaagaaaatatgtaagcagagtttgccccagaggaagatgccaactgcagctaatgtgtactgtattccattaatactaagatatactttttcatattttgacatatctgaaattggaatgtctctcacacttgatggtgtttcatcatgagattgaggctgtttttttaattttcatagtggtatataaaataatggttacatttattttgtgccacaattgatggcatcttagattcaatggaaaataatattttactctttgagatgtttgtaaaatcccagccaatggccttcctaatctaatagcttagatttctattttatattttctttacagacttccagtgactgaatagaatcccaaagaagcaaaaattaaaataacaaaatgaacaaaaaatattgccagggacaaattttaaataatagttgattctcttactgtgagtttgctttgagctcagacaaaaaatggttcttccttggcctgacatctccataaccgtagattttgaccctttattatgatgattgctataagtaaaataattggcttatgattcatcttacaaatcaaatcaatacggaaaagaatcagttggtcaaatcctttgttaagtaatgtcatggcctggtgccagcagtgttaagtgtatggaatagtatgtgaccaagaatcagctattaatacgtgtgtggctgatgaagtaatcaaggaaatcttggggaatggacgtgcagcttccctctataggaagttctcctcacactactgtcatgggctggagagtcactatggactactacagaggtttccaaattaacaagcatcagtatcacctggaggccctgttaggcatgctgggttccgcttccagaatttctgacttagtaggtctggagagggtactgcaattggcatttccaacaagctctcaggtgatgctgatactcctgatctagggaccaggctttgagaaccactgggctagtgattgaaaaaaaggaaacaggatttggaatcggttgatctgcagtttgggtctaattggctaccaactaacttctttttttgtgtcttgatgttctttttattcctaacagaaatagtacaaatcacgtgtgctttggctaaatatagggccattatgagaatcaaatgaggtaatggacctaaataaaatgctttgcaaaatgtgacactctacatataataacgtataaatgatatcatccccacgaaatctactattgttttcacacatataagctggggtcagaattcatatgtcaaaatacatttggaatcttatgtgaaaattaatactaagctatttagttatttttaaatgtttaacataattattttatatttctaaaaacatttgaaatatttagttatttttgttggtttttataggaagtggctaggattccacatatattttcttcctctacctaatccctttccaactgaacctctagacttgtcccatgcaacgccaagatttgtggccacagagaagtcatcaggagttgcagtggttctcatgccaacagctcttagaattcctcagaatgatagaaatttagccacctttacccaatatttctcccacgtagtttcagaccaagagtaacttttatgaactccctcatttatcttatcccaagtcacctaactgttacttggtaaagcgccataaattcttcctgatctgtcagtattaatagaaagagctctatagaaatgagctttcactgggccgggtgcggtggctcccgcctgtaatcccagcactttgggaggccgaggcaggcggatcacgaggtgaggagatcgagaccatcctggctaacacggtgaaaccccgtctctactaaaaataaaaaaataaaattagccaggcgtggtggcgggcgcctgtagtcccagctactcgggaggctgaggcaggaaaatggcgtgaacccgggaggcggagcttgcagtgagccgagagcgtgtcactgcactccagcctgggcgacagagcgagactccgtctcaaaaaataaaataaaataagaaatgagctttcactggctctcaggatttgatacgttttcaataaacaataggaaaagtgacataatagagatgtattaattttcctccaagttgtttttaaaatgcaaaacttgtcttacaagtgtctatatcctatcgacctcccaccttaacactatccccagatcttagtatcagcttcttccatgagaaattgtgtggatctagccagattaaaactattatttctctcctcctatcatctctttacatggttaatgtaactttttagtctaaatgagccacctgtgtaaaatacatatttattttaatgatagaagtgaaaaagaaatgcctagggttataaatatgaattttgtaaatactggctttgattgctgcatgcttgtgtaatgttcaaccctttttcaggaacgactttgtctagtcatatataacaatagagtctatagataaggtctttattccatgctgttttcctcttttctctgccttggtgaaatttgtctataagctacagaaattacctatttcagaaattattttaccaaacaattgactatctgtggcgtatcattcctctgctttatattcttttcctgcaactacaataatgtacacctcttaccacacgtgatgtctatgtactctctaccctactctatgctcctctgccaacccttttttcactattctgcagcctggaaaatctttctgtctctctaacagaccaggctcacatcagggtctttgcatgaaaagatcctattcaaaggatctcttctttagtgataacctggttatcttctcagctcagatatcaccttctcaggtcaattttcctgaccagtgtacccatcctccatcatgctctatcacttctttgacgttactgtgtgttgttaactactatgtgtccccaggggctaaaatatcacctcagctattgtctaggctccagaaatatttattgactttcatgtatggagtgatttaaaaaaaaatgatctatttaaaaatatatttaaagtcaatctctttattttttcttttacttgaaaagtttgctgcatgggtgtttattcaagatattttcataataagcatccatgttgtattgtgcttgttgctataaaaaaaagaaaaggaaacaatgatcagcctgccagaccagtacttggcagtggttcaaaaagcaggctccacagtatatacacctttataggaccaacacatgggtctgccacttttcttctttgttttgtcgttgagatagtgtcttgctctgtcacccaggctgaagtgcagtggtgcaattatggttcattgcagcctttagctcctgggctcaagtgatcctcccacctcagccttctacatagctagcactaccggcctgtgataccatgcccaactcattttcctgtaaaaaattttttgtagaggtaggatcttgttatgttgcccaggctggtcttgaactcctgtgctcaagtgagcctcttagccttccaaagtgttgggattacaggcgtgagccaccgccactggccactgccacttttctaattgcgtgaccttgggcaacttactttcccttttagtgggccttaatttcctcatatgcaaataggactatatctcatagatttatgaagagtaaatacagaaactcatttaaacatctcagcctaaagcctgacatttagcaagcactcaacaaatgttagccaatattagatagtcttatcatgtccatgtgcctcaaaagagctctggattataacatctttaatgcctgcatagcaactcttaatgcatgacagttgaacagttctagatctgtgttttgataacagcatataactatctgacttttaaatgcttcaaaccacctaacagatgaaaactgctgtaatgagcaaccaccaaaagtctacaatacacgagtcatagagttttggagatttgttttggagagttttggagatctgcccataggatgactctcccagacatctatgtaacaaggagtcagttttgatagccaagcacacgtaaatagtacaggtttaataatatttgggacatttagcaaacttcttcatttagtaagcatttccataaacatttcaaagattttcatatgtgggaaagaagagtttatgctgctcaagataaatacaaagaatgaaacagagggaacgtttctgttgatgattggaattataccacatccattgtggtcgattaccttttgaaaagcagattttttaaactaaaaaggaaattcactacagtgtaacatagaagtattaatatttactttggggctgtaacatagaaacttatctttgatggcaccgtaatataaactttaagcgaaagtagaaaatagatgaaaggataggtggagctagtgatgaaaagacaaaggtaagcccagagagaccaggcaattagaccaaggtagtgtactcaggatttaatttatttagctgacctgtactgacctccagcagtctaggatattttggcgagtctgtctgatctgggtttcatagcacgtatttgtgcgctatataaaatccagctgtctcatttagaattgcttatctcagattcagaatgagctgccagctctgttcatttgtttgcacttttctggatctactataaacagttttctcagatgttgttactctttagtcaaagatttctccccacagcactttccttatgcacaatatttccttcctgccttagggtaatcatgtaaataaagtgagtccctaaaaccactttgtcgcccaagtagccagcagagggaatcatttatgaaatgtagttaatttcagtaactgacaagcacatgaagtgcctaaagaaaacaggagtgtcaggctacttgggatggttccaggaaggtcctctactttaagagctgcattttactaaggatcctgatggttattagaacttttcctgttgttttactcagtagtctccaggggactatttggcacttgggtgcaaaatgagatcagcaattaggaagaaccactgcaggcacttgaacagtaaatcattgagtaccaggcttaagagctagtaagtaccaggccaaagtaatagcctaaggatggtggcaagtctggcttcttagtctttccagggtgcttggggccctagctccttgtgtgactgacttgaggtggtgttcagatatttagcaatgggaaagttgtaatcaactttcaatcccaatagatcaccaaaggtttggaagtttcatcaacttggaacctgaaaagtctacactattcacatctatttaagggcagccctagacccaccttccacataggacacataggacagagatactagtgtcaaacagcctggcaggtctttgtatgaatggattcattccctctgggggtgatctatttgattagatccagcttatctatttgatgacacccatgtaggtaaaaaataaaaataaaaaataaatcttggagagtaaaataagtaattttttacttgcaaccaaaggcacaattaccacttatttccaagctctgattacttcatttactcccatgtaacaatcaagaaaagaatgaaaaagaatgaggggaaatagtgagctttcaaggagtttattggaagaaacacaaactaggaaataggagacctgcgttctacagacacgaagtatctatttgaagaattgatgtcttcagtcgtcatctggaaaatgaagtatttggaccaactcatacaatggtttaaaattctctatctagaatatcaagagctacgaacatttaaaacgtgtttataatcaatagtaagcacattgcatttactacttaatctttataacaatgctataagataaacaatatcaacatgatcctcattttatagatgaagaaactaaagcataaaaaagataagaaagggtcaaatttatgaaagagctagagatggaattcacaggtggtctggcatcagagctagtggaatatactttctgtctacatttatatcagaaattgaccttcaaaacaaagagaggcagtctctctccctctctgtccttaccgctattctttcttctctcctggaaggtcatattgtttatggagagcataactcttccactgtaaggtcttgagccctgccctgcaaagacggaaagaggtaaatttggttcctcgtgtatctattctcttatgatgctttattaaaggataatttttaagaagcaatacaaagtgggaaaaggagaattattgcccagaaataaattctgaaggctcaggaaggtatatttgtttttgtcccagacataaaatgcaattaaatctaccccatgtaagactgatgaaacttctttcttgatagagagatgtgatttatattctagcattaattaatactgagtttaaggaacttaagtttatgtcagatcatttttttttcctcccaggttgttacttgttgcttctcatatttggccttccttctgcagctgtgttgagagcttatacagtgtttcaagtaggtaataggccgaaaaaaaaaaaaaaaaaaaaagaaaagaaaagaaccctaagtgcttttgtcattacagcagtgagaagaacagacatgcaaacaccttcatatctagagctctctcactgtacccctaacgttcttttcatattgatggtgacagtagtgtcaaaaagcagagagaaagctgtaaaccgtaagctacagggagatctgcaaaaccaagttactcagggtcacaacctgtagttgtgtagtttgtgctttacacaaggggcagcagcgtgaaggaacataacataaccttcgctctccttatcaaccaaataccatggcctggggcaatattcaaccagagaaataaaaccagaaagaaaagaaagtgactaattcaattcacaggtatacatcaggcatctagtgctggagctacatcagtctgaagaagtcaaaactccctgtttgcatgtggcttatatttaaactgtgctgtctaaaatggtactccctggccatatggttatttaaatttaacttaatgaaactatgtatttcaactgcccaatagccattcacagctagcagcttccacaatggacattgcagatatagaacatttgcatcgtcactgaaagttcttttggggagcattgtctagtggttaaagcctaagcaaaataagtaagcaaacatagagtacattaggagttcatgaataaaatgaacgcagggaaagggtcagattttgctgggacaagggaggtttgtgatttttaaaagggtgatcagaaatggcctcacttataaatgatgtttgcctgaagagctgaaggtgataaaggagcaagctgtgaaactatcatagggaggaacattgtaggcatggggaacagaaagggcaatagccctgaggcaggaccaagcccacagtgccaaaggaagaagaaggcaagtatgagatgttcaagagaaaagggtgatagaagtggggaaaagtagtcatagtttgatttattttaaaggtgagtgaactggatttgctggcaggctggattgggtatgagagaagatcagaaggtgggaatggagtaaaggatgacttcagggttttgggtctgggcaccagagaggaatgagtggctctgaactgaaatggggaaagatgtggaaaaaggtttaagctgagagttaaatttagttgttatcagcatatagacgctatttaaagccgtaagcccagatgagatcacctagggaacaagtgtaggtagaaaagagatgcaaagactgttgcttgggacactctaacattatgacattggagccatgagggggagccatatgaagcctgattgattttcactggcagagtgtgctgtcctgtagcccaatggaggcaagccgttcaaagaggagcacaagccattagctctatcaaatgtccttaaagggtcaagtaagataaaaactgaccactagattcagtaacatgcaggccacttctgacctagacaagataaggagtttgatgagttaaaagcctgattagaggagaaattggaggagagaaattgtagactgcacatatagactgctgctcttgaggaattttattctaacggggaagagatcaatggagcagtaggtagagggaggaaagggtctgatgagtacttgaaaaaataatcttaataaaatgacagcatatttatgtgatgctggtcatcttctagtagagagggaaaattgatgctgctgtaaaaagaagagagaattgctatacaaatgttcttgaatttgtgaaagaattgagttctaggacacaggtagaaggcttgggcttagatacaggagaatttatccacaggagcagttgaaaaagcagagtatgtgggtccagatgctggcaggtgatgggtgtaatggtgggagatatatgaagtgtgcttctgacttttttctcagtgaaacaggaacaaaggtaatcactgagaattcgaatgggcaagaacattttggaggcttgaaaacatgagagaaggtatggcataattatctacaggagtgaaaaaggggatctactagcggaaaatagcttagaacaacttatgagcccatgtaaatttcacatataactttaaagtgagaccagtcagaataactatgtcaaataacaataccatttcaccagccatattcgatagggctcaggccccgctaggcagagagctggatgtaaccaggattgagttagagtaaaagagacaagtgattatctgatgtactaaggattttaaactggtttaaaaggaaagtgagacaatgtagattataagagaaatgaaaaattggtaggatcaatggattgtagatcctagaaatactgcagtgtggcagtaaagagagtaaattgaaaagctagaaggtgataataagagaggaggatgcttggaattgatagtatgaaagagttctgatttttgttaatcaaaaggacgagagcatgattacaaaagtgagtcactaaatcctattctaaagatcagctcatgaagtgagtcactttaaattcttattaggtgagtgtactcctcctttgaatatgagtgttatctttttatgaaagaagaaagttttgacttgatactttcagttaatgctgagatttaaaaataaaaaacagcagggcagcatgtttcccttagcatcgaacagctctctttggctgtctattctcttgtaaggttagacagttggagttcgcatttgatctgaggctttaagcttcttgttatactcaatttccaagagtttcctgtttagagacttgaaatgcagcttagtaacaataagtcattatttaatcatgattaaccactttttaaatggacatatttccaaaagggagaggtagcagtttcttaggtgtggattttgtattccttgactatacaagcataaagaaaacatttgtttatttggataatcaagaaaatctcaaaaaggagcagctgcagttttcattaatgccgaagggaaacatcaagaagatacttttcctaatgtacattaaattccaagtgttatttatgaaggaagaaactattttatgaaatatgatctgttgacgtttaaatgtaaattttattttccattagagtcttatttatgtttcaaaaatggacaaatatttatatttatgcttaagataaaaatatagaaatatttctgcttactaatttgaagatttattagcatttgatcataaaaacatagaaaagagactaatcactttaagagccaagaaaaatatgtatattttttccaactttacagtaacttttaagaaacactcaatttggtcaggcaggattcattcaccattacctttaaaagcacaaggtagaaacttatcttcattaagtgccactgaatgtctggcaccacataactaaccagagaattcagtagcttagggtctatggaatgcctcaagttcaaaggaagagagacatcctgtttggtgttgtatttcacttatgctgttaaaactgcccagaccccattaagtgttttctttttcattcttgggcatgatcttctttgtccctcatgaataacacaaagcttaataaaactccatgccagactaaataattttaacaatgtgttataagattttatttttaggtataaaggtctttctttttgtgcaaaagccattttgttaaagatagtgacatcgggtcacacgccactcctgtggacctggcttgttagagaactagcaagaacattgtctcagacccaattccttcacactgcaaattccactgttgaaacttttactacaatgggtatctatggagaaatagtgaaggtaaataaactctaaattttccactgaggaaaattcattctcaattcctgagaccataaacatgaacacagaaaaataaggtgttttgaactacttctgcatacaatgacattgtaaaggatttagcaatatgtattcattaagtctagagtatgcatatgctcattttttctagtttaaaaccacaacctatatcttccttgaatttcctgaatataataaattttaaaaatagaaaaaaaatttaattaaatttggggaaaataatggctgaaaaaatctggtctgactgaatttttcagaaatagctttactgacatttttctacataattatttgtaacagagtgtggttaagaaatgtgtacatctgatttaaagatgacttttgaagaaaaggtaataaagcctttcaaatgatcgcttattgaataattctcgaaaatctaaacaaagacttggaagaatttatgatttgtcaaaactctaggactttataactttttcctttgttttcttagaatatagctataagataataaataaaaataatgtgactcctaaaatgcagtgttacaatttactaaaaattgtttaaagaatgctatgcggaggtttctgatccttcctgtttgctctgctacctttttctgcagaatatctaataatcatatttgtaggtcatatcaattcaaccatgttttactggagaagatcttgctaaactgcttgatttggcaacctaaaagggtgaataatgggctataattctctacataatattttaagaattggagtctacttaaagattttatttgctactcattatatgtgtagaatgagtataatgaagttttaaaagtggttataaaacaaatgttatgttttctctatctaattgctcttttaaaatatggttacttaaaaaaaaaaaaaaaaatccctccatttcagctaagggtctttgccaccagggaaccatgcatggatccaatgcttttaaatatcgtgtccatgtgtgatctttctagacacagttttttactgtcacttttaaaatgttccctataagtcaatctcttcaggaacaaatacatttttgtatatgcatgaatagtaaaatatatttcacacatttctttaatcatctcctctggaccataaagtcatacatggcaactgaccttgtaaagcaccattttagacatttcttggtggaattatttcttaatgattgaatcattcattgatttatttgttttgttttaaaacatttattgagtttttaacattggggaagcattcatagtctattaagacagacacatacacaattatgacaatatatttgtaaaataatattctatgggaacatagatgaagaagtacatcagattacctggttgagtaaagacctcactgacaaggtaacttgtatatggcataaaaagatgagtggtacacagccaaatggaacaaatagctaaaaattttttacataaatattttaaaaattctaaaagcatgttatattttcagaaaaataatgagtggcctcatgttaatagtgtttgaggtatgtgaaggagagtaattaagagaacatattatttctgaaggcgtttcctttgaccacaaaatactgtgagttttataaagaaatattgagagaggcagtatctcattttatctaagttacaaactcagagaaagggtatgtactcagagaaagggtgtttactgtatatatatctacttacttatctatccattgatcatcagtctgcttatgttggaattcacatttacaacatttgaatggaaaaaaaggataagactttttttttataagtgagtctgatttagttgattggtgtgacaaggaagactggtattgtctatctgattgcatagtggacattttccataaattgaatcagctaaatccagaggtccaatattttgaggaaatgtttttaaatcacttacacaatatgcttaaaagtatatcctttaagaaatactaactcataaaaatattagacatccccttaaaagacgaaagaaggtatatagtttttcaaattctgttacgcttatgctaccaaaaagtatgaagattgctgagttaggaagttattgcatagggaaagtttccaaagtatggcttaggttttggaatctccactaagcaaactgttattaatgaaaaaacatgttttaatgttaggatatatttgctatggtttggctgattgaaaacataacttttggatgacagctagactgtcgtccctattaataaaaatgctgtttgggtgtcttgtcaatagaggacacttttcttgtagtgcttagatttgaagtgagctcctatgtggtaactagtaattagtaggactgagtttactcacctgatgtactggtataattttttttttccctgaaagttacttgctctccctatagccaaacatgaacttgatgtcttcttttttattatcttttctgagattgatgaagaatctgacaacctaggctagatcatgttaaagatgttgacatgatggaagactgtcgattgccaatagtaagtttcaactatgtaacaattaaatagatcgtacttcaaaaattttatagattcagaatctacagattttaatcatttggtttagtccagttaaaattaatagtatattaattatttctttggaagacatggtggttagcttaccttataaataatgtgaatacagtgagttaatgatacagtctttaaaaatctataagccttgaactattcaatgtaatttgttatttaacaaattatcagtgtaatttgttatataactagggttatatagccctagtagtatggataaagatggatatccacactaatcacatctaacttttaacaagcttcatactatctgtgacctgtaatataaaaaaattatcttcagtgtggaaatactatcagaaaaattcaaatttctattctcacaaattgataatgtgcattttctgaaataaagtgttgtttgaaagacttgataatacacacacagaaagatgatagatttctctgtacatggatttcaaacaaggagtttctctaatttaaaaaaaaatgaactggtcacacgatatattcaaaacaaaacaaagacttctatcagcataacattccagaggtttttttccctgtccaaaagatgtatgaatacatacaagaattttgctttaattgtgatactcttaatttcaagtctacaaaaacaactcaaatctatacatgcgcacacaggtgcacacacactaatgcacctatgcatactatcattatttagaaatcaaagataaataaatttaaaatatgtctcattaggactgggaaaactctagggtgcttcttcatgctttctaagcatgaaatgtacttgatcctgggatgctgtgaaaacgatgatttagcccactgaagaacagatggcccttaatcaccccatgtggctaaacacacaaatgccaacctcagagacgccttacctttgccctgtctgtcccctctaggctagtcctgctatattaagggttattgcctttctggccctccctgcaatcagcttttgaagtccatggccaagaaggcagtgtgagaataccattatgagagaggtgtttgcttaaagtcatagtccggacaagatcccatggaccccttgatagtctagcagggagccacaaactttagccaatatcttctaattccctgaggattcagaactgcccaccataaaaacataatgggctgtttatctgagcagccagaagataacatcttaaagttacaatctgggttacagactggtgacataaagcaataagaagtacgaataccacccctaccctgggaaaaacaacatgtgaacagtctagtgtatagataccactggatgcccttttctcatgctaataagagccacaactttcccaacatttttctgttaaatagattaaatatacttgggaagaaatggatggaccccgccccttactccatttgcatgctttatactgtttttgaagtttgggactatgttaggaaatattcccactggcacaatcaagtgaatttttgtggcacattttgacttcttttcaaagattgcttaagtcctgtgacattaatcatgatcttctaataatatactacagagattcccaaaaagatactttattcccaaggctccaatactgcaacagatcagactctctttctctctctgtatatatactatatatacatatatatatatatacacacacacacacacacacacacacatatatacatatacatatatatatatataaaattgtatgaataatatattttgttcctgtgattctttgactctctgctgggacagaattaaaatatctcagagttaaaaaaaatcctcttttttccaaacgcctgttatttgtctgcattgctgacattagggaaaagaaaagctaggtttgatatttcaactgcatcaattgaacacgtaatatagtggagactttacaactgtttgtttctggtaagcctgtttgttattattaccagtcaactgggagaatccaatgcctgtaggggatcccacccccaacaaatgaatctctatgattatggagagtgaccaaattaaccacataattgctagacttaacctcattgtatagtatgggtattttaccacatataaatatggccatgaaccaactatatctcaacccacttggttcgttttaaacatttcctgaacatccaataggattgttttcataacttatcttatttaatcataaaagttgtttccatatatcagtccagtatttttaatcttttaaatgttcacatctgcatatatacatttctaatctactgcatttaacaagcagctttcttttttatttgtcccaagagtatgtcatattattattttatgccagattcaatttagtcacaagttttgtctggccttacctactgtattttcttctaccctttcaggaaccctgtaaagtggcagaggaaaagttacacatgaaattgccctaaagtgtttggaaacagcttcagtcacaactgcattgtgctatgcaataaagctaccctcacaggcaactgttgctggaggctgaagcctctggaatgagtctcagggagaatgtactgcatcccaaactgtcttccttaaggatgacaacagtgaaatgtctgccctgcttgggaacatgcactaatgctgctttctcttacaacttgaaaacgttttattggctttaagaatttgtttaatcaaatcctagtgaaggttcttctcactcctggggctgtttagtaaaatatggattagggcaaagccctctaatgtgtccttaggagagtcatcatggtgagatctgtggaggggtaggggaatgaacaggctccagaagattgcttttagccaaaaaagaaggagaaaaatgaggctttggcaggaataactctctgtgtttgaaaccaaactatgaaagaaaagtatgtgagtaaaaaagatttccccaaagattcgtttggaatagaattttcaatataatgaagataaagcagttttgagaaccccctctaacaatattttatttctaatagaattgcctgtgagcaactgaaacaattgacaagggcagggggaaatgattgaatgaactgcatcactgaaataaataaaaatatgcttacctcaggatatcttgttggatttcctaaaatataattatttagctacgtatttgaattagcacataaacaaataaggaacacttttgattttaatatctgaggaatggaaaagtttggaaaaagaaatttcacactatttataagtgaaatatgtctctagtttacatgtacaaattttctgattccaggaatctctgcagtctcgttcctttgagtgttttctaatgagtataatcatctatagtaatagtatttatttacatatggcattgtgctaaggggtaagcaaaaccaattgtgcagagctagtcagtctgatataataaagcatgatacacagttatgtaggggaatatgaacaaatatattcagcaattttcttgcatgagcaatttgaaaacaattttacatgttcaggccagagaatacatgtttgatcagagtaggagaaaggaggtgctttgagaaatgatggaatttcagcctgatggttaactatagcaagggctgtggaactaaataaacctgcatttgggtcctgacttggcccttctaagcaataacatgactttaggcaagttgttaatttttttaaatcccagttttctcatttgtaaaacatagatgacaactgcattttattcatagtttacgtaaaatacttgtgtggcgcctaagcaatggtgttagaccaaaatcagggaatcggtaataatcctttcaagttttaatccattttcatcttttttgacttctttattacatatccttcctcttgtcaatctttcaaatagacatccagtggaatttcctctcttccacattctgaggccatccctagagtttctgtttttagcttccttaactcttttttaccatcgtttcactggcagccagcatgtgaccctgaaaaggtgaattttcatacccttgcagaaaatgttgacagctttcttatctttgtgtcagctatttacgcccatttactcctcactatctttctgacaaacattctcatttattctacctacatcctaaagtaagccctgataaaatgaagcttcaattccactcctaagatctcttctctctttcattgttagtcaccgttagtcgagaatgtaccatttggctcactctggcttaggatctttgtagtcaagcatgctgttctctctctctattttatcaatctggagtcactttaatgttccaaatggaattggagccagatacctcatattctgttcacctccacatgacccttacacaactggcaacaaatctaggatgagaataatgctggctacgattgggaacagagattctgatggaagtctgtagtttcgatagtcataattacaatacacacaattcctgtccttccccaaacacccaacaattggaacaagtacgagctttagcattccttggattaaaaatatgtattttcccgatttcttttaagtagataaagtttactttctactttagtggcaagtatgaatttactgaaatagtaaggttttctgctttacatattcatacaataaaagtagaagataattatgagagatacattcttcttcccagtccaaccatgttataaaaggaggatttaaaaaaatgctgctaccaggtgaaagaattcacagattatctatgatgatcagggtgctgcgttgccactgtaatgataaagtgtgtgtgacataagatgtgctctcaaatctcataaaagttaaaatctatatggaaatatgtcacagggatgaatttgttataaaacatttagatccataaaatattgcattggcttatttatcatctgagtttcctacttgctagatcctcagcataagttaatggggaaccctctaccctccccatttcttttttttttttttttttttttttttagatggagtctcgctgtctcccaggctgaagtgcagtgacgcgatccgctcactgcaagctccgcctcccgggttcacgccattctcctgcctcagccttccgagtagctgggactacaggcaaccgccaccacgcccggctaattttttgtatttttagtagagacgaggtttcaccatgttagccaggatggtctcgatctcctgacctcgtgatccgcccgcctcggcctcccaaagtgctgggattacaggcatgagccgccgtgcccggccacttcttttcttttttttaactagtttgttttgttttgttttttctcaaagtcttggtctattgcccaggctggagttcagtggcgggatgtccactcactacaacatccgcctccagggttcaagggattctactgctttagcctcctgagtagctgggcctacggtcatgagccaccatgccaggctaatttttggttttttagcaacctgaccatgttggccaggttggtctcaaactcttcgcctcaagtgatccacccgccttggcctcccaaagtgctgggattacaggcgtgagccactgcgcccggcccagcctccccatttcttgttaaccactcatgacactgtcagaatccctcttgttgctcacttctttttttgctgttgtaagctgtggccttgccatatatctcttaccagcctgcaggcacttgaaggtttaataaggcattttatacagagtagatgttcattaagacaatgttgtccctcagaagctagataagctaaattcaaagcttcttcacgtagatttttgaaagtccatttttctacttaagattgtacaagtgaggtggtgaggatagtgtgatacttatagtttcttgaatgttgtagctctgtgtgcctgcttcctcttaataactttatgttaaagattattgccacagctcaacagtgccatttttacattgcataatatcaatgctaatgtaaaattaaacccttttaaaatgttttcatgaagaaacaaacctgcaagtttttgtgtatgaaagcatttattgtatgcagggaaatggaagggatttccattgcagatgagacagaaatgtaacattccaatttctagaagtatttcagccatctgtgcattttaaactacaacctcttaacatattacttagcactcgcactccttcttccttctccctcatcaagttttatagttatttctaatgctgaatagtttctttctttctttctttcctttcttttccttctttcctttcttttccttcttttctttcttttctttctcatctttcttttctttctcctctttctttccttcattccttccttccttccttctctccttccttccttctctctctctctttattttttctttctttttgctttctttctctctctcttttctatcctttcttttctctccttttgctttgtctcattgacccataacctctgcttctaattcttcactttcaaatgtctttttccttttttttttaacgttattttttttcttgagatggagtctcactctatctcccaggcaggctggagtgtagtggcacaatctcaactcactgtaacctagacgcctcccaggctcaagtgattctcctgccttagcctcccaagtagctgggattacaggcacttgccaccatgcctggctaatttttgtatttttagtagagacagggtttcaccatgttgggcaagctggtcttaaactccttacctcaggtgatccacctgcctcggcctcccaaagtgctgggattacagacgtgagccatgttgccaaatgtctttttctaaatacagatataaatgtctttttctaagtacagatagttcctctgccaagaaacattttgagttgttaagataatatagttttctgccctgctacaaatgcatgaaatagagtttgtagaggatctatggtggggaaaatgatggtaaagagattacaggatgcaacagtggcaaaggaagcccagtttatttgctccttcacagctccagaaaatatacagcagtgactctgaagaccttgtttgacggcctcctacaaatagattcaactaacctgagcagtcttgtttaaaatgcagattccttgtcttaacagctagagattacaatccacctgttctttattcaatacacacacaatcaatttcgaggaccactgacaaaaggaatgtgataacagctgatatggccatgagtacactgcacttttcataaggtttttaagccctggaaagccctgatttaaacctgtgattctccagaaactcctgtgctggaggtacaacagtttggaagtatacttggggaaagagaaaacacaagatggaaggaagatctctcttttcacatcgggagcaccctcacaagaaaagaagaaaccagctgcaagtgcatccaaaagcatagaaaccacaaggaggcactatggaaaccacctgcaattaaacccaaatgatctcgagggtaggagtcaatcctgcaggatgttgtcccatgcagagcatggaaaggtgtattttttctttataattctgtttgaatggaaaacaatttagctcaatgtagaagagaagggagagtctcacataaatcaatggaattctgtgatttgaaaaatatttcccaagtgaaatagaacaatgcccagaacaactgttaaacacatttgtcactagatgagctagaatgggaattctaaattacttaattcacgagtgatgaagttttgtttacaatgactttttaaagaggggcacattataagatgctatgatgcatgtcaagattatatcacctagctttattcctagttgagccttattgctagtgtaagaattccctgcagattttgtgatgtcatattatttgacaagcaaaatttgccaaaaggtcaaaggaaggaccacaggctttctgggaagggccacagggctttggagctatagctagataattccttgggcaaaggtggacctataatcctctgtatcataccaccaataatgcacaatcagataattctggaaagaaaacaaaactcaccaaagggcaaacttgagagagcatgagccattcttacagtttactttacttttgttagggtagtgacatcttgagagtaattcttagaatgtctggtcatttgtagcattatccatatgcagaagtttgaaacggagccactcccctagaattggatctgattaaatttatacctctggtatcatcataatgtattttattctgtacacatactatgtatatatcatgtatttagccatttttacagtgatttttccaggatagaatgttttattctaaaggaaaaggcatcatttattatactgcctcttacaatatagtagaaaaacactttatatggaccatttttaaatgtcacatggaatagttagttaatttgagacatgaaatgtctcaaattatgcatattctttaaaaacattaatattctagaaataagcataatatagaagctcccagccacatcaattatagtgcctttatgtattcagagcttaatttttttattctttgtactctttaaaaaaaattttaattgacacataattgtacatggttatatggtacagagtaatattttgatacatctctacagtgtgtaatgattaaatcaatgtgtgattattaaattaacatatccatcacctcaagcgcttatcatttctttgtgatgggaacattcaaaatcccttcttctagctattggaaaacagaataaattgttgttaactgtagtcactctacagtgttgtaaaacgctagaaggtattcctcctatctacctgtaattttgtatctattaaccaaccttttcctatttctccctctctccactcacttcccaacttctggtaaacactattctactctctacttccatgacatcaactcttttggcttccacatgtaagtgagattgtgcggtatttattttttttgtgcctgcattattttacttaacataatgttctcttggctcatctagagccacaaatgacaaaaaaaaatttcattctttcattctgttttaatggttgtataagattccattgtctatttataccacattttctctatccattcatccattaatggacacataggttgattccatatcttggctattgtgaatagtactgcaataaatacaaaagtgcagatattccctcaacacattgatttccttcctttggatatacacacagttgtgagatggctggagcatacagtcattctatttttggctttttgaggaccctccatactggctgtactaatttatattcccatgaacagtgtataagagttcatttttctctacatcctcaccagcactagttattgtttgtctttttcataatagccattctaaccggggtgaagcaagatctcattgtggatttgacttgcattttcctgatgattagggaggttgagaatattttcatatgcctgttagccattcgtatgtcttcttttaagaaatgattattctgatcaattgtccatttttaaatcagattatttggttttattttgctgatgagttgtttgggttccttgtatatatattctggaaattaattaattaatagtttacaaacattgtcttccattctacaagttgtcttttcactttgttgattgttttctttgctctgcagctttctagtatgatattatttcattgttttatttttgcttttgttgcctggtgtttgaagccttatccataaagttcttgcccagctgaatgtcccaaagcatttcccctatgttttcttttagtagtttcgtagttgtgggtgttccatttaagtaattaatccattttaagttgaattttgtatatggtgagagatgggagtctagtttcattgttcttcatatggatattcagttttcccagcactatttatctattttttaaattttagattcattacatactatgtgcaggttcattgcatggatatattgcatgatgcggagactgtcccttccccaacgtatgttcttgctacttttgtcagaaatcagttgactctatatatgtgggcttattctgggtcctctcttctattccactgatctatgtgtctgtttttatgccactgccaagatatgttggttattataggcttgtagtatattttgaggtcaggtagtttgatgcttttagctttcgttttttttgtggggttttttgctcaggactctttggctatttggggtcttttgtggtttcatacaaattttaggattttttttatttgtgcagagaatgatatttctacctagatgatctgtccaatgctgagagagtggggtgttgaagtccccaactattgttgtattgggatcaatctctctctttacatctttacattaacttgatagggattgcatttaatctgtagattgctttgggtaacaaggctattttaacaatattaattcatccaattcataaacatgggatgttttttactttctgtgtcttcttcaatttatttcatcagtgttttacagttttcatcatagaaatctttgacctccttggttaaatattttctcatatatttttgaagctattgcccattggattgctttcttgatttctttttcaggtagctcactattggtatacagaaagattactgattttttgtaggttgattttgtatcttgtaactttactgaatttgtcaattcaaggaattctttgatggattctttaggtctttatatgtgattatattatctgcaagcagggagtttgactttctcctttcccatgtgaatgccttttatgtttttctcttgcctaattgctctgactcggacttctagtactaggttgaataagaatggtgaaagttagcatccttgtatcattccagttcttacagaaaaagctttcagcattcagtatagtattcatcacagttggctgcgggttcaaatgctctttctgtgtctattgtgatgatcgtatggctttcatcttttattctgttgacgtgatgtaccttgattattgttttgtctaagttgaaccatccttgcatccatgatcacttgatcatggtgtataatctttttaatatgcttttgtattcattttgctagtactttgttgaggatttttttgcatctatattcattgggggtatgagcctatagttttcttattttgttttgtccttatttggttttattatcagggtaatattggcctcatagaatgagtttggaagaattttctcccctttaatatcttggaatagtttgagaagacttggtgttatttattcttccagtatttgttagaattcagctttgaagacctccagttcttggtttctctttgttgggagactttttattactgattctatcttgttatttgttattggtctgttcaggcttttttttttttttctggtttaatcatggtaggttgtatgtatccagaaatgtatctatttcctctaggttttctaatttgttggtttatacttgtgtccgttttatagttgttgcatagttgtacagttggtgtcagttgtaatgtcttgttgttgtatagttgtatagttggtgtcagttgtaatgtcttgtcatgtagttgtatagtcggtgtcagttgtaatgtcttcttcatttctgattttgtttatttggatctcgtctccttttcttagtctagctaattgtcaattttgtttatcttttatttttaaaaacttttcattttgttcatcttttgtattttttggtctctattttgttcatttcttctctgaaacattatttctttacctttactaatttggggtttggtttttcttgctattctagtttttttttagatgcattgttaggttgtttatttgaaatctattgtttattgctataaactgccctcttagtactgtttttgctgtatcccatgggttttggtgagttgtttttctattttcatttgttccaagaattttttaaatttcctttttaaattcttcattgacccattggttattcaggagcatgttgtttaatatccatgtatttgtacagtttccaaaattcctcttgttattgatttctaattttattccattgtggtcagaaaagatatctgatatgatttcaatttttaaaaatcttttgaggcttgttttgtagcctactatatgatctattccagagaatgttccatgtactaatgagaagaatgtgtattctgcagttgtcagataaaatattctttaaacgtctgctaggtctagtgtagattaaatccaaagtttctgtgtggattttctatctagataatccgttcaatgctaagagtggggtattgaagtccctaactattttcatattgggatatctctctctctttacatagaataatatttgctttacgtatctgggtgctccagtgttgggtatttacaattgttaaatactcttgctcaattcatcttattatcaatatgtaatgaccagcactatagatgagcgagctttagggagttatttcctctcttatgttcacttttctcagctgtgaaaatgaacataaaaacctttacccctaagtttttatcagaataaaatgagataatattttaaaactgtagaaaactataaaagtatccaataagtgggtataagtattaatattaaatttgttttctttatcaataaataagaaacatttgaaaatatgttatgcattgaattaccactttctctgaaaattagcctaatttagttgctctcaaatggaggtgattttgctttcctggggattatttggcagtatctagagacattgtggttgccacaacttgaaggtcccactagcatccagtgggtagtgcccaaggatattgctgaacattctacagtgcactggacggttctctatatcaaagcatcgtctgctctgaaatctcaatagtatggacattaagaaatattggtcagattttaattttaaaaaacaaaaatgagacaactgtaaattgcataaatcgcaaggattctaacaaaaaattagagtaatcccctattactcagaagtttgggtaagacagatttgtgttaaacttacagaaggtttgagaggtaggtattataatttcaccaagaatatgctcatgcaccttgaaatgtatgttctgctagagcttaaataatgtgtttagtaattcactgcactgtaaataatactgatcttaactattagaaaactaaagagttttcagtgaaaacgttgctatttagttgtagcacatacaaatggatattttctctgcttaaaaactttctatttctcttttgtgtcagagaggactctagcatttttgagtactagaacaaaggctgtataagtatatataaataatgcaaacttttcaacacgtggctaatttccacggttgaactttctccagttcttatccaaatatcttccacatcccttctggataaaaatatcttaattcgccatgtctaaaatctgtttgtattcaagacagtcactcaagtcagaataatagaatttaaactacttgatgcacaaatgtttttcatttatagatgtaggctgttgtcaaaatagaatgggaggatgtttggcaatctatctgatgattatttaatacttaaggaatcaggctacttgacatacgtggtacctcccttctagacatttacagtccaaaattctaaggtaatgacatagcaatacacaatttgttccacccacctttaaacaaataatatgcgtaattttctttctgtttcctttggactccatgtgcctgaccctgtgccagaaaataagaggacgcttatagcagccttcctaattaatattgacatcacagcatatgtaagttttcattaaagctttgagaggtggttcagtagatgtgaaaatgcagtttcattctaggcagaagagaagttaaaaccctagaagataagaatttaaaaagataatatattgactagcagtgaatggattaaaaaacagttggaagttaaggatgaagcatccacgattcaatataagtactcattgtaaattgtaaattagctctttcaataattctggtacagaagacaattagtaatttgcaggtaaatatttaaaaagtagctcttaaaaaacaaaaacaaaaaaacaaaaccaaggaaaatatccacactactatggtctgaatgtttgtgtcctctcaaaattgatatgttaaaaccttatcaccaatgttataatgttaggaggtagggcttttgagagctaattaggtcatgagggtggcagagccctaaataaatgggattagtgccctcaattaagaggccatcgagagctgtcttgcctctcacaccatgtgaggacgtggtgacaaggtgctgtctatgcaccagaaagtgggccttcacccagtactgaatctcctatcaatctgattttcttctgcttgatcttgaacttcccaccctccagaaatatgagaaatacgtctttgttgtttgtaagctacccagtttatggtattttgttacagcagcccagacagacgaaggcattccacccggctattcattcgtttcaggttttcaatgtggaagtaactagcacagctgagacaagacatgcaacagcaatccatagtccagtatttcaactctatctgtacaatagacataagtaacccccatagcacaaataatagcaaatatagtaaaataattcagaaataatgaatttggggtacataatgcctttgtttctaatataatttttaagttgtaagtttatataatttaacatttataatggtgtttaaaccaggctcacaaatttctgaagatttagctgtcagttcttgcaagtcagtatgagctggctttagcacaccattgatgggatagtcatttcaatttcccacttaactttgatgtattgagttggaacttgatgtaaaagatgactagtagtcactgtaagtgtattaaaggtcattacgctgggagagaaacatattttttgaaattttgaccgttaaagatatagcagaaaaaacctctggaatagaagttacactatagaattggtatagcagtatttggaaagagtataaatattggaatactttacataatacaaccaagaagagattataggaaaaaagcagaatgagaaacatgattttggggactaagaaacttgtagcttgtttgtgggcttaagatttaaaagggatggttggattacaaaatcttgtgtatcttgttcaaataaagatatatgaccactgactgacaacaataaatcaatttgtacgcatttgtgcatgtgtctgtatgtgtaggggatgtgtgttttcaaatgtggcatctgtcaggccatatttgaaatgcacagtttttattaaggatcctaaaatcttctgtaaggatattttataagtagagcatgaaaaccaagtagacattttctttagattgcctgaaaatttaaggtacatttttgtctttatgccaagagaactggttactttaagagctaaaccctatattgctatggcttttatcaaaaagattccatttactatattgctctggattttcctgttcctttcttgttttcagaaaaccgcaacaaactattttttttttaagttgaataaaataaaagtagaatgcctcactttggagaggaaaagaatagctaaggtcgagcttaaaggaaaaaattacaaaaaattatgtgccacaatgaagctttgaaaatgaagcattgaacaaatgaaagaatgacagtttgcaaatcaggagtccagaagttttgttttatgattatgttgcagcttaatttctttatatctttctgccattgttaaaaaaaaaaaaagcagtcggaacttcaaagcgaccccgcatgtgttctgaatcagggcttcagagctgatgtctgacagcccagaaattaaaacgaaataaatatgccattttaactccaattttttccctaacaacaacaacaacaacaacaaaatcactttttctctatttatggtttttttgttaactttaaaattgtgttcctttggatattttctcatttaccaattatgggactgggcccttagagtgcagagttcccgtagacttcagagggaatttcaggaaacgagagtagatgttaaggcttcgcatcagcctttgtgactttttctgtactttaaaacagaccctcctctcaccccccgctggaaaaaaaaaaaaaaaacagaaaaagacaaagaaccttagtcgttaggccatacccaaacacctgcatttggctgttcttgcattttcttgggatgacggaagcagacatctccaaagaacaaagaaaggctcagggatggtttgtgtttgaaagtgtactagcgtgaatatgaaatgtcagtcactagccagaaatttggcagccatttcttggagcattgaagagagtaattagagtttgacccacagagctctgtgatgtggtggtagagatgaatctttgactaatgtagaatcataaatgcaaggggactttgatatcatctgcaataatttcttagttttacaaatgagaaagtgaggacactgtgtctcagggtggcaaagtgttttgctcaaaataatacagttagtaaagtggtgtaaaattttgatgaattctgttatgtggctaatgagatagagatagaagctattgggcttcagagagaaactattgaaacttcaggtagaagctactgggcttcagagagaaacaggcacataaagtggtgtaaaatgttgatgaattctattatgtggctaatgagatagatatagaagctattgagcttcagagagaaacgggcacacaaatgctttggatttaagtgcagcattctacccgcctatcagagccattactcccaaacacctctgccttccttatttaatcaatattcacaaacaaccaaaaagtgtacatacatagaaaacaggagtaaaggacttgctggccatgtcttcgcaaagaaaagcagagaaaagtaaagccactctgggaatatcctaagtttaatgggcttgggttctttcttttctctcccacaatgccatctcaacagtctgcacatctggcctgcagagcatcccagaatgtttatttccggaacctaagaggctttcctgagtattgctggggaagagtccacattttattgatgttagaatacattctgagagtatattgtgcccaatcagagatgatacacttcagtttcaatatgctcttagaagttctgtgaatatttgtggtagacagaaaatagtaaacatgagctgaaatgctttcaaagctcgcaaatatgaaatcatcttatgttacttaggaaagagcaaggagaaggtccaagcactgatctctccgctcagacactgtcatggtttttgcagtcagtcatgagggagaactcaggatcaagcatgggcactgcacaattgaagcatccctctggacctctggatatgaatttgaaaaaaaactgggatttttttttcagtaaatactactgtgtttatttattggttgatgtgccaagaattaggatgttgaactactctttcaaaatctcacaaataaattgaaaatagaaaagacacgtatatatgaaaaaagacagtatctgattgagcaaattctgcaagcaaaatgtctagtgatcagagccacttgtctgaacgttgtggtgggggcagcagagttcctcttgagtggtaagttagacatagatgagaggaggaggaaaagcagatggaaagaaggacacgagtgaagagatcacatttgttctccagcaaccatttgctgcttttactgtgtcctttcattggacaaagtaaataagtacatttttttcatgtattcaccttaactttgggtgttactatccccgatttattgaagaagaaagggagactcagggaaattaaaaatatgtctgagatgacactgatgaccgtgagagagatgaaattcaggcccccaaatctatgctcttatctaatacatgcaatggaaagcctattcagtgcagtcattttgacaataacggcatattggggccctgattaccaaactgagcagtttaagctcatttgtcattgggtagtttgagatagtgtgtcattagcgttgacagacattaaggtttcacaatcttgattacctattggccaaagtagtgacatcaggaggagaaaccgaggatgacggataatggataatatttaaacacattcaattaaaatcaagtcgatgtgcaaagaaatgcatttctggccatttctgattggagataagggctagaaaaggcgaacaggaagaaaaggagatttcagtctttggttcagtgataatgggtataactgtgacaatgaaaacattcactgatgaaccatgtttgcagagggagaatggagtgctgaggccagtctctgaggagtacccatgtttctcaggtggaaggaggtagaggagctggcagcttgacatgggggggatggaggggaaagggggaaatccaagaatgtgatggcactaggccaggtgagaagagtgtttcataaagcaagagagataaaactgttaataacagagtattattctagaaatattttatatagcacacttaatatatgatttttatagcttttattactcaggttaagaatagacataagaattttagacttttttcaggtgatcattaaaagttgctcctaagttaagccaccaaaataaccacagtcttactaccttttcacacttattgtctgtctctcctccactaaaagattaatatactcttgggtaatgcattcataacacagtttgaccgcatagctctacaaattgtgccacctccattgttttcaccagaaacaaaacatgaaattattctattgaatcaactagctgaaatgatgaagtatccaaagaacctgcttttccttgtagttaaatgattacggtggaattaatgagagttctcctgtttaaaaacttagttttaatcctaggggcctgaacaattgttttgtgttgagaatcacggcctctcatatttagttctctggttggttcaatagagcccaagttgcttttgtttagtaatattacatgtttcagatcccctgtgcaaatcaagtctttgcccttttaagtcgttggtaataaagaggtaattacaacatagaaaactttttgcaataaatacttgagttaatcagtaataagccacaattaatgtaaaggcctaattataaagaatagccaatgcacttcaaggaaaatttataattgtcagaaacacaaagtcagaagggcgcttatgtatcattttgcaaattatcatttccaaggagttgccccttatcgtgatacctaaactatttatttactatttttggaaggttttcttcatgttggcatgtaactgtttatacttcatcataaagctaaccaatatgatggtaaccagtttggtgttaaatgtgagtaaatagtttcctttaggactatattttgtgagagccaggacacaagtccacttaagcaatcttcctagagaagaaaaaatgttgtatcattctagaattaacaagcagttacataagtcttacaatgttaggcacttttctatgagttttgcaagtattagtatttaaatgttgggatgtgtctcccaaatctacagccacctgataaaaacaacccattgatgtaaattcattgtttcaaagaagatttcacagggattaaagggaagaagaaaagagcacttgaaagggaggtgggaggcaggggagaagcaaaagaccaggatgaaattccacctcctatacaatttcatggaagtcctagacctggaataacaatgtatactattatttatcttgttgataagcaaatcaaaatctgactgtcttttatttttgttttggtatgcttaagttgttgactactaaaaagtaataaaagttgtcaaaggctctcttctgttccatgggtctatatctctgttttggtaccagtaccatgctgttttagttactgtagccttgtagtatagtttgaagtcaggtagcatgatgcctccagctttgttcttttggcttaggattgacttggcaatgcgggctcttttttggttccatatgaactttaacgtggttttttccaattctgtgaagaaagtcattggtagcttgatggggatggcattgaatctataaattaccttgggcagtatggccattttcacaagattgattcttcctgcccattagcatggaatgttcttccatttgtttgtatcctcttttatttccttgaaaagtggtttgtagttctccttgaagaggtccttcacatcccttgtaagttggattcctaggtgttttattctctttgaagcaattgtgaatgggagttcactcatgatttggctctctgtctgttgttggtgtataagaatgcttgtgatttttacacattgattttgtatcctgagactttgctgaagttgcttatcagcttaaggagattttgggctgagacaatggggttttctagatatacaatcatgtcatctgcaaacagggacaatttgacttcctcttttcctaattgaatgccctttatttccttctcctgcctgattgccctgaccagaacttccaacactatgttgagtaggagtggtgagagagggcatccctgtcttgtgccagttttcaaagggaatgcttccagtttttgtccattcagtaagatattggctgtgggtttgtcatagatagctcttattattttgagatatgtcccatcaatacctaatttattgagcgtttttagcatgaagcgttgttgaattttgtcaaaggccttttctgcatctattgagataatcatgtggtttttgtctttggttctgtttatatgctggattacatttattgattttcgtatgttgaaccagccttgtataccagggatgaagcccacttgatcatggtggataagctttttgatgtgttgctggattcggtttgccagtattttattgaggattcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaaccgtagaagaaaacctaggcaataccattcaggacataggcatgggcaaggacttcatgtctaaaacaccaaagcaatggcaacaaaagccaaaattgacaaatgggatctaattagactaaagagcttctgcacagcaaacgaaaccaccatcagagtgaacaggcaacctacagaatgggagaaaatttttgcaacctgcttatctgacaaagggctaatatccagaatctacactgaactcaacaaatttacaagaaaaaaacaaccccatcaaaaagtgggtgaaggatatgaacagacacttctcaaaagaagacatttatgcagccaaaacacacatgaaaaaatgctcatcatcactggccatcagagaaatgcaaatcaaaaccgcaatgagataccatctcacaccagttagaatggcaatcattaaaaagtcaggaaacaacaggtgctggagaggatgtggagaaataggaacacttttacactgttggtgggactgttaactagttcaatcattgtggaagtcagtgtggcaattccttagggatctagaactagaaataccatttgacccagccatcccattactgggtatatacccaaaggactataaatcatgctgctataaagacacatgtacacgtatgtttattgcggcactattcacaatagcaaagacttggaaccaacccaaatgtccaacaatgatagactggattaagaaaatgtggcacatatgcactatggaatactatgcagccataacaaaggatgagttcatgtcctttgtagggacatggatgaagctggaaaccatcattctcagcaaactctcacaaggacaaaaaaccaaacaccgcatattctcactcataggttggaactgcataatgagaacacatggacacaggaaggggaacatcacacactggggcctgttgtggggtggggggaggggggaaggatagcattaggagatatacctaatgctaaatgacgagttaatgggtgcagcacaccaacatggcacatgtatatatatgtaacaaacctgcacgttgtgcacatgtaccctacaacttaaactataataataataattaaaaaacattaattattataaattgcttttataacaagacactgtgctaaattatcctatttttaaattctatatgttttctatataattaaacctattatttataatgtaatgatagtctaatttctttttcccaaaaaaataaaaaatgttgtgagaggatcaactcaaataacacagctagaaggaagccttcaagattttgtagtcagatgaccttcaaacctcaatgcaggtagaaggacctcagtggaaaaactcaaacctcagtagaggaacttactttaaatgcagagatttggattcaaacttggtctgggatgaggctcacaaatctgcattttaacaaacacccaggagattctgattaaccaaaggttaaactccactttaagaaatatgagttagtctgacacttatatttgacccttagagaaacaaagcaaagtccagagatgggaattggcaggtccaattatgcagtaggctatagaacctgagttagatttagttactaatatcatttgaaattattgattaattttatccaaattcagaatcagtggtgccaccctggctctgttgctgatgcttcccaaggtagactagataattttcctaagcagttaacatttttatggtaataaaaatcgacaaatgtctagagagggtttaagcagctggcagagaacgcctgggtgtctcctaagagaagtaatgtctcttcaatgaatttgaagttggaaattattaggatgagttacacaactcttttgacacatggtgataatgataaaagctttattcctttaatagtcactatgaatttcttttgtcacctattattaattaggtaattttgaacacccagttgctattattttctgaagctataatacttgtgattgggataagtgaaatgctgatggtcccactttaataaagtgctactttttttatcttatacatctatccgttaatatccagattctgaaattttaactatttttgaaaaatctaaactcacactctaaggttagagcaatagactcaacagctgcgtatccctagtgtattccagcttgactcccagtctaatgcatctgcgagcttctttggtttgaaaagtagttgcctaatctcattatagacccttgttgaaagatgtccatgacctctcagtttgaacgattctagaatggctagcatagtgcttttttatttattctggtacatacccagctattccccaaagtcctggcaactcctctttatctttgatctccccaccctgaatctgtcctctgcttacctcactctctcatcattcaattccacaatcttgtcatcttctttcagataccttaagtgtcttgaagtgtttgacctaaaatgtcaccgccttacccgaaatactctatctttaccattatgaaggttttatagcattttatataagttggatattgggcttcactcacaagtagaccatggcttaagatgaaagacctctggcataataaaggaaagactcccttttcatgtcccacacctccaacttggaaaggtaggaaaatcatgcaagataaaaacaatgatccaatacgctatggaatatgtaatgttattccccaaagaatgatagttatatggaaatctttcatggaaattggaggcagtctttattttcttttaatgatttttttaatggcaggtgggaatagacttaaaacagaacaaaaccactgtgataagtatttgaaaagaagcctttattttatccatattgacaggttgaatcatggcatttgtaaaaatggtgtaggatcttggccatgtttgtactgcggattttctgccctgatgttggagaattgcctgttttaaaaaaaaggaaggaaaaaaaaaaaactatcctaactatcctattgggcttattagatgcttatgaattttgctaaatgttatcctttcttttgcaaatattctttaagtatttctattaaatggtgatttattttaaaaatcatcaataacaaatgtataatagaagcttatatactatggaattcttaatctttaacaaacacatttagaggcatttcatatttagttaacatacaattgctgtctaatttaatctaaattaaatggttgcttgtaacttacaattcggagggttcctgaacctcgacttatggcaggaaaaataagaagtcatcagttttgcccagagggtagatacttatcttttaaaatcaggtattttggtcttgaaattaaaaaccctggtcatttgggaaatgcaattccaaggaatgtttttggcaatgagacatgtccccattttccttagaaggcagcggttttgtttttctaccatttaacaaatctgtgtaatttagctgatacttatctagcactttaaagatgaatgatcatctgtttgtgaagaatatacacattgagattcaatagtaatattttcgttgttgtttgtttgtttttttaaagaccagataacttattgtgtgtcaggtactatgctagttgaaaatatcagtttataaaaagcaactaggcattcagaaaccgtgaggatgattatggcaaatcagtgcataagctttttggcaatggtcaattataagtgttgccatggccatcataacctgagttgaattttgggagtactgccatgaattaatgctgtgctcaaagttaaaatgcaagcttagatgcaagggttagtttgaaaaggaattagttttttgaaggggtgatatatttccttttcaaactgaaaaaatagcaaaaaaatcgaagtggatcagttttaactactgtaagttgtagcttgagtaagaagaatgggttacagtcattaacgtttgaggattatttttcaggcacaactggcactgtgattgtagtactaatgcattaaatttgcacttcaatattacttggatttagccacagaagagtggcttggatgacaggcactaaagtcaactgacccaacctcttatcccaactttgtcattgattgacctttgttgcttgggcaagttaatgttcttataacttgggaagttgtgtggtgaataaatgagataatgcatttcagcacttagcatggtgcctggttatattaggtctcactaacattagtttatacaccatataagggtaatgaacacctttgcttggctcataactatgccttcattgccagcacagttccttggtcacatagtagcttcttagtaggtatctcttaattgaatggatctaccacaattattttttgagtcctcttgaatacatggtgttttagttttaccctgtgtaaaactaaatcaatgaaattttgtataagttaaatttttttagttaaatacatctttttttttccatacacctatgtaagcaagagtttgtggccagaaagacttgagcctttttcatttggtgtgttatatttatttggacttgaacttcttccccacacatctctcactcctcaccctcacccccatctttgaacatgattttctacttatattggccacaatgtcttttttaaaaacattgttcaaaaaggatactagatattctatagcagatatatcataagagcataacatttttcatgttttacttgctcttctttacttttcctcaaaaaattgctctctggtatcactatgggccttagtttcctcatccacttcttaaaacgatagaattggagtatgtaaacttgcaattatatctagatctgtaattgttaaatgaaaagctttcattaaaagtataaatactggccaagcatggtggctcacacctgtaatcccagaactctgggaggccgaggcaggaggattgcttcaggccaggagttctagaccagcctgggcaacatagtaagaccctgtccttataaaaaaaattgaaaaattagtagggtgtggtagtgggatgtaatccaagctagtcagtagactgaggtgggaggattgtttgggccctgtaattttaggttaagtgagctatgatgatgccactacactccagcctggatgacagagtgagacttcatctccaaaaaaatgtataaatactgagcatctgccatatgccagactctgtttgataaactgtgtatccattttgcagttggcctttaatgattaaatattcatttcaaacctgtgatgtagaataagtagtatttaattttatttataggtaatataactgaggttcaaatagagtttataataactcatatctaatagaagtatcagaattatgtataaaactgtggcacagagtaggtattttgtaaataatagttgatttgtagttggatcgtagatggatggagggatgggtgaatggatggatggatggattgatggataactaaagttccagtcaatcattcttgccatttattttctcaggaatttctgaggatcaattttgtcttacaaaaaataatggcattgaagtattctgttgtttcagactttttttaggatacaatttattcatttgctttcaaaaggtgctgagaatataaacttacctcctggagcatcactgactagaagagtaaaaggatttttactgtgattgaaaatgctttctttaaaacatatgcagtatttatagggctgcttggaataagccaattgaaagatttaatggtaataatctccatatttcttataaaattgatttccggattcagtgaacttggaaagagtcctgggacatcaaataagtaaaatcttaacatgaaatgaatcttcagaatatgttcataaatttacattttaaacataaccagataatatatatctttacccgttattaaggtgatactttaatgaaaatttttcatttgcatgaaataaacctttttggctacagatgaaaggactttatggtagcgacaatggttctgtgagttaaatgatcccaacatcatcaggaatgaatcacaagtgcctaccatatgaattacagcaccatgagtcttaaaaaggtatttctgtggaaagcattcctcccatctgcaacaatcagattctgctttgaagtcctgctggagagcctcacaatacatgagactgccacatgctacccgaatttctctctctacttgagcctgactgcattttcctaaagaataacatggtaacttaatgaccagggggtttagagagggaggaaaatggctacagtttttataattagacttccctggatgtgcattcttcagtaatactttttggatataactacagaaggtagtccaatggatgagaaaaatttaatttcaaatgaaaatagggcaacaatgtgtgactcctttggtccctactatattaaatgtgtggtgaagtcttcataaacatttcaggcccaaatgtaattgacatgttaataaatgagtaaattggtagtgagactttttagccatagaagagttacaaattaatacaaatcatcatgagataggtgtcagtgagtatttcaaaagctttcactcctgcttatcttgatgccagtgcctctgctgctgaatggcagagtgaggatggaggttgccagaatcatttttgttgtttctttttttaactagaggctttcctcaatagaaagaaaataatagttggggggagacttgtcatgaatgggagactggcatcagcaacgtcaacaaatgtttaagtagaagtaaaatgacttatccaatagatcacaatgtgtcaccatttctttattaaccaaacgaatcatgatcgaggtatctttctctgagaattggctgctgattctagagtctgttctattttactacagggaggcaggatagcaatagtaactaaattgtaggttggagagaattccctgttcaacctactacagcattaactcagttttggcctccatagagacttccaattccatttgcaattttgtaatagaaacagattttgtgggagaatctctcatttctctgagcttctatcaaaacattaggttattcaaaataggcattgctaaatatacatgggttctaaaagaaaaaagtttatacagttctgactgtactttgttctccttttggctttatgtgctttaggttctagcccatgctctggtgaaacagataagttagcaataaaaagagcaaggcttcttccaaccctaataatacataataacactagaataagataaacactaacatacattggtcactttgattatacactaggctattatttgctatcttgtatattaaactaaaaacctaaagcacacttaaatatctaaaaacagaattgcttggtgcatgggtacattttaaatgatattgtagagaacatgaaaaatgtatccactatttgatatttgtaaatgtatttttaaaaaaccagaatgattttgttttatttagaaaatacaacaagaagcatgaaatacacaaaggtagaattggctatttctggtcgatggaactatgtatttattattatttataattatttgatgatgatcatttattttatttatttatcaaataaaagataacactttatatgatatatcacaacatagagcctgtttattattatactatttatttattattttctatcatcttccaaatttcttacaacgagaatgcaataattttggttttttaatatagttttttttaatgaaaattaaaataaagctagttaaggttgtttcctttcactaccactattctctgggaactatttggaaatgttagagagaagcatttgagacatgtcaccttgaaggatgaatccttttgtgtcatctgacttggttattaaatacgtatataaggcttaatctttgagccttcttagagcaacttttcatttcaaacaacttctaaactagagaaaatactgacacaatatgatttcttagcagaaaccaacccctataaagtatcaggaaatcaaattgaaattgataatttgaaaccattaccatattgatagcttatttaattctatttttataatcaaaaatattaaatttgtttctactaaattaatggaaccaaacagaggatttcattctgaaaaggcccttctaattctctttctcagtggtttcaaggtcatggtaattaccagttcagctccacttggtcatcaaaagaaatgatttgttacaatgtagaatccttctcatgcttataatttaatgctgatagacaatttttaaaacaaccaggctacatgtaggattctttagtagtagatgtggtgtttgattaatgcctcattctaaaatatttcctaaaataaaagcttaagttaccaaatctcttttaaaaagtatctgacacggctgggcatggtagcttacgcctgtaattccagcactttgggaggcaaaggctggtggatcacgaggtcaagagatcgagactatcctggccaaccaacatggtgaaaccgcgtctctactaaaaatacaaaaattagctgggtgtggtggtgcacgcctgtagtccagctactcgggaggctgaggcaggagaattgcttgaacccgggaggtggaggttgcagtgagctgagatcacgccactgcactctagcccaggtgacacagcaagacgccgcctcaaaaaaaaaaatatctgaaacaatatgatttcttagcagaaaccaacacctataaagtatacagattcttttgtagtcaatacaggtaatagggatgtctgtcaaggctgatttttagtcagtgcatcccaatatgaacctgtacatgtggctgctccgaggcatccaagctcctccctcagctctgcactcaattaggaaactgatgccctatgtggttgttgagaaccccgttccatctctatgtccagtgattgcttgagcctacaaggtaccatggtataggaacacgttttccacttaatcacttagcccatcagccctcacactcaaaacactcaaccccgcttgaggaaggtctgtgctaaaatttttcaactctgaaggtgttattaagtttactgtcaaatgtaggatgagcttttgtgtctttaatgaagctagaagtaaatatgattacatgaaacttgcaatcatgcctactaaaattgttatatatgctctaatctaacacacacatacacacaaacacacacacacacacgtacacatgccactgaaacctttaatatgtcctgaaaaataataccttcacctgggtagccacactcggctggcatttttaatgtttctaatatgtacagtaacagtggacacagcagaattcaggataataaaattaaaaaaaaatactgaattgcttattttgatttgaagaaagggcatgggccttgtagaactttccttacatcacttgaatgttttgtgcatgcataacttagagttcagctgcctcagtctctgactgcagagatcacatgggtaacatgtgaatggaaataaaccctgtaggtaaaagaaagaggaatttggatagagatcaaagattaacttcattccactctttccttccactttttactatcccatctaaatttggcattttatgggactttttttcattgccagaggaaagagtgaacttaaaccagatttggatcgctctgtctctttctttctttaatccagtgatttggtttgttcagtagtgactttagataattgaattctcagttactagaaattattagtaagatttctggcttgatttattatatcttttaaaattataactgtagccctggtttaggttacagaaaaagcggtctagaatatttaataatatgattaacagaaatgtgtccttacctattaggttttttacataaattttctagaatggtactaattactatgtgctattaatcttggctcagggaaagaacatttctaagcattagggatcaaaattttgcgttacttcttttctgaatgtttatcattctttttattgtcatcccggtaataaggtagtttagtgtggacagcctcattcctaagtggcctgggtaaaagattcttatcggcatcataatgaggtccataggaattgagaaaaactaaaatgcttgataacagtttttaactaatttttaaatcctttttaaatgtatttttgtcaagaattttaaaacgtgataattgtaaagtgactaatttgacttccatccaaatagtagttaagtggttaaaatcaacattaaagtgcttcaagatattgaggagattcactcatcctgttcatggtgaacatcaagtgctagaccagaagggaaaatctaggcagttgtttaccaagtggattattttaatgcattaccgggattaatgtattattttattgttcaaaatagaagcaacctaatttagtttcaggctctcattatctgatgattttataggctttcattaaattctagtgaatacatcctgagaatttattttcttttcaaactaaagactatgacaattaaaagatcattggttgccaggagttgaggggcagagagggaggatgaataggtaaatcacaggaaattttcagggcagtcattgattctgtctgatagtataatggtggatgcgtgacattatgcatttgtcaaaacccacagaatgtacaacacaaagtgtgaacctcaactatactttagttaataataatgcatcggtactggcttatcaatcataacaaatgtaccaaaatgatgcaaaatgttaatatggaaagaaagagactggatatggaacttgctgtacttcctgctcagtttttctgtaaatacaaaactgctctaaaaaataaaatctatgaattatgaaaaattcaattgatttaaaaattaaaattttttgctgtaagttcacaaagcatataaaaaatgaaatgttctactgaaacacgtgttttcatttatttttatttaccgtaccttttggcaattgcccctgaaattggacaggtcggatgccatgataattttttctaaatgttgaatgagaaacattcaaatttggcaatatgagacattacatattcttaaacacttttatgtgaaagtatctcaaaatgctgaattaaatattaaaatcatccttttaaatttgtggttgacttccaaaagatagaaaaaggagagtaaatcctgaagttgttgactaccctgggggcatctataccaaaatctccaatcggtcggagttggaacattaataatctactgcatattgcaaaagagggtcagaggcttgggcctaagaaggggagggaatttaactggagaccagaataaagaaagaatgacaaatggccaacactttggaagagaataaataggagaaaagaaaatactcctaaataaaacatcatatctatcttagcttttgccaccaataaagggaatttccgaaagaaagtttcagagaaagagagagaaagaacgtaagagagaaagagaaaaagaagaaagaaagatagaaagaaagaaggaaggaaggaaggaaggaaaaaaagaaagaaagaaagaaagaaagaaagaaaggatgtcctgactttcttctccatgagaatttgtaataaagttttaaggtccatatttataatatacatgtgcaaacaaaaacagcaaactccacaaccagtcttgccatataagaatttaaaataggtcctagaaggtagtgtcccagatatccagcaaaagcaaacaatatcacacttgagccagacttgaatgacagataccatattcaaccccagtgtcttagttcaggctgctgtatcaaaatacgatagactgatagcttataaacaacagaaatttatttctcacagttctggttactgtaagtctgagatcagcttgccagcatggtcaggttctggtcagggccttctggaataaagactgccaagtaaagacttggacccttagaaggcaacaagagaactagaggactctgggtcctttttgttaagggtacaaatctaatttacgaggactctacctaatctggattaaagagtgccaacttctccttggatccttagaaggcaacaagagagctagaggactctctctggggtcccttttgtaagggtactgatctcattcatgaagactctacataattatcaaaggctgcctctcaaaaacatcacattggaggttagaatttccatatataaattttggggtgtagtcacattcagtccattgcaccaagcttcaaatatttttcacatataaagttacaatgaatacaagctcaaagtactccacaaattaaataaattaataaaagtttttaaaaaggggataattaaggcagcatgaacatgaatcagcagaaacaacagagagcaaactaaaccaaaagatttcaaatgtcagttacagaatataaaataattatgctgaaagaaataaaagaagaaataaaaacataaacaaggagttaagaaagtatcataatgaccaataagtcacgaaatagaacaaaattggaattctagagttaaataatacaatcacagaaatgaaaatatcactaaagatgtgatgtagcagattagagatgtctgaagagggaaagtctggaagacagctctgattcaaaaatatacgtaatgcaggacagagagagatggaaaatatgaaagagaacttagatcaaggaaatatttacagacaatgtccacctacatctatgtggaacttcaaaataatgtaatagagtaaacaaacattttatttcagcaaatttaaacaatgaaataaaagaaggaaacgcctgtaaaaatataacttaggacgatatagaaagcaggtgtagtgatataatccctttaaaaattcaatcaatactaaaaatattcttcaaagtgaacacaagaccctaatggtttcatacgagatttgtccccaacattctggcatcagataataaaaacagagggtcccaaccacatcaaaattcattatggccaatacaggaatggaaaagtacagattaaccccattcatgaacatactcaaaaaaatcttaaagcattagcaaaacaaatccaggtgtgtactaaaaagataatacattatgaccaagcttattttacttcctaaatgcaatgatggcttcatatttgaaatattaattaatgtaactaacagcactgtgaaattatggggaaaagtctatctgtgtaaagaaataattagattaaattacatttgtaatgaaatctctaagttaaattagaaatagaaaactcccctcttacactgaatgaaaacacaataagatgccatttttttgccacccacttggcaaaccataccaaatgttggcaaggatgtgacttaactggaattcttacatatactgtttctgagggtggggcttggtaatagccctttggaaataatctggcattatttagcagatttttaagactcaacaattctgtttcacatgtgcatatgtgcaccagaagacccgtgtaagaatgttcatggcgacgttatttgtaacgacaaaaaaactggaatttggtgataacaagaaaaccaactctctgccaatagaagaatgggtaacctctgttgacatataatggcctactagacagcaaaaaaactatagctacagggatcaacaaagatgagctaacaaaatacatgaaaatagcaagttgcaaaagtgtaaaaccatttttataaagttgaaaaacaaggaaatttagaaaaggaaagcaatggaattataaactcaggatcctgatctcccacaaggaggaggatagctactgtcagagaaaggcacatgggggttgaaaaagtgttgctaacttaattttccttaagttggaaggtaaaaaagcagatatttgtcatattattgtattttataactcgtatagatgttattcatattttgcatttatcaaatgtttcataataaaataatgcttataaaatctaatgtaatagattttacattacattagataatgtaaatattatattagataatgtaaatttgtaatatatagcaatttggggcatagaaaactttctataataaaggccattgatagcgacaggaagcatatggtaagcaaatggaagagtttaccttgttaacacctgctgaagagtattcagtttttttatccagatacatacagaccatgttatgaaaagcagccctgtgcactggtgaagagctagattggtgccagtcttggttgtgatacttcttagctgtgggatcttgggctttgggtcccttatctgtaaaatagagataataataggacctaatccataaagttattttaagtattggatgagttagcacacagaaaatgcttagtaatgacttactcaaaatacatgctcaatgttagattctagtgatcactttctcttgatttaatactttgaaatgttctgtttgtattatggtaggttttggtcatttgacgaagcaattgatgacattggctgatggacgtgtggtgttggctctagaaggaggacatgatctcacagccatctgtgatgcatcagaagcctgtgtaaatgcccttctaggaaatgaggtaaaaaagtaaaagtacaaaggggcaggggtaaagaatcagggatgtatgcatgcatatttttaaactaaaaaaaaattctgcatactcagaaagcttaacattgctcttaccattaagaaagaaggtaagccttagataagtttacatgttctcgtatactacaatgttatcccaggtacagaatccacatagcactcactcccttcaatcaggttagccatggagctcaaaaataagaacattttgtctactgacccaaccaatgagtacggaaacattgaataagaaataaaactttaaaaaatgtctggaggtttcttgtagggttatgttatttctgggaaaaaaaaactgttttaaaaattggtaaactatttttgtcaccatttaagaattctttatgctaagaggtaggtatttccatcttacagatggtgagaatgagtctcaaaaatgttgagaaatccatccaaagtcatgcagtcagaatgcattataagatccaagacatgaacatgaatctaaatggccaaagaccattatattttctttcacatcacatggctacattgcaacatactttctgactactctgcagaattcagatccaattgctatgaggttcacttccagctcatggcaacattttcaaccaattagttgcaattcagcaaatatttcaaagtttctatgtattcattaatattatccattaatctattttctatagtgattatacagtagtgttaagactatcatatgcattttgcctttcttttatgaatttgcaatatgattttgcttattagataaacatatacaaaatctttttaaaaatctatcattcatatcatttttttaactgtaatgcatgcctttgcctgtagtattttataaaacaaaatgtaccttttcttctgcacatagaacacatagttactattgtcatcattattttacaaacctgtaatgtttccatatgattatttttcatatatattgaagtaaaaatgtatgttgttaatttgaagaaaaaatatgagagagaaaacttaagcattgctcaagtactttgctcttgttaatttttttttttttttttttttttttctgagatagagtctcgctctgtcgcccaggctggagtgcagtggcgcgatctcggctcactgcaacctccgccacccgggttgaagtgattcccctgcctcagccacccaagtagctgggattacaggtgtgcaccatcacgcccagctaatttttgtatttttagtagagacggggtttcaccatgttggctaggctggtctcgaactcctgacctcgtgatctgcccgcctcggcctcccaaagtgctggaattacaggcctgaaccaccgtgcctggctgtcttgttaattttagacagcacagtaactcaaaggatgtaattatctaatgattagtgtcaacaaagtgctgctgtttcagatcacgcacaattcaacgtgtgtaaaattttctaaaatgttagtgtctttctgtgatccctgtacaccaataatgtcaaacaggatgttgagtgtttttttgtggcagtaagggagtgcaagaaataaatgctatttttattttataagttgatgttggggtgcttctttgtcccctagataacattttttgcatagtcacctgtattctgaaatcacttatttgattttaattatagaaatatgttacagaagcataataatattaatatttgcattataaaggcttacaccagatgtgcagacaatcagaataggttgtggatctgtagctccatggataattgacctagccagaaagaaatgttacctgattgcaaaagccaactacttttcttcctatgtggaaggaaatcagggattttactggctttctttgaacacatgcattcaaatgtctctatactcataatcttttgctcttaacccaacatttccaatgaggatggagtgatctcccctatgatctctttctttaagaaatgattatgtttcagaacagattcaactgtgtggagttacatgtttttcttaatttatctgtgtttactgtaaagcaaagtgtgttttgtaccttgctgccattctatgaccttttgactgggagaactctggccattttagtacacgtgcttttcgtggagatgaaatacactgcttttgtagagcaattagtgactttaaaattgatggcatgagccgagatcccgccactgcactccagcctgggcgacagagcgagactccgtctcaaaaaaaaaaaaaaaaaaaaaaaattgatggcaatatgagagattacatattcttaaatattcctatatgaaagtatctcgctggccgggcgcggtgtctcacgcctgtaatcgcagcactttgggaggccgaggcgggtggatcacgaggtcatgagatcaagaccatcctggctaacactgtgaaaccctgtctctactaaaaatacaaaaaattagcggggcgtgttggcaggcgcctgtagtcccagctactccggagcctgagtcaggagaatggcatgaacccgagaggtggagcttgcagtgagccgagatggcaccactgcattccagcctgggcgacagaggcgagactccgtctcaaaaaaaataataataaaaaaaaatctcaaaatgctgaattaaatattaaaaccacccttttaaatttatgaatgacttccaaaaagatagaaaaaggagagtgaatactgcaactgttggctaccttggaggcatctgtttgaaaatcaccaactggtcagagtttgaacattaataatctactgcatattgcaaaagatagtcaaagccttgggcctaagaaggaaagggaatttaattggagaccagaacgcagaaagaatgacaatgatgtcacctgatttaaagtgtgagacctgtgccttttctctatatgtttagaaagaccaggcttgagaaagagaaaggaataaaggtattgctggacaatattaaacctgaccatgtgagtgtttagattgctaaaatttccagtaagtgctaactgaaatgattatttttggctatattgactattgaacttactaattaatatgtatgtcttatggtaaatttgagttagttattatgatgccctaaataccagcttgtcccttttggttggtggtcttcagttgcataagcacaacctaaaattttttcaatataaactaaaggaagggaggtttaaataatgtatgcttttctatattttttgcattaaactttcttgggaacataaataagaatatagaattcctagcagatactttaagggtaacaatgaatatgggattattgaatttttgaaaggtaaattttgttgtgtcaggtctatcagtatatggaagaacaaagttaagaaaaagaaagattattaaaagtgaaaaattaaagaaaaatacaaatgtgttgtacattataattcatttggaaaaaggaaatgaaaatataatacataaaacacattaaagaatggagagttcttctcactttcattgacaatataatttataatccaaggcctggttttctgtatttttttccaggtcaaagatcattatgactacactgaagttttaaattttattcttttagaaaagtaatatataaggcgtattacatgtacttcaccattttttaaaaagtgcatatatgtagttttcacagtagttttatatggtaagctgtaggtaaaaaaatacaaaaggatgtctttcagattgcgatttcaaatcccagtttccctccaaaccctttattcagtgattaatagagcaattagaactcattatctgggatttcacttttacaaataacaaaatgtagtaaagcttgaacttaaaacattggcagaacccgctttagtttctcaacactgaacttgcaattgaactcccattagaaaggtcaagaggggcctttctgagggcctctgctctttgtcagatgtatttattcatgtgcagaggattagaattcataaacattttgccagttttttgaatgctatttctttcccttgttgtttttggccaggccatgtcaatacagcaaaattttgcttcttagggcttatgatcagcagaataatatgtattacataacccaaagtaattataaaatcagcaggaaccgttagctgtgcatctgtgtagacacatagaggggtaccaaaaaacttgatttttaaaaattttagttatctgagtgttgcacccaaaacatgcattttcttctttttaaatatctttatcatgaaaatgatctacttagcaaaacatctcttaactattcttttcagaaatatgtacaaggtcagtcaaaatagtatactattggattaaaactaatttgagcatggtacaggaaattcctggaggcaactgatattgaagacataccagaagtccatttttttctttttcttggcaaagtttagaacttagatttatcagtccaatcagtgcatgatgaatatttttgatctttttcaatgaagcacttagaaacaccagcttggggtttgcaagaaattgaagtgaatatttaaatgagaagaatcattaagttgcttggaaaggcattagggatacttgtgtcaataaccacatagtttttagaattcataatagaaacatctgtgaggttcccagaaaatctgattttggtaatctgtatttgagctgattggcaaacagtgtcacagttgctttaaggccaaatttgcctactgttatgcaaagccaattagtggcaccccgggttacttcctctgaaagaaattttcccaagaggtgagaaaagctttaagcagttgccattcctatggaatctaaaacaaaaacattgaaaaacttcaagcaagtcaaagaaaggagaggacatgtagtagtagaagccttgggtagtgagttgagaacatggccattagaagatcacctgtcaataccgaataaatgatgatttctaagcttgttagaggaaaaaagcaaaacaaattgtcataggtctggaagctgttgagattatggtaaatcctctagtactgcaagttcagcatttacacttggagcatatagcatgttttgatttccctcactctttttaaaatttggattctgatttctttttttgtctcttcttttttttttcttttctttccctccctgcctccctcccgttattcttcacttcctcactcccttcaaccctctctccctttctccctccctctctccagtttctttttaataactgctatctcctgttgagtatgctcagctgcttctatttgacttgaatttcacaaacagtggctaaacttagtgattgtgttggttgataatcttttaaagatgacgttttgctctaaagctgctgaaacagtctcttgaattgactctagtaagtgttgacaaccacccctgaggtgaactcttgagatgttgttgtccaagttgctcatcaggggtttgttttcattggattccgaatagggaagttgttttgccatctttttcatcctttagattatgtatggctgaagcttagtccattggggaattggtgtgaatctgggaaagcttacaagctcctaaatagttgccattcatgagtaaaggaaggaggaactgaatacagggacaatgtatgatatgtcagaatagtgtttttctatggttttcttttaaactttgaaggctctccatactctgaaagagaatgtgtgggtaatctaaagagaataaaactgtttggggaaaatattatttgaagatacttttcagtgtagatgtggcctgtgatgttgcatttcttatattcaacaaggcagagccaaattggttgtggatttatttttgtttatatcttttatcaaatgccaaatgaagtggacgttgtttggataattcaaaactccattatataaattttctatatagtctttaggtttttcagagggtgttaaggagaatatgggccagggacctggatatttcacaggttgtggtaaccaataaaagaaagaaagcagttctttgccatggtgaaacaaacatgaaatgacattcatttatctgaccattcattagtcttttattgggcatgtattttgtgcccaaaagtttcaatataagtaaaagtaaaacaaagtgctttgggaatataacataaaaccattgtttttaactacagagatcgaggaatattttaacatttaattggtcttgaataaaaaaatcagactaatatgagctaatgtctaaggaaaagattatcatgtaatgggaaagcatagataaagacattaagacttcttggaattgtggatggctctgtttggatttgttcgttttgtttttggtagaggagaggtatgttgagtagaataaaagtatatactggggctgaatctgggtaatggaatatcataaggaattagaatttctgtgaaaaaatatggaagctttgaataaatgaatcccaagctttggtgtaaaacaacaacagcaacaaaacagcattttgtttgtttgtttgttttggagatggcagaagcttgtagaagaaaacaaagcttactatgaaaataactattagcaattttcccagataatcaataaacaaaattatactctaaccacaatatgctggaactgactgtaaatgacttgtgaaagccaattgtgtgtatctctgcttaaatctaagtttaataacatcacgttagtagcttgaaataggccatggtgggaatatttacaccacagaaatcagcaaatactacaaattaggactactacttggacagttagcagttcaacatttaccggcacaccactgctacataatgtgaaacaggtcttgttagcagaaaagtcaacacttggaaaagagtatcatacaaaatctctttaataaaataaaaaaaattaaagaaaatattgaaaaatataaaattagcagattaaaggaagaagagattaaaaaagcaaataaagagaatactaaggcacacaaagtgaaacaggacttaacaaatttgactgtcaaatttaaacttacttgcagaaacaggggcaagtaaacaagatttttggcatttaatgtgagccaagccttcttcataacaattgatatccagactacagacattatgttggaaaactacacatacagccctgaacgaacttcccttcaatgttgttagaactttagtttgacatgcacttttcaacatatgtagtattttcctaactctactgtgtggttctaactgttttctcattatgttgtatatctacaaacttaccttaatgattaaacaagaatatcaataatctgaatcatccaacaaattgtatttattatcctctttccaattgaccgctatgccttcttccatttatttttaggtttatttttaattacttagttggtgactgccatagatgtttaaatatatcatgtgcaaactgtccatggttaagcatcatggaaattatgggatactatttgggtttgatatggaacagaggcatcttctcatagtcttcctcctttcattcattggctgatgtattgtttaacctacatttctctaagccatagtagttttggacaaaactcagttaatagaacaataactacagtaataatctcggagtctgactcactggtccctcttaccttattcaaggaattcctgcaatatctcatgtgagctgatgaccatgactgttccctttacctcttggtcttcctgttactctcataagacttatgtcactgctattgaccagagatatttctttattgctgtgttgatatcaccctatgtcatccacatgtaggtaggatgcaggcagacgcaatctgaataatttcaatagtttgtcagtgtagtaacttgattgtcaatacaatcaccctgattctgatatttcccccaatctatttggtcaagaattttaatgacttcaaacaaataaaataggttatttcaagaatgactcatgaatcacaatttggataaaattataaccagatttacttacacaatcaaattaaacatacacaactaattgcagacttctctaagacaattattcaaatgagagttgagtttccaccaccaatccctcctcactagggaattgataatagttcattagcatggagagtcaggtcttcattacaatctgcttcccttgtcctcttggtcttgattatcatattcttccaacgttccacaatatctttgactctgacaactgaaccctttctgcattttgtctgagtcgctttgcatgttgcagggggactttcagctttctttgtaagtaaatttgtggccttgtacctaagaatataacatgttgctcttatgcaaaatatataatctcactttgtttcctggaaggacagtaatacagtggaaagaacatgaactcaagatctagactttgtttccctattctcttacatcacagtgcttttaattttttttggatttttaatttttgctacactgtttttaattgtaaaatataacaattatacagaaaactgcaaaacacaaatgtacaactcaatgaaatatcacagagatcacatatgtaatgatcaaccaagagatagagtaatgtcagctctatctctatgaaaagcccccacattccttttctaactagtatcccctttctcttttctgaaagtaaccaattttctgatgtctaagactatattttaatttgtagctttatatccatgaaatcatacaatatataattcttactcattttgcttaagagatttatccatgttattgcagctagctatatttgattcatttccattcacatatagtattccattctataaaaataacttttagggaaatgtcacagtttatttacatattctgcttttgacagataaagggaatttttccagtttgggggctattgtatctaatgttgtgatggacattttatatgtgtttcttggtgcacttgtaccgacatttttgttgaatatatttctacaagtggtattgctgaatcctgaaatatgcatgtgtttaaatgtgttttccatagtggcagttacaatttgtactcctaccagtggcatacaagtgtttacacagttctgtatccttctaatactccatattgtcagtcttttaaaatcttagccattctgttggaggtgtagtagtatatcaccatggttttgatttgcccagacgctaatgcggtaaagcagttcttcatctatttattgatcatttgtacatactgtttttgaagtatctattcaaaactttggtccaccttcatattgtctttttccttactgatttagcaattctttataggttctagtgttagtttcatgtgttgaaatatcttgtcttttcaccgtcttaaaggtgacctttgataattgaaagtaactttttaatgtggtataatttatcaatcttttcctgtaggattggttctttttgtaatctgtttaagtattctttctggattcccaaagtcaagaaaagattatttttattctttccttcctcttttctgaaaggtttattttttgacttcaacatttagatgcatagttcatctggcattgaatatgtatatggcataatatagaggtcaggtttgtttgtttcaatgtgaatatacagttgatcaagtaccacttatagaaaagaccatccattcagccaggcacagtggctcatgcctgtaatcccagcactttgggaggccaaggtgggcgaatcacgaggtcagaagtttgagaccatcctaaccaacatggtgaaaccccatctctactaaaaatacaaaaattagctgggcgtggtggtgcgcacctgtattcccagctactcaggaggctgaggctggagaatcggttgaacccaggaggcagaggttgcattgagccgagatagcaccactgcactccagcctgggtgatagtacaagactccgtctcaaaaaaaaaaaaaaaaaaaaaaaaaaaaaaaaaaaaaagaccatccattcattatggctcagtagtgttaactttatccatgtatacatggagagtctattctatttcacaggtttctctctttttatgtgatattatcagactgtcttaactactgtagttttataaaacgtcttgatatctgctagaacaaatctttctgtttgtttttcttcttcaagacagtcttggctacatttggccccactgcatttttatataaaattttagaatcagcttgggtggttgtacaaatcacatataagtggatataaatggatttagttcaccaattaagacaaaggtgataacattgtaataacagatgctctttgaagggaagctttctgtaatataattataaggaaactttgaatgaaggaaatgaaaaaaaatttatccacaagaactaactgaaggaaaattcatgtgaccatattaatatcagataaaaatggactttaaggcaagaaaaaagagaaaatagagatcaaaagaggtgtttcatactgataaaatattctatgaaccaagaagataaaacaattcaaactttttgtgtctaagacagcatgaaaacatattaagtatacatggaaagaaccaaatgaaaaaattggcaaaaccacaatcatcataacaaattttagtacacgtctctcagtaactgataaaccatgaagaaaataaaagtgaagggtgatgtggaagatttaaacacttgataaacttgctataatttaaatatataatggagtatatatcccctaacatgacagaatatcattcttttcaaggacattcttaacatttttaaaaatagaccgtatatggagcataaagcaagtttcaataaatttgaactaattgaattcatacatagtataatttcttaccacagtgaggtaattagaaaatcgtatatattttgagatttcaaatatactctaattcatgtgtccaaagaaatcacagtgaaatactagaaagtattctgaaataaagcattatgaaaatataacatgtgaaaacttgtgtgatatataaagctgaacttagagaaacatatgcttttaaatgtatatattagaaaagaagaaaacttaaaattaatgtttaaaagcatatatctcattagagaatcaaagcagcaaattaaatgcaaagaaaccaaagaagatataaataaaatgataaaatagaaaacaagcatatatgtaagatttttaaagtcagaggttgattctttgaaataagtagtaaaattgatcgaactctagtaagactgaccaacaaagaaaaagcatgcatgcccagcactgggaaagaaaaggagacttcactacagattttaatgttattaaaaggatgacaagaaaatattaaaataaactttacgtaaacatttcaaaaacttatgaaatggaatatattaaatggaaaaattataataaaaatgcaaccttgcaagactgaataaaaatacagcaaatgtgagtggttctttaattacttacaaaactgggtttttaaaactaaatttaccaggagaaaacacaaaacccatatagcttcaccaggaaattctaccaggaatttaaggaaaaaataacaccaatcacaaattgttttagaataaaggaatggatggtaggaagaatccatcacaaataattttttgaggcctatgtgataccaataccaaaaacttaacagaatatcacaagaaaggaatattataagagaatatttctcatagtcatagtagttaaaaccctaaataaaatattagcagttcatcaagatcttaaatgttcataaaaattgggtttactctagaaatataacatatcaactttccaaactaattcattataattcatcacattaagacaatgaggaagaaatatatttcaataaatgttttaaaagcagctgataaactacccaatcataatgaacaatttttacaaatagaaataaaaaatgtttattaacttgataaaggatagctacaaaataaattccacagtatacatcaggtttaaaggggaaatatagaaattattcttttaaatcgaaaacaagacgaagatactcttactgcttcatttcagcattgttcagggaatcctagacagtgcgatattgtaaaaaaaagaaaaagatatcagtattggagaaaaataaataaatctttcactatttacagatgatttgtaattgagtatgaagaaaatctattaaaagatgttcatttaaattatgaattaatatgtaaatttaacaaagtgggtagttaattaaaaatcagtgaaaatttaaaactcacttaaaaggtttagtaaaaattaattatatatctatataactgtcataactgtagaaaataaaagtttaagaatacactggttttatgtaaccagttatcgttaagggaaactgggtgaagagtacatgggaattttgtacaatgtttgaaactttctataaatataaaattacttcaaaaaacattttaataatgagtttatttcacacacacatttttgtatccccaccatttccgtgtctgaccactactatactatatcctatcataacattccatacatacttaaaaccaagcaaagggtggagttccatcttagaaaactgaacagacattttggacaacacattcttggcaatggaacctggacaacatttatcagatatggtatgtaaatttctcactctgcattacaaaaagacaggtggatatcaaatgatagagaaatgaaataagacagaaattttctaacaagctgtttaaactattaaggagacttcttgctccactgccagagatcttgaatagcctcttggtcagtcattaggaagcagttcttcacataattgatgaaattggtttccaatttgggaagagaaccacctttttgtgtacttgcttgcatttttgctttaatgttttctacagaactaggtccttttagcgttttgggagggttttttttctgttttttgaaggattcttgaccttttgggtcttgatgttgatggttttgagtctttttcagtctggtttgatttttgtgcaattttggctggagtatcttatatagatttcttcactgagctttttcttcatcttcctcacccttgtcatcgtcatcttcattgtcatcatcattatcttcattagcagcaagtttttactttttttctgtggaacctcactaccacctctagaggcagctcgctttccagatatacttaagagctttgcatcctcctcctcttcatcttctcactgtgcatcttcctccacagctgttaagtgctgcccattaatatgcactggccctgaactatgcttcaaccataagaccataggtggtggtatttcaaagcccacaaaggaaactgttggctgtacagacattttcaaagttgccagtgttacttttatttggactgcgtttatatttcattgcttctgcttcaacgatgtgcaattcatcataggtaccagctcctgaactggccattcttaaagaaaactggtgctcattttcatcatcatccacattaaagtgataatatttgtcagctttagttcacaattaaaaagttaattttgaggccttagagggctcatgtccacgtccatcaaatcttctatgggtttgtggcacccactgtggtgggagagaaggcgaatggagataaatgactcctactccagagaacaaacacacaggacagaatcacaccaggattgaaaattttttaattaaattataaatatacgtattttatatatatagtgtaaatatatacacatacataatttacaaaagcattaaacaaaccaaatacctagaataaatctatctgaaaatatgaccctattcataaaattgtagaatatttttagagaagttaacaaacatctaaataaattatagaatacattatgttatggattagaggtctaggtattgagatgatcccagttctcctcaaattggattaaagattaatttcaatgcctttcaaaatttcattccattttattgtcattctattgctttttcttccgctcaattggaagcaaccttttctcctctaattattggcatggccattctgcctctacttgccctgggtctttgtttcttttgcatttccctgcatttctgatctatagaaatatctgcctgcatgtcaggaaaccttgccaatgcataggagaaaataattgtgtggaaattatgcaagagcagttcaccttagaaaacaaaatgagttatcactgctgttctaattcttcatcttaaaaccatatcctgattacagcaggaaaccaagaggaagaacccattttattttgtcttgttagctatggtgagcagaataaaggccacctcttcatgttattttttcgattaagtatttctccatttattcaacatttttaaaatgtctttcatatacagtctccatcttcgtctttaaatggctcacaacaaaatagagagtgggataaaaatgactttctactacataatgtatttagtaaataagaatatttgtgggggaaagggccataggaggggaagaaatttgctctagtggagaatttgaggagcacgcaatatttgcggtggtccttgaatgcttggtaaggttttaccaattcaaagaagaatgaaaaaaatagaattcagaggaaacagaatagataaaagtacagaaatattaaaatacttggcatatttgggaaacgtcaacacataacaaaaacgctaacaagtctatttaatagatcctttgcttgattgatgtatacatccatcctcacacacctgttacatttgcaaaggctctgtttagcttcttttatgttctgttctaagtcatgcaaataaaaaaaatcagtgagctgtttttcatagctcatcagtacagcgtaaattttaaaaatcttactcaacagcttctccaagaatatccctcgcctctttctatagatgaatcttaggcaactaaaatgatttttgacgatttaaatgatctgattctaaagaacctggaaattacttataagatgataatggccacaattttatggtgttttaaaatagctgcagtacttagaatgtatatggtatatgcaacttaacaaacatctgaatcatgccaatacattatcacaactttctgaaaatgatgtagaaaaataaatttccctgtcactgagcctgaaaatctgtgtaaagaattgctatgagtaatgcttgtgattaagctttagatacaattaagctggatgagagctttaagtgtcaagaggttgtgttaaaattatctagtgtatcttataactccatgataattaccattatttaacagaattgcttgacagaaatggcatgacgggtgtgtactatttcctacatttgcatctgcttcatctttctgtaacttttgcatgcaaaagttgtcttgtttgtataaattactccttatttatcttttaataatttccagtaatgctgattaatctccatcaccaatgtttttgctgtatctaatcacctaaattaaatacatagcaaaactttaccacatattcttattttctgctccaaatttataaaaaatgaatatttaatattattttattagttattaaattatgaataatgacaacactcataaatatttattaagtggatgcttcaatcagatgttgttagtgcctataattgtgagtgattaaataaatgtctagaaaagacaatccagttctgtggtcccgccatacaagattttaattttataaaaacagactctaaatgccacttgccttcttgccaacggagagaatattatccattgcatacctgccagagaaaaaataaagaacctacattgagaaatttctgaattcagctctgtctgtatgtatacactcaaaatgaaacaaattggggcaatttactgaaggttaaatcctctaaatgacattcaactaaaacatgcagggaaatggtttgggaggtttaaatgatcaatttaattgccttaattctctgaattgctttttaaaatagacacaacccttttgcatctaactgaagattctaaattgggggtttaggggtgtttgtattttactctcaatactctgaatcacgtatgctttctgtataacctgagtctttaaaatagcccagacctcagtgtgcaagagaccagaagttagatgttttacatatatgatctgcctatagctttctttccaggagccagcacctttcagtttgtcaggatttttaccccaaagtcacagggaagctttttgaagagctaaataagctgtcatcgctttgtgcttttgttcttaaatattggaacatagagtgtcatttcaagatattttattagtaaaatctacctgatttctattaaaaattattttctctaagctccaagaaaggagtgaaaaattatttataagcaaagtagccctctgaaccttgtctaatgcataagagttttccaagtaagcttcagtttatgattcagtagttcctctgagttaagagagtgttactagactaacatattcttgaagatacaatttgaaataccacattttaaaaaatgattttaacaagttttaagagtttatttcagaaccttgtactgccacagagcggtggtggtgatgtttttttttttttttcctctcaccaaactgtattgcaaataaaccttttgatgtttaaaagtttttctttggcagctaagaaaaacactctggaaagttatagttagtgaatttacccgtgtataaatatccctgagctagtctgttatcctgtggcatctggaataaaggtgctattgttgtagatttcatgattgaagaatagaataatcaattcagagggaccctgaggggaagattcactcacatatgtggtggaaactggtaatccctgtgtttttttaggttttcctacagatgaagagacatagatgagttcatgctttgatgcgtctagtgacatcgcttcccattcgtgccatattatagtttgatcaccagttcttatttgagatgattaaccttaatgtttctaggaaaactacttttttgttaatccttttgttactattactttatttgctttttgggtcacaatagctggacaactattttatttgcaagggccctagccatgcgctttctgctgcaacatgccaaactaatcaccacagcattctgagggatgtgttatcagacttaggcctaacagataggctctgtaaattatttaaagcttctcttcatttcttgcaaagcaatgcttgctgagcttctccatgaaaaattagtgtaattccagaagattatgatagatttgcaaggtaggagtttggcctgtgcttacacacagacatctgcatagttatgaataaagtagaagttaaatgaaactgtacagttattttacatttggttatttgaaccctttctctactactttattcaatggcctttgaataaaagcagctgtgtctcatggctttctatcgtgaagtgttcaaatgtataaggtggttggatgtaaaaacactgtgaaagtatggataatagagtgcccactttctgtctattgcaacttccctgaggttttgtttgcagggcccagctgcatatacagacatgatggaatttggtttgtcaggaacctacaaaaattacacaaataactcagatttttaatgaataatgcacagacatgcacctgcttcagggacttcatagattagtcttgtgaccaatggaaaagccccttggaattcaattacatggatacaaaacagaaaataaaactggctacacttctagaactaatatcagcaaaatgttaactagttctcggagcaagcttttcctgaggattaggttgtttcagtttgctttgcttctgtgagacttactataaagtcataatattctgctcatactattatctactattcttgcagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacatttatttagagttatcataatttgcacatgcgttcttaagtatatatcttaatgtgttgctcttaatgcagcaatcttatcttacactgatgacaaaacgtagagactctagatttagaatcttgtttttctcatgtatttcaggtatttggagtttttaccattatgatcactaagcatttacccagaaccatgaaataaatgcagaaattgtgattttgtaatccaatcttaatgaagggtagttatctcctaatgatgttggaattcagcaatcatttactgattcatatgtgtcaagagaggaaaaaaaaattaatgagaaagcctctgtatgggaaaatccaacttaacaaagcagggttaagtcatagactttttttattatccaactcccttcacacacatacatacacataagcacacatgggtgcacacacatgctgaaatcaagcacaaactaacatgaagattagcatgaagaggaaaaccaaagggcactattaggtgtccaggaggaacaggaaaacccttaggtttgctactgtcttgtagaagcatttattaagtgccacttaagaagccacttgccagctatctctttgggtcattgcctttgcttgttcagtagcaatttggagatatgggttgactggagttaaattacccatttatttgatactgtgaatatttacacatcaggccatataggaactaaaaataattctccacttcatctcactcatgctgtgactgagggctatatgtacccaataaacatttattgactacatgtcataactgaaataaactatgaattttgaagacttttagggaatagaaaaataaaccttcaaatgctggggtgcactattcaagtctctgatataagcctaaagtacaggaactgacagagacaaagcagcgaaggctggaggtgatttcataagcttaagaagaaaatcctgtcattgtcctgtctttgtcttgtttccattggggctagataaagagggtctattacatgtcattctagatttcaaagcaaggaatcttgtagtgatctttgacagcattcttctcttcatccacatgcaatccaatgtatgctttcaggtcattaatagaatgaaaatatctcagtttttatacatattattatctttttctgagcattgtttagccattatatacacagagtgttaaaattgattgttcctatgtatattctgagcatatcacttcaataggcatttttgagttcttattacatgttgatcaattaccaaggcacagaggttatgaagaggaataagacatagtttctgcatcaaggagctaacagtccaatgagtgagagacaaccaagtaaataattgcaatacagtattcacagagtacactgaggtcatagacaaggggcggtctgtttcttcagtccctttcaactgggggtgagagggactggatagtaaggaaggttgcttgacggtgatatagcctgagcttggttcttaagggctgaacagcatgttgaataactgaagaaagagtgaaaatgctttgaaaggaacgacagaagtgaaggactctatttccacataggtataaaaaggcgtaatttctgtacatctttagaaactctactgttgccttttatattggatctaatttcctagtaatgattttccactgcatagttttttcctttcactactgatgttttcaagtgacctctacagtctgctctagccaagcaaacctgtttgactcttgaaaaagactcaatctactatcaaaacttgctgtaggagtatcctgccactaaggattgtcaattccactcttctgccccaaagtctattttacaccacccaacagtgatcacttgtctgtgaaatccatttccttctaaactcttaatgagtaccccacccagcttggagcattactgatgatccaataatgccataatttctcaagaccaatatgtgttggttcagcggtatatttattttcgatgtttctcttaaaaatatcaaatatttaaatgtctgttagctctggttgctaaattagaggataatcatcaggaggacaggaatcatatctttttgtctctgaatgtccctccaggaagggttgacagcaggtgtgaggtgcttgggagcctggccattaaaagcaggcagatttgagtaggtaggacttgaataactcttcaagaccataaacaacaaaggccataagcaaccagagctcctccttctgagtcaaggatatatggtgtagtggacactgattttggtatacccagaaacaatgcactcttcacatctactcaaaaggagtctggttttattcatgaatctttgccaccagataccgtgcaactcagggggaagttcaacttagctccaactccaggggagctgtttttagtctaaggcagtcaacccacttgacagtgattggttaagaaatgggtacgtgactcaattcaggccaatgaaaatcaggactagcttcatgggcattcagcctgcatggtcacataggtcctacacatagaagggccccatccttagtgtaaggctcttggtgttgctgcctaaaattcttactgcgttttaaagaagcagcccatattttcatttggtaccaggccctataaattctgtagccagtcctgatgaaagtcaaggtgatggtgaggtgaaaaaacgtttaccaagaaggaatgatagtagcatcaccacaaggacaacttaaatgtcagttgagagggctctgaatagtgggttgaggttgtaaaaggaaagaaaacacaagatcggaaagcgatctctcaccatttgagaagtggagtgaaactcggtagagagaaagtgtttcagcactgtggctttgaccaccgtgtggtgcatttttatgtggttataactatgtgtcttaggggccactcttctatgctaaaggaagagaaaagagccctctaatgtccacagagcaataaaatcgagtgggtatttcagagtcttaaacttcataatggcttgggaaattaaaattatgggctccctgattagtaaacagtgcttgatttccttacaagatatgaaatcgcactcttgcttctcactgttttataaccaatgcttccatttcacctgctcctttgggactccaggaccctaattgtgttcctcgtttcccctttggcagagaaagtggtagggacaggttacttattttgtgagacccagttcaagatgaaactgtgtgaactcttccttgttaaaaaaattaataatttctggagggtaacagcaaagcactgaaccaagcatggggtctttctgagagtggggcgcttcgcaactgcacaggtaacccattatgaagctgcccctgaaggtagtccttgttcaacaggagcacttcctcttcacatacgtctctgagtgtcacacaagtgcctcctttcaactttagggggtgttcagatttcagcccaccttctagcccaggttctgaagggttcttttgtgctgcagtttgcaacgacagtatcagaaaactatgttactcttgagaagcaggcttgtagcatgtgggaaacattcaggcaagtctctagatagccttatcccaaggcacatggcaaggtgctgacagttctcctgtgaatttctttttgagaactgagtcccccagctgagggtatgcaggtgctggaggtgcgttggctccttgcctggccacatgtatgtgaatattttccaacaggatcatttatgttgtcctgtccttgtttatgttgctcatctagctgaagagaaaaggccttacaggccacagaagggcaatgatttatcctgacaggtgaagacccttcctgacaggagagggtctggttccatcttaacatgatagatggcatgcaagggtcaactatctttgagatgacaaaatggaaaaaaagtttcatgttattccttaagaaattaaaaagagaactaccatatgattcagccatctcactttctgaagacttatcagaaagaatttaaattagaatctctaagagatgttagcactcccatgtactttgtggcactattcaccatagccaagagatgggagcaacctgagtgtccatcagtggatgagtgggcaaagaaaatgttgtatagacataaagtagaatattattcagacctacaaaaggaaattctgcaatacgtggcaacttagcacaatcttttgatggcagatattatttctgctgtgttcctgcttgtttttaattgccgtatcttttgcacagtctctggcatgtattaggtgctctgcaaatgtgtgttgaatgaatgaatcagctagtctgtcaatgtttgccacatttttcttctaagcctgcgttgatttttgtaactaacctcacatatttatactccttggcacactcatgcagaatgagggattaagaagaccaagcaaaatacatgagagtccatttcctctcctttcttcacaacccacaaggatgagtcatttctaagttaggaagaacatggattatttttgtgagttgccatttccacgggtaagcttggggtgacaattctcagagctggatctagcacttggctaactggctgtaataatcaacaagtgatgccagtaacgagtcagcccagagtgagataaataactctcatatggatgtttcctttcctgaaacccaccctagtgatttacagcatccatgcaccgttgaattcgttcacttttctgcatggcatggtgggcgccagagttctaaaacaccactctttataccagtgctggcccattataactttttcacagatttgggaggggaggaaccatgaagtgagtttcccataaaagtaaatttatttagtttgaaagactatcactttaagttctaaaaacaaataatgaatgatattgatattaatctgtgaaaccccaaaacatgagaacaagtatagagccatagtttccttttatttatttaaatttcttagtgagaagagtattccttttaagtgtcaaccaattttgtagacttcttgaatgataataatcataaccatagcatcttttgttttgtggatcaaggaaacatatacatgcacaaggatttgaggattctttcacaattttgctgcaaccctgcagtggtttgcctctgataagttgaaaaacaccagtgtaggagattttaaaatgatacgaattccatcgtaatcttctcctccactccacaaccatgtgacaatgagcaagccacttgtttgaggaatttcaccaggaatgacatggcacatcactagaattgcttttccacgttggcgctactgtgacaacaaagtggcaaataggcagaagaatcctaaaagaacagtaagaattttctccctgtagccccactttcacttttccccactctagggattatcccttacttagtgaattgaggtctttttagaatttcttattatgccaaccaaggcaaaatggtggcacaggcaagaatgaggaatggacagtgcctgcaatttcaccatatgttcttgtcaaatgtgttttacataaatacaggagcaatttccatgtttcttgtatataaaatttgtgagtatagctaatcctctgttgttttaaacacacacacacacacacacacacacacacacagagtattatttagggcaatgagaagtgaatttataatcctcagaatttatccaacttttgaggacaatttgaaaatggacatgatttcctttgttgcaggggaatgttacaagtaactatgtaattgactaaagcataatcagttatctccatggttccataccagcaatgcacagagcacactctcacacattctagagtaataagaatgaaatcagattttccctgggagatgagaggcaagtatatttgacacctactccttgtcagaactgtgcttgatttatgttttgtatatgtgtttttgagtgagtgatgtcttgcttctcctcctcttcctctatgttattgttattctttactcttattcgtcctcctcttcctattattattactaatattattatatctgtagttctgggaactggtcttagaagtaacaactgatactagaaaagaacaaaggaatgctgattttgttgattttactttttattatatttccaatgggagataactcataggtaaaataaaatactaaataaacactgtcaatgtattagaatgaataatcaaaatatgtggtacctaattttcttggcgattaagagaactggttatgaattgaaggaaaaggctataaaagtaaaataagaccgtattttatgtaatgttaccgtaaagataacaaccattgtcttcttttatctgaaataccatcctctcccatcattataatatcctctaccgaccccagtacaaggagaaggggcatttacatcagataatccaggagaaaatccaaattgtttctaagctgaaaggaatttgtatacatctcttgttggggggtgggggaagttatccaatgttttgacctcatggggctatgtacacaactaaaagcgttgtttctccagattgcaacgtgtgctgcataaattatctcacagactttactagcttcttgactgcacaccaaaattctaactcaaactcagtttttcctctttctttttgtccccatctacttcattttgattttctgcctttttttcgtatgtctcttctcctctctcttccatttccatcctattgagatccaggggagaaggacaagaaggtattcccaatattggaaaggagcttttagctcatagccatttgaggttttatttccagcagggaagaagcatgataaagcctgcaaatcgaaagatcactgtgcttgctctgaagacaggagattagcagggcttatagtcaaatatgagctgtttaattcagaagtagaattggtataatatggtaattaactgacagggagaggattaataatgtctgggttttctggcttggaaaactgagatgatggtggtgatcagctcccacgataggaaattgtgaagaaagaaaagatttgaaaggaagtgaaaaatactagacttaagaaaaagacactttgctgatagaaagtcttaacaatttggggagaaggcagtatcctccggaatatacattttcactgtattgaagttacggaggaacattggatgaaattatttacacaatacaaaccctgtaagatgatagcaaataataaaataatgtaataataattgagtgcttacagtgtgtgaggtactattaaaaattaatttgtttaatcttctctaccctgtaaagtagttactattttcattcccattttatagtgaagtaaactgaggcacatcaaggttcattgtattccccaaggttacacagctaatgagtgggcaaaagcaagatcataaaccaagcagtctagatccagtcttccctcttagcctctaagttacactatgtcacaaataagttcattccttttgcaatttttgggttgagtttttcccatttcttcccaaagtgacatatttagacaaaatttaagttaagttaaaattaggaatttgggaagttctggctaattgagatttagccacagtcagttctggaagctcagtgccaaagtacaagaagccatggagctgtgcgtccacttttgagccccttataaacttgtaaaatacttctaatcagaaaaaaatgcaaggattggcagaatttcaaatccctgccctgttgagtttaaagccctgactgttgtcaggtgggagctgctatttgtcatatattctttggctttagacagaggccttgacgttagagtcctgggccaggcagaccttcattgaagaaaagcagcgttaggcattttcccactattaaccctgccaaccctcgcttgtatcacagccaggtcagacttgtacacatggctttgtgaaagttgactttgaacttctaattaaccattctcttcaaatgttcaaagtctggttgttgtgttggtggcgccctaatactagaatgtatcagaataaaaaagaaaagtctgccatctgctatgagacacagttttggggggtattttttattccaactgcgtctgcaatttttttttcactcacacatctaccaagggaaaaccaattaaaccaagaaaataaaactatgcatgcttctaggactgaaaactctttgtggattatgaaagagtaggaatactttgtgatcacatactcaggtgttagcacccagatcaatctcacacatacacatgataccatgataccattcactgagactaggacgtactagaagaaagtcaggtttgagggaagatcgtttcctaagtatttacatatattatctctagtcctcacataattctgcaatacacagttctttcctcattttgttcatgaataacttgagacttatcaagtttaggtagcttgttcaagttccttctactggtaagaaggaaaactaagattttaatcctggtcttactgtgatgtcaaagcccactttgtttcgattaaaggatctatatgaccttcctgttcccactccatttcaaaaatgagaacaatgttctaccagattgcctcttcccaagtatagacactataacaggactctgctaaaatgtaatagagtttgcatgcattaaaacaatctattgaaatacattagtgggcttgctagaatgtcagcaaataggagaggggaaaaaacataagctgaaatttaataaggagcagtaagcaacacaaaaatggggaatatctctgaagcaaataatggcatcagtgctataatgcacaagaaatcttaagatccgcatcaaagggatatgaatttgatagatactaaagagttttgatctttgtccactcctgggttcaggaggaagccagtaaaattccttcctggaggaatgtatttctaatttagaccctcaatatatgcagagattaagcccaacaaaatatgaactcaaatacataaatacatacatatttaaataaatgaataaaatccaatgcacaataacacaaggcactagggagagttggcagaaatgagatatattagaataataagacttatttgtggagttaaaaatggagaaggaggattactttcaaataatgataatagataaagagtattcatttattttcacttcttcatggaaacccactaaaacaataacagagttttctttttttctaaagacataaactcctatggataaagaatgaaaaaggaaaccatctgttactgtcttagcagacctaaaaaaggtgaatcttaaagcaacactagcaagcgttatctctgacgggatggatacatcaggctattgtacccatatgtcatagaattgttgacttgcacacctaaggcactgttttattgtctagtttttaattcctcatttctcctcattcattgccctttcctgtcttcacttctttttccattcagcattaaaattataacattcatttgcccttctacgtttcaatctaccttaccaacaatcctgcccttcaactttacccatctaagaaaatctcaaccctggatatacaggacaaacaactttccctaacactggtcttccagagatttccccaatgcaggtcttcaagagattgtcatgatgtatagcagtttgacctcttagaaacttacaattaccaaacctaaatgggcccattaccattctactgctttctactcttgacccaacttaccttctttcagttcctctagtgtgctatttttccaccttcctcaagaccttcatatattttttcctgctattcctctttgactacttaactcctatacatacttcatatctcagcttaattgtcccttgatcagatatacaccttctgattatcagttaagatcagatttttttttaatttcatagaatgcagtacgttcattttagtagcttatttcactgtgagacatgtactcatagagcatgatcatttgattaatggcaacctgtaagatctatgaaagtatccacattcctgtatttccaatatcagaatgcttggtaggtaataaaatcgaaaagtaagagtatattactccattcacacactgttttaaacaactgcccaacactgggcaatttataaagaaaagagatttaattgactcagagttccatagggctgggaaggcctcaggaaacttgtaatcatgatggaagggaaagagacatatcttacatggtggcaggtgagagagagcaaatgtgtgaaggaggaactgtcagagacataaaaccatcagatctcctgagaactcactgactatcatgagaacagcatgggggacaccaccctcatgattcaatcacctcccaccaggtctctccttcaacctgtggggattatgaggattacaattcaagatgagatttgggtgggggcacaaagcctaaccatatcactgagtgatagaaacaatcctttgaatgcaatttggtttcccatgtagggaaattgagataaaatggactggtcatcctgacagtaatagtatagccctcataaaagctatacttctttggtgagttaacaaattagctttgcagtttattcataaatagcttctgattaatgcactcacagctccgtatccaagagactgactctttcccagaagatgagtattcatttcatctattaccccttaatctggcttcatgcttgctaagaaaactggaatatccatgtttgtctatgtacagggagataattcactattcatgttggcactattatttccaggacatgggatagtttattactcaataaaagttaattttcaaaaaaaggttggtttctaatgcaacattcaatgcattttagtaatatgtgtctcagggcttgaatatatcaaaacattgacagagaggacgcttgagatgtatgaaaggaacagttcctaccaggttttccttacgtctgttacatgttgggagattatcttggtttggcttctaccagaaacagatcctgatacacaaggagtcatgtacaagtaatttatttgcaggtgcaggcatagggagaaaaggaagaggaatagtgaagtgtgacgagaaaagaaatgaagtgtcatttgttcaactatccttgtaggtatctagagtttaattcctctggggaaattctgagagctgatgtaaaacacatagctcagagttatttcatgtgagctgcgagggagcagagaaatttatgctccaactccaaacagttattgcctgaatactgctcctgggggacaatatgaccctgacatttctggccaatcatagagcaaaaactctccaggggcactgaaagctgtcctgaaaagacatgctggttctggtgaatggaaatgaggttgtgtgcactcaattagtaaggggcgggacatgtggatgaggccctgacagtggctgctacaatgacggttctttcttgtcagccacagacagtcttggtttatgtctgttgtctcaacatctcatccagatactgtttgtttcagatttttcattctgaatgaagtattattatctatagttttattaagtgagtaaggatggatgtgttacacctgtactttgctttagcttctatcattgtttcctctggttgtatgagaaatgcgtggaaagtaaatataatttttactttgaacacatggttaaatctatacaaaatacaattgataacccatctctcttttcctggtccttttgtgatataactagcgcttcccttttaagaaaagcgtgtagggtcctcacgaataccagttgtaaatgacatttaaatttctgatctgggagttaaaggaagaaatactcaacattgctgccacttggcacaccagtcatggttgctgtagcttgtgacgtgcatgaagctaccaagctgttagaagatagagttaggggtcgggagccggtggctcacgcctgtaatcctagcactttgtgaggccgtggcaggcagatcatgaggtcaggagttcaagaccagcctgccaccatgatgaaaccctgtctctactaaaaaatacaaaaattagctgggcatggtgatgtgcacctgtaatcgcagctactcacgaggctgaggcaggagaattgcttgaacccgggaggcagaggttaccatgaatggagattgcaccaccgcgctccagcctgggtgacagagcgagactccgactcaaaaaaacaaacagaccaaaaaaaagatagagttaggggaaaatttgagaaatcagcagttaggtgtgaataaagtatgttcaggaaatagaaaggaccagccttccatacagcatttacactctcaatacttttgctacagagattttgtcaattattatacattgcaacttcactatgtgtatatttgttttatgttttgttacatattttaatttcgctatcaacattattagctgaaatgagctcacaaacaagtgtgaatgtgaattttaaaaatgagtgctctacttctgtctcccaagcgaattgataatgaatatgtaacttgaacaaaatgtttgtcgatattcattattcatcagggggacagagtaaaatcacagacgaacactgaagacacaatgctgttaaagaagcagcagtttctactttaaaatttagttattattgaccaaaacaaaacaaaaataaaaactaaaaccaaaaggaacaatttaagaagtgcagttgcagagggtgcatttatgtaacactccatgaagcattactttttatttagataaaatgactacgattaaaaattttgtaaatcaattttcagtttctggtattacttttaaaagttcaggagtgacgtaataattcttctttcttgactccattagtatcatttcttgctaatgatacagtgtccttaattgcttcaaacagaaaaatcactaaattctaatgattattctatatttttcattcaatttatggaatcaaagcaaaatttttgtaaataaagttgccccccccccaaaaaaaaaaaagcagggtgttattgtgaaagctatttgttataaattttggtaaaagtgtaacactgataataaaatcatttggttttgcattgatatacaaatctaaagttcggtggaacatcttatagagcaggaatgtacttagcattacgtatggagcacacaatttttataaatagcttaagatttaattatgaagttaatgacatttaataactcttaaaaacctaaacaagcttgatattctaccaatgaaaatctaagctactgtcaaaattttaaaactctttacataaacatagagtaaataaaatacactgttttagatatgtgacaggtgaggacagttaaaaaacaaaaaagaaacttcaggccgggcacagtggctcatgcctgtaatcccagcactttcggaggccgaggcgggcggatcacctggggttgggagtgtgagaccagcctgaccaacttggagaaacccggtctctactaaaaatacaaaattagccaggcgtggtggcatatgcccgtaatcccagcttctcgggaggccgaggcaagagaatcgcttgaacccgggaggcggaggatgcagagagccgagatcgcgccattgcactccagcctgagcaacaagagcaaaactccacctaaaaaagaaagaaagaaaaaagaaacttcagcaagacagttcaaaatttctctcttagcttccccttatcaaccatactttaggaatgtttgaacatctatagtaatattgaaccattttgcaaattagctttctgaatttttatatttttccaattagttagaaatcaaaaatattcaataagtggacctctgaccccatgtatgaaagagtaactgctatcgaagttgccctttgatcagaaacaagagaaaactatatacagatagagatagagagatatatgatacagagagagagaaaaagatatctaatgttccatacatatatggaacactgtctttctttcagacattggcctgcaggcaatgaagaaacaaaatgagtaccgcagattccagggtaactgactagaggaagtttccaggctgcagcatagagaagaagaacccaaatagggtccagtggtattactgagttgagaataaagccatcaaagttacagaatcactttatccctggacgcagtggctcacgcctgtaatcccagcactttgggaggccgaggcgggcggatcaggaggtcaggagatcgagaccatcctggctaacagggtgaaaccccgtctctactaaacatacaaaaaattagctgggcgtggtggcgggcgcctgtagtcccagctactcaggaggctgagccaggagaatggtgtgaacccgggaggcagagcttgcagtgagccgagatctcgccattgcactccagcctggacgacagagcgagcctccctctcaaaaaaaaaaaaaaaaaaaaaaaagaatcactttatcctctaaataaaggaggataaagtggctagaatttgtgaggcaaaatattggagatgaagttgccacacacacacacacacgtgcgcgcgtgcacagagtgctgcatgtacaggagtttccttaatgtttcatttgaataattttctttacatatataaggtgaaactccataaagctgaggaactaaccaacgaaaagtagcaggttaaacaattcaaggagttcacagaactgggaatagtttgcattagccggagtggagagatcttataatacacaaggcatcaaacagagacatcaaaatggtatcatcttagttataggactaaattagccttacattaaaggctacattttagccatcctaacacagtgtacaagtgagcctcaaaagtactttgctaattgtgagtaacttaacttcatgctaaaacaaagtccaatactctctcaaataatatgacaaaatccaatagccaaaaaatgttcaaattaccaatgtcaggcatccaaatgaaaattactaggcatgcaaaaatgtaggaaagggatcacaaggcaaatcaataaacagaaactgactcagaatgttaaaaatgtacttccaatatgaagaggaaagagtaaacataatgaagagataaattaaaaagataaaaaccatgcaaattgacattttagagaaaaaaaaatacagcatttgatatttttaaaagtccgaactttggatggattaatggcatattatgcagtacagaagaagaaaattagtgaagttgaagacatagcagcatctgaatttggtaaaattttgaagagtcaaaaacaacgaaaactttttgacatttaacttatttgtgttacataaaatgtttgccaaagtggagtatgctgaaaggagataaaagacagtaaccatgagacatttggaataaaatagttactcatttcagtattttaaaaattaaaagtgaagatattctgcttttagcagaaattgttctgagcttaccaggtagcaccatagttgtagagactatttctcaatgaaaaatattgcagtatcttgagaaggataaattaaaaatgctaaaaatttcaaacttattaaccatacaattaagttttcaagattataggcaattctatcaaaaagcctaaagtatttagaccccgttgaaacaaaaaatacatttttcataagaatatcagtatattgtatcagtgagtgatagagctacaaaactgattaacatgtgtgatattcagcaggaataataattctgcttgtgttattttctaaggttcagataatcaatataaagaagaagctggtagctatgctttgacaaacatgaattatgcaatttttattttttgaaatgaattttagttgtaacaataaattttgaataggactattttataggccaactgataaaaataatttcttggccaacaaatatttccaaaacatataatttttatttttatccccatttagcctcaaaatagccccaatttagatgaaaaattacctggtcactcaatttatgcaccaattttcaatgtgtctttatttttgcatttaaacaatgttttggatcatgccaaagttctctatttaactaaaaaatttatcttaaaaacgtattaagttttagaaaatccatagacctccttgtaagccccaggtgttaataatttctgtggttgaaggagatagcaagaggttaagattagcagcagcttattttcctatgagaacccggtgtgtaaagatgaaaggcaacatcattcaaatggaaaaaaggtaaaaaaaagcaaatttgagaaggagtgacagctctaaggctccaaaatgatgatggaatgagggatttctggggtcaggaagttttcaaagtagcaaaggggtttgaattgagaaaacttttggtagataggtgacttgtgtaacacagattttcatgagtcaacaactgcctatttttccaaattgtccatttccaagaacaatctggtttatactgaagtctgtttacagagtacctgcaggatgccctctcctgggtcttgtgtaacccagtgaaaccccatctatggccctcacctctaactcttgactctctacattccattctatactttttatctttattgtagattcattatttgtgttacttttgccagaaaaaaacaaaaacacagaatggtgaaggctggatagtccttaaaaagtcctgaaaagtgggacaatttacatagtgggaaaaatgaataaggatagaggatatgactgaagagggagtgtgcatgtccaattttaatggaaaactcttctcttttgccagttgcatagccataggagagcaacccagttgtggctcattactaatatttgactttatgaataacagctcctgaaaaccctagcagtcaacctttgttcatttctcgtatgtgataatggtgatattattcctatgccaatagatatgactttcttgcacatctgtttctgtaatggaagaaaagaccctacacatcacatgaaaatataacccataaattatggggtttgaattgtctgcatattgcacagacggtgctgtacccacttccatttcaattattctcctctatgaatagagatagtcgtctataaatgcattattaatgtagaatatttcccttgtttttatagactttgccagaggccaaatataatttaaagttttgggttatttctgagtcaggaaactcatacatgtggataaaagccaaacttctaatatttaatcttaacttagcaggatattttatacacattcaattttatccaaaaaggtctcaactattttaaatccttcctagtactgacatacatatgggccaaaatttaaaggatcattgtcagtcattcttcttaaagactgctattaaccatgcataccttctgtcctgattgtgttatggaagtaaagatgtttgtttgtggcctagacctctcctgttgagaaataagacccaatgcttggtaattaaagcccttgcttattctaaatgtgcatattatgtgcaaagaatgtttgctgacctcttcaagagttcataggctcatagaaaagaaaaggttttctgccatagcaaatttattgtaacatccaagattgatatgtaacatgagatcagaaggaccacgataagtgagaatgagagcaggaataaaactttcatagcattaagcctaccactattatttataaatgtggaagttgtgctccattgtgatccagtgacttcttccggattagtgtgggatctccaagctggaaatacttttagttagctcaattttcgatgaacttctctttttttttttttttttttttttttttttgagatggagtcttgccctgtcacccagtctggagtgcagtggcacaatcttagctcactgcaagttgggcctcccgggttcaaaggattctcctgcctcagcctccggagtagccaggattataggcatgcaccaccacgcctggatattttttgtattttcagtagagacgggatttcaccgtgttggccaggctggtctcaaattcctgacctcaagtgatccacccccttcagcctcccaaagtgctgggattacaggcatgagccaccacacccagcctttgatgaggttcttattcatactcttcaattagccgtgtctccagttttatgatagcctcaataatttacctggtaaaaggtacttgcaatagtgcaattttatgagaaattaagagtagagtgaactagtttcaacatgattgtctcacactgtccaaataaaccacaaagtctagaaaatgtgtgtcaactgaatcacatatcttaaagtacaagggtaatgtatcatttccaaagattatttctttagtaagtaatctgcaatatacataattcttttaagctgagaattttataattgagctttttggtattttcatgtctactggaaggtgggtggaggacagcagagtgcagaggaagaggcaatttaaaattagtgctgagtaaggattttagctcctctgcctattagccatgtgatcttcaaaaacactaccagacattgcctaaatagttgtcaccagggttaaataaaattacaaattataaatgtagaaacaccgagcacagtcttggcacatatttagttctcaataatgctagtttgtctttcctctagtctttataatttgacccataagccactagccacatgtagtgtgtttgtcagagtccccatgttagccaccatagaaaacaagaaaaggatgtcataaggcatcactagctttgtaaatgtcatctgctaaaataacgtttaataataatattttatgtaactcattacaatatatgtacttatagatggtatatggaattttcaacttgggtaatactacaataacattaacttgaaagtaagtttaatagtagcggacacccatgtcaacaggtcttgttgacatggaaagtgggtggtgagactgaatttcctcccctaatgtgacatctgttccttcgtgaaacagtaagataaagaaaggccaatcatgaaatattagagctggatagtatttggcattgtgatctagcgaaactaggccctgggaatggaactgtcaattcagaaataactttcaaagttgagagatgtagggtaggccaaagatacattttcaacctcccaaatctctcttagtgtcttctcgtttcgattctgttacttcgttttggattagacatcatggtttcccacttggacttttgccaagatgtgaaattggtcttcctgcccccactgttatcaccttccaatccatcacccataatctctccaaagggatcttttaaaaacataagcctgattctataccttgtctgcctaaaatgccccctgatcatcctcaggttgaagtccaggatcatcagagtgtcattcaagagtgtgtattaattagcccttgcctaccatagcagtctcatccatcccactccagactcttcctatgttctagtcattcccagcagttgacggtcacccagtaaaacacagagactccagtctctgtatatttgtatgtgctgtttccccttccagggatatcccatgacctcactctgctgaagatcaagaaaagatttggaaaggcaatcaagacatcaggatgatcaactattaggtttttaggagcacatttgcactctaatttctaatgatctttcaaatactcagtcaagtgttatttttcctggcaagtcttcccatacttttccatcatcttaaatacgtgttctacttattcccgttcaaggtcactgtgggcattttacacacagaattgtaattcttaactaacagggctgtctcaactggaccatgcatttcttggtgttagggaagcatctttgtgtcctcgacatgtggaaaagccttagcttctacaaaatgttagtttttggattcattgacagaattgttattgtttggttcaaattaaaaactttatgattctcagactttggtcagaataagggatcacagcaagttaaatagtaatggacacctatgtcagatggtcttgttggcatggggaacagatggggagacttagtatcctctcctaatgtgacatctgttcctctatgaaacagtaagaaataaaggccactcataaaatgttagagctgcaagagacttgaggcatctccctatttcagagacagaaataaagtcctgaaaagcctcactaatgtcattgggatggcagtgctgggtccagaaccctgttatcttactgcccaatccagcgttcatccatttgccttttccactcaaacaaggctttttcttccaagaagtaagcaaacactgcataccaaagttcttgccaactagtcaggctgcagagatagtactaacctggtgagtcatgtcagcacctagggagattctcctgctttgatttggggctactcatcatttcacaaaaaaatagcctaagggctgcaagaaagccattaactatgctctttcatatttatcccattggcatgttctcatgaaatgaccttctattttcctctctttctcctttcctgcctcaaaaaaagaaacatcagtatgacatatggatgggctccaacatcagccagtatatatattaaagttttaagtcaattattgttctagtacacaccctgaggttgagaaagaaagaacatccaggactaacaaacctgattgttctggcaaagttgccattcaattcatgctggcatttctgggcttttctttttctttaatattccaacttcattttcttaaagttaatgattcaagtagcaatgtttaacagtacgattccattcatgttctctgtaagagtgctgcctcctggtctcttgtgggtttcccagggagcgtgaagcccggagtttgcttacttagttgcagagacagctgtcagtctgagggtgagttcagtaggccatggattattcctcactttattgctgtgtaagcaagagggagactcagcttgggaatatgggcacttcacaacttggcattcttatattgagaaaaagacccaatcataacagttaagaaaccaaattacaactgtgtataacatggggaattttaacttaacaactgctctgagttggacgtatgtgagtattctgattattactgctgtaattacaattcttatgaagtatgatggatgtttttcctaggcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcaggtatgaatccaacgtgcgggaataatccgggtcagtcatatccaggctcatcgttgatatttgtgaatcttcctcctggctttccttcacctgtctcctccacttccaccacctgtcctctccaaagccacagatgccacagcacatgctttaggctatcgagaattcattgcttcattcttcatgtgaaatgcagagctggagcatgtggttgcagttcacagagaaatagaggggatgagataaatggtgagaaaaatcacgccttatcagataattgagtgcagatcgttatggaaagagctgcttgtgggcttaactccttttcctagttatctctgtttttccagatgttctttttctttctctaatcattttgaaattgctgatataacaaagagaaagaggagagtagaagatggaaataatgctagaccgttggatagccaaaatacatacacactccttacgtggctgtccttgaggtccaacaactggataaagggggaagttgcctgcaaaggagacaagagactgtgtgtaaaggactgtgtgaacttggggctgattttatttcattttgggataggacagaattggttttaatgtatcttcttatgaatatagatttctggagaaaaaatacagtgaaactaagatttgattcacttgttctctttttaaggaatgtttgtcagtttgtgcatttggtgttcatcattcagttctacagaaaatggtacattcagaatttctttgaagtctaccaaagccaccataaatgtacataaatattggtgatttctatggctgacttcaaggtcacatttcctcaatttaaaaataaatcaggtgaggctttactaaagctctgccagcttgcactcttaaattgctcctgagaaggaaatcagactccctccgtcaataacatcaccattaattacgcagatcctgctactagtgcacaggttggcaattttcccaagaatgcacaaatacgaacagttctactttcttgcttttactggatactcagagtttaatggatttaacatcttgttttggccaagaacaggagataaaatgaataagagattttatttttatgcaattattttctcttaccataaccacttaaacagcagattagcaataagggggaaaagttgtatattactctattgaaagataactttatatgaatatctagagcataagggaaaacttactttacatctttgataataagaactaaccccctgccgttcccagctaagaactgaaccaagttcataatccaaaggtgttgcaattattccgaaggccaaaaacagttagttgtctgtcatctgagagccataaaactgaggaaactaacatctgttagtgttggatataaaaggagcatagctattctttagaatttaatatagaaaaacgaagctaaattccaacctgagtgaaatgaattgtaaatatttttgcctgttaaattgcagagcttagaataattaacaataataagtgatgttatgagcctcaagtaatataaaaatctcagcagtttggcaggaattggccctgtaggcaaagttgtttatcctcaggtaaatagtgtgcttgactcatggtagtctatagagatttaaccttggcttcagtccacagtgatttttattttaagcttcatctgatggcagagagagaatgtgaatgttctgatgtgcaggaaagcagagtcaaagagtgtagcctggtttcatgttcatttatcacttttagacagattatatctattgtgattgatttttcttgtgggaagaaaaatagttttgcttgaaatatttctgatggctttgaactgaactccctttttcagcagaggaaaagaagaattcttctagaactggctcttgcatttcaattgaaccatgcatgaatttcctcagagacagacagacagacacacacacacacacacacacacacacacacacacacacagaaagagagagagagaatgctctgaaaagccacagagcatttactcttttcaggggaatactatcagtattgtccccctactcaaacaggaaagatggctttcaaaatgagataaagtggcggaaacgtttctgggcttttcttatgaatgcaatattataagcacacaggaaattgaaaaattagaaaaatcagagagctaaatggatggaaaagagtgaaggcaagattccttttataggaaattcttgccagttattttggagaacatattggtgtttggagtgagatgactcatttcatactaagattttgggtaaagcagctcttttcctggccaactcatatctgactcatttaccactagtgaataagggataaaatgctcctggctaagaaccattgtaagtattttttgttcgtttttcttggatgggggaggggatgacaacacagtgcagatagtcatttcgtttttataactacattgatgggccttgaagaataaattactaggaaaaggctgatatgtgggaattccttttggggatagttaattttcaaacataacacatacttttctgggggcaaaagacttgatcaaaaaaatgattgatgggtcaacaaaacaaaacaacacaaaaaatcttgaagggatccaagttatatagtcaaagaaaattaaatatatacgtctggtcacatatagcatactacttagaagcaagaagttttcttattgtttgctaggaatgtgtacctttaaacaattgtagtttgcatttgttgactatctgtttcaaaatgcttctactttggaaaggtcagtacagtactcaggtttactcttggatatcagttcaggctctgctgaagatcaagaaaagatttggaaaggcaatcaagacttcaagatgatcaactgttaggtttttaggagcacatttgcactctagaatgcctaacttggtgactttgtgtgtgtgtgttttttttttaactaacacaaaaaccaaacaaacttgaaagttagatttgcagttgtcattttgacctgtaaatcgtgttacatttttttttaacaaaatccagaatagttgtctctttaatcatttaactttcaacttttggcaacctttctcatgaacgtgatggtttcatgtcattagataatacagaaacatgagaaaacatattattcaaagtctgaccactttgttttttgggtaactatctagtttgtgaatataacagtgtaataatcagctaaatccaagtatcatctacctgagctttgaatggcttatcaatagttccaatgacatcaaaaaccccattttcctgaatcttaagatttatatagaaatatagaccattattaaatatacattcatatctaatgtacttagaaacatgattttcctcaaatagcccatcccaatgggattgtgtctccaaaggcttctagaagctaaatgttgcacaaattattcacccctcttattttattctatgataccattatgttaagtacttgtttaggtaactaagaacttatttagacaacttagataactaagtatgtgcgttaggctgttcttgcattgctattatataaatagctgcgaatgggtaatttataaagaaaagagatttaattagctcacagttccacaggactttcaggaagcaagttcctggcatctgcttggcttctccagaggcctcaggaagcttaaaatcatggaggaaggtgattggggagcgggtacatcacatggcaaaagcagaagcaaacaagagagagagtggaggggaaggtgccacacacttttaaacagccagatcccatgtgagctcagagcaagagcttacttatcaccatggagatggtgcaagccattcatgagggatctgcctccatgatccaaacacctctcatgaggccccacctcccacactggggattatatttcaaaatgagatttgggcaggaacatttatccaaactatattagcaggcaaatttttcaatataaattttgtttttaattttcatccagtgtcaacaaagccttagctgaaaattgaggtgagatttggaagctcctggtaaaaagaaaaatctgccccctcttcatttatctttcctcctcttcccagggccatcattttatctctattttcccaacgtgtctaacatgtggtcttgaggtgcatgtgaagtctgacttagaacattagggatgttctaatcctccaatgcccagttatgtattttggggttcagttctgtattatttacaaaacagtgtttactttgaaaaaagaaacaaaattgaatagaaacgtatataaaataagatgcataatttagcttcccatctcatctttttcttcactccttcaatcctatcctcttaccactacagaggaagagtagagcttgcctctagagtctccacacttcacagttgtttgctcaagggcaagttacttaatctctctgagtttaattttcctcatctttaaaatgagagaaaaatttcatagagttgtgagaatcaaatgaaacaacacatcacaagaacttaaaacaatacctggcatgtagtaaatacttgataaaacttgataaaggtttattatttttattatttttctatcacttttcttcttcctcgatttgttacactttttcttgttcttcttgttcttgttcttcttgttcttcttccttcttcttccttcttcctcttcttcttccttcttcttcttcttcttccttcttcttcttccttcttcttcttcttcttcctcttcttcttcttccttcttccttcttccttctcctccgtctccttcttcttcttttttttttgagatggagtctcactctgtcacccaggctagaatgcagtggtgtgatctcagctcactgcaacctccacctcccgggttcaagcaattctcttgcctcagcctctcgagtatctgggactacaggcacgtgccaccatggccagctaattttttttgtatttttagtagagatggggttttaccgtgttagtcagatggtctcaatctcctgacctcatgatcagcccacttctgcctcccaaagtgctggaattacaggtgtgagccaccgtgcccggcctgtttcttcttttaatatattggccatcattcagtaatctataatataagaatatagagcctatacttgggcatctatacctttagctgttcataggttaaatcaatcaggactatcctccaaccagcagaatgaggaagaagaacatgtgaaaatatcaagttcattcactctttcaacactttctgattatttctaggagccagataaagtgttaggggccaggatcacaaagctgccttgtactcctcaaaacgttcacatacctttttacagcagcagtagaatactgcaaatttaatggcttaaaacacacaaagtttgtcagtcagaaatctaactaacccaggtctcactgagctaaaagcaatgtattggcaaggctgccttcatttgtggaggctctggggaaaaattggtttccttgccttttccatcttctggaggttgcctgcattccttggctcatgaccccttcttccatctttaaagccagcaacttcacatctatctgacctttcttcagtcatcatatctctctctgccttcagctgagaaagggtttctgctattaagggctcatataattagattagactcaccaggataatttaggattaatttctccaccttatcacccctaactttaatcacaactacaaaatcacttttgccatgtaaggtaacatattcacacgttccaaggattaggaagtggatagctttggggactattattcttcctaccacagaaacaaacatgaacaatcaactataataaatgacaagtctttgataagattgaaatagggtcctgcaaaatgaaaaaaaaagcaaaacaaaacgccttataggccaaggactggggagcaaatcacagaaccagggagaagagaatcagggtggaagaatgtgtagatttcacacagtaaataggacaaaaggcattcaagatgtctttactttgacaagacaatttaagaagcccttactttacaagacaataacttgagacaatatatatatttttaacttctactgctgacactcagtccaaagtatcatcatctctcatccaaacttttacagtagtttccttactggttttcatatccagttttaccttctttctaatccattttatacacctcaatcaaaaacaaaacaaaacaactggaaagcatatctggtcatgcctctgcttgaaacccttcaatacttttccatttccattaacataaagatcatcatcttcaataggctccataaggtctgtattagtagactcatacctataattcctgccttacttctaacattcttcctctttcttttctgatgtggtttccaacaatgaccttaattaatttttaatggaggtatatcttacatataataacatgcacacgttctaagatttttaccaatgccaccctcatataaacaccacccagaacaagttcaagaacatttttattacctccaaaaagtttgcttctgccacttcccagtcggtgccactccctccagaggtaactaccgttttacttttaacaccgtcaattatgtttgcctgctcttgaatttcatttaaatggaatcatgcgtgtgtactgtatttcttaatctgacttatttcacctcattaagcatgtttttgagatctatttatgccattgacaatccggagtttcttcatttttattattgtacattactccagtgtattaatacaccctaatttgtttatccgtatacctacggatggatgtttggcttgcttacactttgagggctattatgaataaagctgatcaattaattattattgtggtttaaaaacacatgtaaaacttaccgtcttaaccatgttaagtgttcagtacagcagtgtttatatgtgtattgttgtgcaacaggtttctggaacttgatcttgcaaaatggaaaccttgtagccattgaccagctccttcatcttcccgcctcatccttccagcccctatcaaccatcattctgctttctgtttcagagtttgactactttagatacttcatataattggaaccatgcaacttttgtctttttctactggcttacttcacttagtgtaatgtccttaaggtttctccatgtggtaacatatgaaaacatttccttcttttttaaggctgaataatattccattgcatgtatatgccacattttctttatccactcacccactgatagattcttggattgcttccacctcttgactattgtgaatgaatgctgctgtgaacatggatgtgcaaataactctttaagttcctattttcagtttttttggatgatatatacccagaagtgatatttctggatcatatggaaattttatttttaatttcttgaggaatctaaatctctatgaaattttcatacaagttttctttttgtggtcacagcactcagtttttttggatagatagctaagatagctaaaattagaattgctgggttgtagggaagtcatatgttttacttcataaaaatcttccaaactgttttccaaagtggctgtaccatttttcattcccactagcaatgaatgacagttccaattgcatcatagcctcacctacacttggtaaaatcagtctttataattttagccttttattgtgggtgtggagtgatatttcattgtggattcagttttcctccaaaaagccatactcatgtccacatcagggcttccttggcacatgccttctcttctgtttggaatgtttatcctgtcctctaccttcttccaccaaccctttattggccttcccattcttttcatcatatcctgtagatttcagatcaaatatcacttcttcttcttgaaaaatattcaccgaccactaacccccaaattagatcaggtcctccatgctttctcatgtctcccttacacttctgcattactccacaggacataagtgaaaattagatacatttgtgtgcttatttgattcctttatgttttctcctgtaagctccttatgaatagaatctgcatccctttggcttagcattatttttttaatagcagtatattacctgacacaaattaggtactcaagatccattttggtagtaaaagacgagcaaaagttcagagagtatatgagtgcaaactttgggaaaggaaaggactctcggggcagttgggggtgccacagagttgagtaagctggctgggtagaaagggatcatggcacaaaatttaatggaagggaattaaaatatttattaccattcgaatttgagttaatcctgttttcagtattaagctttcacagagagagagagagataacttaggtctatacattgaacagagagtgtcatggaggaggggccagcatactactaaagggacagccaagaaacccttatggtaattgtggtaaagaagccaattaatcatggtagaggaaatggagaggaagaaaacctagtgtagataaattgttgagaaatagtgagtagttggcaattcatgaaatatcaatgaaatgggagagaaagaagtccaaattaatagtctggatgataatgccattagctgagagagaaaaaaggaagacgttggttgaaggtgactatgtattgtagaattaagaggcgaacatggacaaaaggaagcaataaggcaaactagggttgagtaatggtactgttagaaaatctatgtcaattccccacaaaaacttgctgccagttgtattgttatggtaggtgtgagtttgtgtgtgtgtgtatacatatgtttgcttttgttgggcttttatttctgcacagccttgtgatatgagggaatatattcccaatcacacatttaggtgtagaattgttacacaggaagtctgtactgagaatatttctggatctttatttttttttaattctttttctatttatttattattattatactttaagttttagggtacatgtgcacaatgtgcaggttagttacatatgtatacatgtgccatgctggtgcgctgcacccactaattcgtcatctagcattaggtatatctcccaatgctatccctacccccccaaccccacaacagaccccagagtgcgatgttccccttcctgtgtccatgtgttctcattgttcaattcccacctatgagtgagaatatgcggtgtttggttttttgttcttgcgatagtttactgagaatgatgttttccaatttcatccatgtccatacaaaggacatgaactcatcattttttatggctgcatggtattccatggtgcatatgtgccacattttcttaatccagtctatcattgttggacatttgggttggttccaagtctttcctattgtgaatagtgccgcaataaacgtacgtgtgcgtgtgtctttagagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttagtgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtatttttttccaattctgtgaagaaagtcattggtagcttgatggggatggcattgaatctgtaaattaccttgggcagtatggccattttcagaagattgattcttcctacccatgagcatggaatattctcccatttgtttgtatcctcttttatttccttgagcagtggtttgtagttctccttgaagaggtccttcacatcccttgtaagttggattcctaggtattttattctctttgaagcaactgtgaatgggagttcactcatgatttggctgtttgtctgttgttggtgtataagaatgcttgtgatttttgtacattgattttgtatcctgagactttgctgaagttgcttatcagcttaaggagattttgggctgagagaatggggttttctagatatacaatcatgtcatctgcaaacagggacaatttgacttcctcttttcctaattgaataccctttatttccttctcctgcctaattgccctggccagaacttccaacactatgttgaagaggagtggtgagagagggcatccctggcttgtgccagtgttcaaagggaatgcttccagtttttgcccattcagtatgatattggctgtgggtttgtcatagatagctcttattaatttggaatacgtcccatcaatacctaatttattgggagtttttagcatgaaggttgttgaattttgtcagaggccttttctgcatctattgagattatcatgtggcttttgtctttggttctgtttatatgctggattacatttattgatttgcatatattgaaccagccttgcatcccaggaatgaagcccacttgatcatggtggataagctttttgatgtgctgctggatttggtttgccagtattttattgaggatttttgcatcaatgttcatcaaggctattggtctaaaattctcttttttggttgtgtctctgccaggctttggtatcaggatgatgctggcctcataaaatgagttagggaggattccctctttttctattgattggcatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttattggcgtagaggtgtttgtagtattctctgatggtagtttgtatttctgtgggatcggtggtgatatcctctttatcattttttatcgcatctatttgattcttctcccttttcttctttattagtcttgctagcggtctagcaattttgttgatcctttcaaaaaaccagctcctggattcattaattttttgaagggttttttgtgtctctattcagttctgctctgattttagttatttcttgccttctgctagcttttgaatgtgtttgctcttgcttttctagttcttttaattgtgatgttagggtgtcaattttggatctttcctgctttctcttgtgggcatttagtgctgtaaattttcctctacatactgctttgaatgcttcccagagattcgggtatgttgtgtctttgttctcgttggtttcaaagaacatctttatttctgccttcatttcgttatgtacccagtagtcattcaggagcaggttgttcagtttccatgtagttgagcggttttgagtgagcttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctatcaggtccgcttggtgcagagctgagttcaattcctgagtatccttgtttactttctgtctcattgatctgtctaatgttgacagtggggtgttaaagtctcccattattaatgtgtgggagtctaagtctctttgtaggtcactcaggacttgctttatgaatctgggtgcccctgtattgggtgcatatatatttaggatagttagctcttcttgttgaattgacccctttaccattatgtaatggccttctttgtctcttttgatctttgttggtttaaagtctcttttatcagagactaggattgcaacccctgcctttttttgttttccatttgcttggtagatcttcctccatccttttattttgagcctatgtgtgtctctgcacgtgagatgggtttcctgaatacggcacactgatgggtcttgactctctatccaatttgccagtctgtgtcttttaattggagcatttagtccatttacatttaaagttaatattgttatgtgtgaatttgatcctgtcattatgatgttagctggtgattttgctcgttcgttgatgcagtttcttcctagtctcgatggtctttacattttggcatgattttgcagtggctggtaccggttgttcctttccatgtttagcacttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaatattgacccccactgtcttctggcttgtagagtttctgccaagagatccgctcttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataatatcctgcagagtgttttccaacttgattccattctccctgtcactttcaggtacaccaatcagacgtagatttggtcttttcacatagtcccatatttcttggaggctttgctcatttcttcttatgcttttttctctaaacttcccttctcgcttcatttcattgatttcatcttccattgctgataccctttcttccagttgatcgcatcggctcctgaggcttctgcattcttcacgtagttcttgagccttggttttcagctccatcagctcctttaagcacttctctgtgttggttattctagttatacattcttctaaatttttttcaaagttttcaacttctttgcctttcgtttgaatgtcctcccgtagctcagagtaatttgatcgtctgaagccttcttctctcagctcatcaaagtcattctccgtccagctttgttccattgctggtgaggaactgagttcctttggaggaggagaggcactctgcgttttagagtttccagtttttctgctctgttttttccccatctttgtggttttatctacttttggtctttgatgatggtgatgtacagatgggtttctggtgtggatgtcctttctgtttgttaggacagacagacaggaccctcagctgcaggtctgttggagtacctggccatgtgaggtgtcagtgtgcccctgctgaggggtgcctcccagttaggctgctcgtgggtcaggggtcagggacccacttgaggaggcagtctgcccgttttcagatctccagctgcgtgctgggagagccactgctctcttcaatgctgtcagacagggacatttaagtctgcagaggttactgctgtctttttgtttgtctgtgccctgcccccagaggtggagcctatagaggcaggcaggcctccttgagctgtggtgggctccacccagtttgagcttccaggctgctttgtttacctaagcaaggctgggcaatggcgggcgcccctcccccagcctggctgccgccttgcagtttgatctcagactgctgagctagcagtcagcgagattctgtgggcgtaggaccctccgagccatgtgcgggatataatctcctggtgcgccgttttttaagcccgtaggaaaagcgcagtatttgggtgggagtgacctgattttccaggtgccgtctgtcacccctttgactaggaaagagaactccctggccccttgtgcttcccaagtgaggcaatgtctcgccctgcttgggctcgcgcatggagcgcgcacccactgacctgcgcccactgtctggcactccctagtgagatgaacccggtacctcagatggaaatgcagaaatcacccgtcttctgcgttgcccatgctgggagctgtagaccggagctgttcctattcggccatcttggctcctctcgatctttattcttttgttgcaaattcttattttgttcttgatttaaattatcatacttgtaaagagcactgaaatcattccaacatatgtatataaacatttcaaaaagtatttatgggatgtctagtatgtatacaaaatggtataacattggaggggggagatgaaaaagaaaaatgaatgaggaaatgaaagaacataaaacaaaattcacaaaatacgaactaatatatgaattagttatatataaaatcagtttgtgaatactggaaagataaagaagtcatcaggctgggcacagtggctcatgcctgtaatcccagtgctttgggaggccgaggcgggcagatcacgaggtcagatcaagaccatcctggctaacacggtgaaaccctgtctctactaaaaatacaaaaaattagccaggtgtggtggcaggcacctgtagtcccagctgctcaggaggctgaagcaggagaatggtgttaactcaggaggcggagcttgcagtgagcggagatggtgccattgcactccagcctgggtgacagtgagagactccgtctcaaaagaaaaaaaaaaaaaagaagtcatcagtgagataaacagacttacttatgacacatacttatgaaagtcatttgattctctgtcttttactttagcttttgtggcttactaaaattcaaatctttgtccaaactgattagttatcaaataaatgcaaatttgaataacaagaaggtattgttttacatatattagatggtaaacattcaattagaatataaggtcaatggagaatgtgagttctatgagagcagggatgtttgtctattttgttcattgctatgttcctagtgcctagaacagaaccagggcacacagtacacagtcagcaactttttctagaatcaatgaaaaatatgagtaaactaagtattgctagcatgggtggagatgtggggctttagagcctcactgctttgggaagataaactatggcagccatgctgcatactaatttagtaccattttatatacacaaaatatatgacctggtaattttgctcttgggaatgtataccaaagacattctcagcataagtctttagagtacgtatactaggaagttcactacagctttattcatggtgaatagagagttggagtcaagcccagtgtccattattgggagaatgaatagttaaaatgtggtggatgcactgtatggagatgccacgtagaagttaccagcttcaaactagataaatataagtgcatgacagatctagtaaatacagtactgagtgagaaaattatgcacatgtgtataaagttaaaatttacataaaataaaaatatatacccacaaaacaataatacacagctttaaagaacacttgcaaacaaaataatgtaacaggcattgtattgcttgcctttcaggaggaagaggagtagaagtaagaaataagaattaaattaaatcagtaaaatgagaaaatgttttactacgtaacagtgttaatataaattaaacaaatgctatttttaaaaccacaagaaataagatttaagagagaatacaagaatttaatttaatactacatcttgtctcaagtgaaattacttccttttttttttacttttgtaaattatcttatggctgttggagtgaattgatccttctttaggatatgaaatctttgattatcaatgacagaaaactatcagtgttcactgtgacattgacttgctggagggaagcttatgtctttcaattcgttaaaccattatactaaaatttatctttgctgggttgattttatagttatctccgaacttactgtcttcagctccctgcatgtctttccttcccccagcttgtgtctttgttaatcaaggtgaagtagacatgtatctagggatggctgaagtgggaagcccccagattttcagagcactgcttctcattcctccaaacacagccattaaagggtcatcactcaccagatatctttctaaatgttccataaagaaatcatcttttttaaaaatgtagacatattttttgattatatgaagataatgccacctctactgagagctagggctatgagaagagagatactataaattgtcccaatggcagatataaataatccagttattttacaattgtttcacacttcacagtgtataaatcatgttttcttacattaactcgtttcaattctcataaccgtgagggcaagtaagggattattatttctattttaaagataaaattgacaatctagagacactgactgactgattcaaagtcaaattttcgaaagtaaaacagctgggacttgaacccagaacatctaccttgaaatccaggatattttccaacttactatgctactaacacttctatgctgcaagacgctggggagaattgaggctagacatggtggcgtacccctgtagtcccagcattttggaaggctaaagcaggaggatctcttgagcccaggagttcaaaaccagcctgggcaacatagcaagaccccatctataattattttttttttaattagcccagcatggtggcacatgcctgtagtctcagctattcgggatactgaggtaggagaatggcttgagcccgggaggttgaggctgcagttagctgtgactatgccactgcactccagcctgggcaacagagtgagaccctgtctcaaaaatacataaataaatgaaagagcgagagagagaattggttaattatgcatatgtgtagatggttcaatagaaggtgggcagctataagtggtttattccaaaaaaaagaggtcaatataaaatgatttcaaagagaggaaaaggcagagaagcatctgatggaaagctttctattgtacctgcaagttgccctgtttcaaccaaagaggcttaatttttggcagtgagtgggttgcagtgtagacagcctactcacatcctttaagcctaggttggacatgtggagaattcacagatcctccaccacagagacatgtggattccttacatctgtgacctctgagacatttcccacacgtgactgtctctggaattccagccacactgaatcctggattcgggggaaaagattatcctgctgcagcttgagttagaaattggaaaaatcggtctccattagaatatccagtttgagttctataactgtattattcacatattctcagatgtaaataaggctatatatttatgtatgaattagtttcaaaacttaaatgtcttccttaatttaaaatctttcttctttgaatgctgattatttttgatagaaaagacttttctgaagtatgactcatttatcttatgtaccacctctaaactctctctcacaacctccttatcccagacactctaggacaggctataacttcttaagaagcaactttttaaatattccacacagactcttttagaattttcttttttggtaacaataaataatgaagacttaatgattatcattctttatttttaaaaggatgctttaaaaatttttgattaccctcctatggttaaaatctttcttttaatgttttagatttgttatacaaatgctaagctactactttatttgtcagcacctttagagatgcattgaaatcttggctttttttcttataaatctgtaaaataacatggccaaacatttcatttgtttgcataaacagctctggtttaaacatagcatgttttcctaatatgaaagtaattcattatagaatcctggcaagtaggtaaacattatgaagaagaaaatgaaaaccacccctctattattccgctacctagagagaagcatcatccaaatattttttccttctggtagcaaaggcataactctgcatttgtgtggcaacatgagtttatgcatgttagacagcaaagggacaaatctaaagtattaagtaatgtctcatagtgtttattatttacaggtcaattttacctcctttattttttaacctttgctaattttataaggaacatcattttgttcatggtttacacctgaaaccagagcttcacaaaagcgtatttaaatcagcagttgcaaaattaacaaatggcagagctcagacgcaaactcaattcacccggcatctcatatcccagtaatcttcccatgacaatccaactacctcatgtatttggattcctcctacaatttattcttttgagtaaattaaaagtcattctaaaagtttgccttaaagcaccctgaaagggttactaaattaaggttaaatctcaagtataaattttcaagcaattagttttggttttgcctgcgcagaataccctgcagatgatgccgaataaaaactatttacacactaccatagtgcatttcttgtaaaaatattgggtctgtagcaacaatttgctaatcaaattcagaatttgatttgaaatgcctccggcaggcagccaatccagttatgaaagaacagaagcaaaaaccagagccctagtgagtctcctccagaagctagctgggtcctttgctctcattagcaaactggttccataggaaatcactgcagttgctcctaaaataaaatatcatagttaattttttcaataaattattgaactgtactagacaccaaacatgtacattttggaatctagagttataaaatattctgacatgttttaatataaacaggaacatttccagtgattgcttggatcgaaaatgtttttccccttgacatttgtttatacttcctaggaaagaaattctatttatggataactgaataacacaaataaacatcagagagagctgaaaaatcagctttgattatgcatgaaaatctacaatgtcattgtgtactcttatgccgtattctgattgcctgtttatttttacagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaattctgaacagcagcttcacttgttctttggatggacttgaaagggcattaaagattccttaaacgtaaccgctgtgattctagagttacagtaaaccacgattggaagaaactgcttccagcatgcttttaatatgctgggtgacccactcctagacaccaagtttgaactagaaacattcagtacagcactagatattgttaatttcagaagctatgacagccagtgaaattttgggcaaaacctgagacatagtcattcctgacattctgatcagctttttttggggtaatttgtttttcaaacagtcttaacttgtttacaagatttgcttttagctatgaacggatcgtaattccacccagaatgtaatgtttcttgtttgtttgttttgttttgttagggtttttttctcaactttaacacacagttcaactgttcctagtaaaagttcaagatggaggaactagcatgaggcttttttcagtatctcgaagtccaaatgccaaaggaacctcacacactgtttgtaatggtgcaatattttatatcacttttttttaaacatccccaacatctttgtgttctcacacacaggcaatttgcaatgttgcaattgtgttggagaatgaagtccccccacctcccagccacacacacatcctttgttctcatgacagtaggtctgagcaaatgttccaccaagcattttcagtgtctttgaaaagcacgtaacttttcaaaggtggtcttaatttgttgcatatctatcaaggacttattcactcacctttccttttctgccctctatcaattgatttcttcttacctttcatcattcattccttcctttagaaaaactgaagattacccataatctcctcttattacttgagggccttgactatttagtttattttgtttactttacaggttaacacagttgttttgtctgattgcattttattaactgtgaagccgttgaaatgaatatcacttaagcaacgttgctaaatttctatgtgtttgaaatgtgttaatgaaggcactgcttatttgtagtcaccttgaactgacttaacctagaagctgtgccttcttgtgaaaaaaaaaaaaaacaaaaacaaaaaacagcctttaaacaagtttccttagtgtcaaaagttaaaaataaaggacatttatttctgagataaaaagtaacttactaaatataagtaggttatcctcctacctcctaaaattcgatttcaacatataactcaaacacctaaacatattgaggtagaatatctcacagtatttaatatctgacaatgcttttgaaagagttgatgtttctttttatatatttttctaactcaaaggatatattaaagccataagtgaagattgtcatgcttttattcagaaatctgaaagaaaccttaattaaaacaaggttttagggaaggccatgatatgaaagatatggaacaatatggttttagttagagaggactctaacctgtaaatcaaagatgaaagatttcactcaagtagaattatataactccctttgttatacagtcagaccatatttttcatgcatttggtttttttaggattaccattttaattttaaagacttttattacatatacaaaaatggctcaatacttggtttaacttcttagaaatttgagacaccctttgaaataggaaatctgaaatggaatgtaacttagtattaggtaaaaattgctttcattgcgtaagggcaaattcagtctagattcatagtagtaatcaattttttataaattttattttcatgagaaattcataccaatcatatttgctagcttatgttattttgcagtgattgcttgaggatatttacttaaaaaaatagtagagccaaaggcttaacaaaagactctcccccattttaaaaaggaaactcatgttttaattagaaaaataattgtgtagttttaaaatcaacttcataattataaatctctgtcattactttttagtcctcccagatatttttttagttgttgaataagaaaataaaacagtgtaatgcaaacatgctaatttactaaagtttcctacaacagtttagccacatgtttatgccaagccattaatctgataaagccaaatcactaggacatctccatggttatttagatttaaaacttgacacattaatgagttaatcacacatactcccatatgacaccatacccaattggttgcacttagagtctttaaaatacctggagaagcaaatgaactgtggagaggattatccacagcatgtagttgtaagaacagaatgccattgctttttgattataccattacaagatggagcatagccctgagggacagaatggaggctttccgaaaatatcaacacttcttttgaaatagaccagcactttttgaaagggtagtttcacttggtatagtttttcttcacttacccgtttaaattttattgctcgcagttgttctgaatgagaggctagaagagtattatcaattttgcatctccttgtgatacttactttgaaggaaaatcacatacgctctctcatggtctcatggtatctcatacagggtgaataaaaatgatttttgataaatctactagtaaataatactaggaatttaataagctgtcaaacgtaggtataaaaagaaggcttaaaaattaattttcccaattgtataatttggggctgtatattaaactaaaaaacacagacagttttattaaatagtaaccaaaatggactcaaataaaaccagaggctatgttaccattgcttagtaaatggaaagaacattgtgagatgaactatctttaaatattgtaacaagtttataacatcaatagtggagacagaagtcagctttggagaaaatagagatatttatgaaaaaactactacaaatcacatttccattaccaatcctggggatggaaatattgccttcagtttttactccagccctatacgacactctcactaacctttcactgacaacatcatggccttgaaagcagggatctcctcccacaaaggcttcagaaattacaggactggtctctcttaatagtttagtcctgctttatttccaaagggcaattataaagcctcgtggatttactgggtttctttacagactccatatggaagtaaaatagaatgatcatttggaaagtctcctgggaaaaaattcctcttcaatcagcattttaaaacttttttatttttgagtcagagttttgctcttggtgcccaggctggagtgcaatggcgcaatctcgactcactgcaacctccgcctcccgggttcaagcaattctcctgacgagtagctgggcatgcgccaccacgtctggctaatttttgtatttttagtagagacggggtttctccatgttggtcaggctggtctcaaactcccgacctcaggtgatccgcccgcctcggcctcccaaagtgctgaaattacaggtgtgagccactgcacccggccaaacttattgttttaatcccagcatttatgtttagaagaattaatttaaatatttcttactatttctctgtcgaatgtttactctcatcttatctcaatgaaagaagtattaaaagtcttatggccccaaaagaaacaagccaaactgtactgtcttaaaagtgattcattctgagcttgaaacgactctgtcagtgtttgacattgtcatttctagtggcatgtatcttaacattcttttcctgcttcaggaatgaaatcacttgtcctgctgagaaaataaggggaaaacaagatagaagtaaaaaacaacacacctgttgaactattttcataaagatggcgttttcactttcaaaagaaatgaaaaccagatggtctatgctaagaagtgaaggcattttgttgtcttcagaactgatcaacatggtcatgatcatcatcaaatttcttgtttccaaaggccactattgtagtacagtctccagcaggattttgtaccatgtgctgcctttggaataaagtattataatgtatcttgtcaccttcatcaacaccaccattaaatatgtaagttcctatatgtgactttttctgggcatatttgcatcaaaaatcacagtccttgcctccttgcttgcttttactccatgaaacgcttcatgaagcagagcatgattgtcaagtgaccagaggatgacatttgtaagtgaacgtggtatactcacacatgctatactcatactacataacttagtttctccaaatcaactgcagtccgttttatctatgatattcctggcttcgtataatggttttgtaaaatacattaaatacaattaagtccgttattactatgctggaaataactaggtcagacaatgaaaccttagacttttgattggggctgtttggacttgatccaatgataaggtaataaggttgttgcaatttctcaaagcatcttaattctcaaactgaaacatttagcaaatacatggtgaatctggtgtaaacttacaatctaacaaataattttctttcaactcttctctttttctgcctaacaatctatacgaaattgccaatatctaagcaatcaaaagtttctgaaatctctgtttccttagtagaaatgaccttgacaacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaagagatttccagactttttaaagcaaattggaatcgttttatttttttgtttgggccttaggcacaatagaagcaaatgttgcaatattaaatataatagggagagttcactgtttcctgggacattgtggtcatgtccttaatccttcattgtgatgccccttcttggagttggcattttgtgacaattcatagagatcttgcagcaatatttggctattggttttattaacttaaaattcaacagaaatggagtaattaaaaaaaaaaacaaaaaacagagaagaattgcaaaatctgaagtggaatggcacttccttgggtatgtaagggttgtttttagataaaactcccgatttgttcttcctacactttaatagtctcaaattctttctggggaagcaacgtcagtgtctacctccacagtaactatgatataggaaattgtcctttcagtggtttctaggtataacaaacaagccgttaaaaatgagtgaccattttgtaggttacagcctcagcaatctgtgtcatttgaaagcaaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattccttttttgtatttgaaaatgcaatggtgtgttccaaattattgttggtgttgttaatgtcatgactctcctttgaatagaataaaataaccccttttgttttgtgttttctactgaattagattttcctctagtcctatgtgaataaaaagctatttgaaataaaa

SEQ ID NO: 370 - DNA, 357174 bp, Homo sapiens
gcgccgccgccgcgcgcagtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgaggtgagtggcacccccttcctgctcgggactccccggggagttcctatcccgcgccggcagggggaggggaaaggggccgtccccggggtgctcgtgcccagcgtctgcaggggagccccaaagcgggagcgccccggagcgggatccaggggagcttgggtccttccgcaccccccaccctccgcaagccgagctcattgtttgtaaataaagcggcgcgacgcccttggagctgggggttcactccgcagctcctcgctttcgggaggagagggagggggcatgcgtgcctctcttccctcttcctctccaagcagcgtctcccggggctgttgggcaactttccgcctctcgcccctgcagcccgggagtccatgatgcatgtcacgtctgggtcgcgcggctggagacccgggactgcggagaagccggatcgtttccccctggaactttctctctcatgattgtgtggatcagcaggcgctcagaagcctgtgcgtgcttatcccggcgggaatgggggacacgctgcgtgtgtccctcccctcgttttgcaaagtctacggccaggattgtggatttcggagcctcggtgggggaggtgttcaaggctggtggcaggtgctcctggaaacttggggaggaagcttgcagccctgccattttttcctcccgaggattcaaagcccggcacctccagggtgggtggggagaggaaagcttaattgatctcttttattaataaagcgactgaataagccacgcctcccaggcggtcggtttcactggaaagggctttgtttttaccttcattctctcttccgtgtctcccactccccccttttgaaacaatcctgctaaatcactgcctagtcctctctcgaccagccacgctcggctcttattggtatgttgctctgccaaaaaggggggtgggacgcttgtcgcgggcgcggcgtgacaggcaggctggatggagcaggtaggagtggtttgccatctggcggggtgcgcgctcaggtctggctcccctttcgagaggtgaattttacaacccaagaagcattactcagcagggaggtatttcctatcctggttgtgcatttcatgaaaagttgatgcctggaaattcaggcgttctcgatttctctttcttcccctccctcctttcttttcagaggttccctctttctctcgtgttgggggtggggttggaagaaaggctattatctgagacaggctcgcgttatggctccgctttctgcggctctcctaccctggcatggtgtgtgtgtgtgcctgtgtgctacgtaagtgtggaatgaaaggtattttggggtgggaagggtgtttagggtatgaatttttttcttagcggtgctaggcaaagcttgatgtatttatttgatcaaagaatgatcacagtgcaaataatgtgtgatttgtgtgtttattttgcctcgctgtgcttttgtaaaataatttcccgttttgtgtaactacctggggataggtgacagtagcattgtttcattgacccggggggcttctcctctccctcctggcttctctctttgaggagctttcccttgcatcctctacttctccatttaattagtggcagtagagggcaggccctgagttgcagagacgcagacattcctaaacaaaggggctgcttgggttgacgtattgtggggggtgggggtgaggacagctgcatttcatcctaggttcttttaaaaaatgttttaataacatgattatttgtaaaaactcccccgaaaaaacgattttaagagtgttttgggaagtgcagctggataaatgaaacacgttaatgtcactgttgtttgtgctttatttacattggcagtgagtgtcagaatctacctagagcacatcttgccacttttgtccacaggagtcactactaatcatcataactgatgtctagtgtgaaagtgaagcttggaatgtaaacagagtccgagtgtgtgttggcatgtgactggattcactcctgcatgttgctagaagggaatttggggctgtataggaaatagcaagaggtgatgaagacaccttttattatctatttattgccatgtcgctggtagtatttagttccacacacattgtatttcacaagatgagtctcagccgtcttcctttttcaactttctcctaccagtgaaaaaataagccagggcagttctgatgacttcacatttcattggtatttgtttttcatgggcagtttcatgctgtcacgttgcccttcagagaatcagggaatgccttcgtagaatattaacgacaaattgttgaatttgcacagcttgttttgtctccctgaattagtatgtgtaagaaaaaccaatggaagattttagcaggctctgaaagtagaatgcccgctgaagcaaacggcagggttgttcttccaaggcgtattaaatatgggtacacttagtttgcagacttggtgtgctgcagaatatcacatatgaagatattttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaaggtaaggggttgagatgtgggctttgcttgtgtgaatgtatgtgctgtttaattttttctgtgtgtttcgggcggaggtttctctggtgagttataattcatatttaccctgatttaagtcatgtcactttaggtagccagattcaaaaccatcagatgaaggacttttggtgttagagggattagcagtttaacaaaacttctgattcatggcccaagatcagatttggtttggaatcagaacactttggactagtttctgcatctggcttgagtccttgtggatttcttgttttatttctttatttttggcaatctgtagtgcattttggcatagtttacttatgaatgttaccgctaactttctgaaatcttttattccattttagaaaggtatcatttattgaaaagatttttctactgaacaaaatactgggattgaatggcagcttcttatcacattagatatgacattaagtaatttcgttagtagttaaaatgaagcaaatggcatagaaatgaaggccaggctgacataggataaatggcaccttctctccttatcctgtacaaacacggatagttggctacttttgaatgcctcttctataccaatggtaaaaatccggcttaattggggccacattctagcctagtcacaatcagtggcttgcattatgtcctttgagatgtggcagatctgcttataggtgccagtcaccacggctccctgctggcttgggggtctttctactcatttacatataattatctacttcttaatcaaccattaaggttaacttttggcatggatcctgtatgcttttcagtttaagatgctgtcacttttaagatgcgccatgagagcaaagtgctaagccttgtgcacatactatgtcatttagttctcatgagaactgtgtgaggtaggctgtgatttacagatgaggaatgaaagctcaaagaggttacgtgacctgcataaggacacaaaacaagttaagttatggagccagctattttgaatagaaaggcctagtttttaacatgctgaatatcctccccttctgacaaatgccttgaaaggtcttactatctagattatttaagataatgtaagagaaataaacaccactggttgcaaactgatggctgctgggcccgatttgaccaggaaccctgcttaatgtggtctctagagtgttttaaagcttggaaatttcatgaaaatggtaaaaatctggcttaattggggccacattctaacctagttacagtcagtggctggcattatgtcctttgagatgtggcagctagttgtgctatggttgcagtcaccactactttctgttgtcttaggggtctttctacttgtttacatataattatccacttcataacaaacctttaaggctaacctttggcgtggatgccatatttctttcactttagtgtgctgtcacttttaagatatgccattatttcatgtaccacgaagaaaaaattgctgtcaagttatgacatactgtccatcttatgaagcatccttatttcagagaagttgaaatatgagaaaaaggatattttagaattgatgaattacagtgactagaaacctgggaaaactccatgccatcagtttcaatatccccaatcattcagtacttttaagtcaacgagtagtcagatttctgcttttctgtgtttgaggaaagtgctagaaaaagagaagtgctcttaaataggcattagcacagaaggaactgggggcctagatcatagccaactggatggccgtctgtaagtgattaagaatagttgttagtttttaaaaagtggcctgtgtgtattttcaagagattacttgggaaaccctatgtgccatctttgcagctgtgcaaaacggtgaggacaagattgctttcaaaaattgtggtttagattttgcttggatctcaaggtgaatgctgacaggccgttttctgaagagagagaaggcttgcccagtcatgccaagtccaagtgcctgtgtcgggcctagatgctggatggtagactgtatacccaggacatataggtaatgtttgagaaacaaatgttaaaaggacctagttttcatggtgacatttaaaatcagtttttaaaattcatgaatataacatgttgttttaaaatttgattatagggaccgggtgcagtgatcactcctgtaatcctagcattttgggaggccgaggcaggagaatcacttgagttcaggagtttgaggccaggctgggcaacgtggtgaaaccccgtctctacaaaaaatagaaaagttagccaaacatggcggcacgtgcctgtagtcccagctacttgggaggctgaggtggaaggatcacttaaacctggaggcagaggttgcagtgagccaagatcatgccactgcactctagcctgggcgacagagtgagaccctgtctccaaaaaaaaaaaaaaaaaaaaaaagactaatgaatagaatttattttcttcaatgatgtagtgtctgtggaatttgtagacattgacatttgaattttcattatatttagttttattaaatcagaatgttatgattgtttatttcattattgaacatcagtttccttaatttaaggaataaaaataattttgctcaggccagacatagtggctcacatctgtaatcccagcacgttggaggccaaggctggtggatcacttgaggtcaggagtttgagaccagcccagccaacatggtgaaaccctgtctctacaaaataaataaataaataaatgaaaaaaaaatcagctgggtgtggtggtggacacctgtaatcccagctactctggaggctgaggcaggagaatagcttgaaccctgaaggcagagattgcagtgagccgagatcgcaccactgcactccagactgggtgacagagtgagactctgtcacaataataacaggctggggcagtggctcatgcccgtaatcccagcactttgggaggccgaggctggaggatcacctgaggtcaggagtttgagaccagcctggccaacatggtgaaactccgtctttactaaaaatacaaaaattagctgggcttggtggcaggcaactgtaatcccagttactcgggaggctgaggcaggagaattgcttgaacctgggaggcagaggttgcagtgagacaagttcgggccattgtgctccagcctgggcaacaagagcaaaactaaaaataaaaaataaaaaaagaatagtaatagttttgcttaaagggtgaggacagtgacaaatggtgatcctcagatgactgtagtttctttaccattacagaatgcaattcaaatgaaaaccattgcatggtactcaggcatttcttcaatgcagtgtgtgcccacatcaccaggaagcttacttgggaaagtttgttttgggattctggagtacctcaatatatctggtatattttcccaagaaaagtgaataatcttggggggccgaggtggacagattgcttgagcccaggagtttgacaccagcctgggcaatgtggtgaaaccccacctctacaaaaaatacaaaaacttagttgcgtgttgtggcacgcacctgtggtcctggctgctggggaggctgaggtgggaggatggcttgagcctgggaggttgaggctgcagtgagccatgatcatgccactgcactccagcctgggtgacagagcaagacactgtctcagaaaacaaaggcaaacaaacaaagatcaccccaaagaagaactcccaacatattaaaagtcattgagttttgtacccttcaaatggatgaattgtgttgtgtatgaattacatctgaataaaactgtttaaaaatattaagaatgattgagtgtgacattattgcagcagtacattggagtttctgctaaattacttttgcattcatttcaaaaggaagcaactatgcccattgctaatttaataacctgtttgcttgtgcggtgtttaaaatggcatcatgaaaacatggcaatgtgtgatagattaagagccaattaaattttttattttgagttacaagatctgcattaaacagattttattgttgcccttgaatttccagtcttagatgagtagcagcagtgaaaaaaagagatcctaacttaagagttttcaagctttttgatgttgcaggtatttgaataagtgggtctgtcttactgaaatatttgttaattagcgataaagcaaactatatgttgatcttttggtagtccatgctaaggaggattagaataatatataaataatataatggtaataagtatcagggcaggaggattaaagaagggtggaagaagtgtgacaaaatgttactttctgtttttacattgtttctcttccaggtcacaactgtatttcaaatgtatttcattttcagactataggtggcaatgtttgtgctgttcactgtttaatgttactgttggctcgggtgttgcttgttgctggaatatggaaatgatagcataatttagagttgagaataaaaaaaactagatttagaaaactagaaactagatttagatttagtagagactttctaaatagtcctagttctgctgtgtggacccttctgtaactttctgttactctgagaaggagctgataattatcacaactactggtgtttgattagcagagacattcttgattcctgatgcaagaccgtggctgaagttgtagcagggcgtttggtggttggcgatgtaaagatctgggcctcttgtttcatgaataatagaatctcactatgattgtaatattttgttttgaactggagtgctgattattgtaatccctttaggtgagaaaagccttattatataagtgtatctggggtaactagcttaaatttgacactccagtcaactttttgtccctgacttcagtcctgcattgattcaaaacgcaccaagttaaatgtcaaggctctcagattcccttgctgtcatcaaattcagtgtttggtgacttcttggcaggcagacatctaccaagagattttgtattctttttatacctcctattcaccaaaagaaaagggccattcaaaagtgagtttttctttttttttttttttaagtttaaaaagctatgatgtggccacccatggtggctcatgcctataatcctagcactttgggaggccagggcaggcagatcacttcaggccaggagttcaagaccagcctgaccaacatggcaaaaccccgtttctactaaaaatacaaaaattagctgggcgtcgtggcgtgcccctgtaatcccagctacttgggaggctgaagcaggagaatcgcttgaacctgggagatggaggttgtggtgagctgagattgcaactctgcactccaccctgggtgacagagtgagactttgtctcaaaaaaaagctgtgatgtgaaacctgttctgtgaaggtggaacttggaaaggcttgtaaggatggtggtcccatgaagaggatgaacaaaccaagggaactgtcctcttgctggtttgggtgatgtcccatcacctgtcactttgtttgtttgggctgcagtggaccaatggtttcccaggcacactgaagtgacatgtagatggattgcttgagtggctccggcatgtttccatctcctgtctaccaggcagagaccgtgttccctgttttgaggggatccagaagtgcagtgacaagggcctgatttgcatctccagctcctggtcttgcctgtgttaacaattttttttttttctttccagatggagtctcactctgtcgcccaggctggagtgcagtggtgcaatctcggctcactgcaagctctgcctcccgggttcacgccattcgcctgcctcagcctcccaagtagctgggactacaggtgcccaccaccacgcccggctaatttttttgtatttttagtagagacggggtttcaccatgttaggcaggatggtctcgaactcctgaccttgtgatccacctgcctcggcctcccaaagtgctgggattacaggcatgagccaccgtgcccggccaacaatttttacattctaattaatttccagtttccaacctgactcaaggtttagctcttcgtctcttgggtgcagttttggatcatgtcttataatgtatatttaaaagtgtgttgtaaagctggaattcccattgtgggtaaatgctgagattgttgtaatactgagaagtgcacttgggaaccatggccaacactgccctagctgaccggaggttgcactgagttgtcccctttgaacatctgttatgaatgaatgttggaaaatgcaaagccaatcatttcttttacctgacctatgtgatgttaagttttagttttatgttttggcaagtgagtgttggatgtcactaatgtgaggaggccggtgagggcagactttgggtcagaggtaatgtaggagatgaagaccctttctattaatttttcttgtttaattgaagatgttcgtgttgaatgggttttatttacatgtataagttctttttttcttaatgctggaagttactttggtttttcagaaaatgcaagtaaccctaatctatttagagaattactttgcttagtaagcactcagtactatttagtaatggggaaaaaatgtgtttgtgtcccacagcgtgacaggctccacaaacttacttacgaatctcctaactaccctgagaacctgaagaatgggactttgtggagaatcttctgctttctttgctagtctctatttttccttctcagttattaagtgagttgtctttgggtgtcctcatcatgctgacttcatcttgcccagtttgttttgggtagaggaaggagtgcaaggtttaaaggaaaagcaaagcctgtacaacatggtgagaccccatgcctgtggtcccagctacttgagaggcccaggtggaaagataatttgagcaccggggttcaggaatgcgctgagtaatgattgcaccaccgcactcgagtctgggcaacagaatgagacctcatttcaaaagaaaaagaaaaagcaagactgaatcatttcactttgtattctcctccttgctctcattccttttgtgcttcatgcattgtgtgtgacaattggatgcagccgtaattattgtcagtaacttggtttttaagcttcagactgtatttcctcctcacttgttaacaccagaagataaatgaatgtggctcttggattgaactacatctacagggagctgaacttcccatgttgacgttgaattctagagtatgcttatgctgattcttgagaaattggtatgtgccgtgcctttggaattgataccttaattttcagtgaatattattggtattattattaaagagaacactttaagccaggagtaagagcttttcctccttttgagaagtgaggtacagaagagtatactgcagctgtgggagtgatgggtggggtggggcagtgttgaagaatatttaataccacgaagatgtcaccagtataatattaaatagaaaaagtaggttataagacagtggatccagtagaatcctattgtggttaagtgtttatatgtagagaaaatgactaggggctaggcacagtggctcacgcctgtaatctgaaccactttgggagatagaggtgggaggatcacttgaacccaggagttcaagaccagcctgggcaacatagtgagactctgtctctataaaacaagaaaaaagaaaaactaactagggatatattccagcatgttagtggaggttatctttgagcaaaggggattataggtaattttttattgtcttgtgttttgcttacatgtgttttctatatttctacaataaacctttttttcttaatataaaagtaagtttaaaagtgagtttaaaaatccctgaaaggcatgtacttcaagcttcaagtgaaagttatagtacttgttcagcacaaatactgatatagtgtttgttcagtggaacacttatttagggtctgccttgtgttttgtgtctaaggattaccaggtcattttcatattaggagctcaccactacgttgggagttggagagatagagcaaggactattttaaggaaaaaatgactggtaaattgtatttctttttccccacttgcagtttgcaaaatagatgtttcatttctctccactgtggacacttaaagtttgaatttccatccttctgtgcactccagttgcgtgaaagtaatttacattgctagtagtggtttgggttctctgaaattttttgtgtgtgctatggaaattgtctcctgtgatcagactcaaatccatttctccttattattgttttcttaggttttgagttagagaccttttcatgaccgtataaggtgttgaataggtttagatatcaaagtgatagctatgcatagctatactcacctgtgagcggtcagctcttcagtgtttctttcaactgacttgtaatatccagccactgttgggtgtgacctaaagtgtatctcttcccaaacagaagggaggagttgacaaacaccatgttacttttaatcagagacttgtccttgtcccccttcccccagccttttaataattctgaattcatgttgcagtcgatatgtgtttaaagtgttggtaggtttcttgtactcacaccatcctcctccactcctctcacccccaaaaagtgacagctgacagttgatggcatcttagaattgtgaggcttgagttggtctgtctcaattcgtgttttatggtggcccataaattgtgaaagataattgatagttgtcatgggaactagttatgttgttcagctatgatgtctcaattaggaaatgttcacctagacagtagggaaatgggccagctcagggatgtcttcaggaaccaggttcattgttttttctgctttcccttctacagcctggctctttccagggcttcttggtcctaggctggctgccactgacagagctatgcctttttttatttttttactttttttcaagacagtctcactctgtagcccaagcaagagtgcagtgacaccatcttggttcactgcaacctccacctcctgggtttaagcgattctcctgccccatcctcccgagtagctgggactacaggcatgtaccaccacacccagctaatttttgtatttttaatggagatggggtttcaccatgttggccaggctggtcttgagctcctgacctcaagtgatccacctgcctcggcctaccaaagtgctgggattacaggtgtgagccaccatgcccagccagagctatgccctcttttttttttttttttgtttgtttgtttataactgtgtacttgtaaaggaaagagaacggcctcctgtgccttaaatcttctgttgtgtctcagggcccacagaggctgagatctgttcatcctgcaaccagtcaccgtggcaaggaggagatagaattacctttttttcttaccttttgagccaggggtaaagtcaggcacggtgaccctgcattccacaccttggataatccatccaccttcagaaatgcccctggcttcgtgaaatgcacatgctccctttctccagggaggtgacccgaatatgcagctaagtattgcaaggatttctgggtaatattacacctgaaaggaggttttttttttttttaattatctggtgatttatgactaaataggctatgtctctcaaaacattgaacctgcaatgggcaagaaagaacaggatgactacaatgaaccttctatttggaaaaggggaaaataagacactcacagtggggtagctggctgaacaggaacagctgggagcgtttgctttggtcagccggtctggcagcttgcctctgctgaagtccgtccagggtgagaatctcgcttggtcattgtcctctgcagctgcacctggatggggtaggcactggcaaagctccttttcttgggtgctgcttggcattagtctggggcttcaggattggttgtcttggggttgaatagccacaggcttgttccagccttactgagaatgtctttggcaaaactgctcccaggaaaactcaggctctgagttttgtgtctagtcaattccatgggctggtaatggcagccagtgatctcacctagatgaggtctgtggttctgggaattcctgggtcttaacagtaagtcccacagccctgctaatccccaccacatctgccttgaggcaattttaaaatagcctagaatgaagaggcacacagttttgggtctaacagacaacaggggcagtttaacccactctgcttttgctctctggtgtatcaagaatgagcaacttccccacactgggattgtgggactctgagtacccacttcccttcactcagccattccaatttcttaaagcaatttttaaaaaatggtggtaaggccggccgcggtggctcacgcctgtaatcccagcactttgggaggctgaggcaggtggatcacgaggtcaggaggtagagaccatcctggccaatatggtgaaaccccgtctctactaaaaatacaaaaattagctgggtgtggtggcacgcacctgtaatcccagcctctcgggaggctgaggcaggagaatcgcttgaacctgagaggcggagattgcagtgagccaagatggtgccactgcactctagcctggcgacagagcgagactccatctcaaaaaggtggtaaaatacacatgacaaaatggactctcttagccacattaaagtgtatggtttggtggcattacatgcatgcacactgttggcagccatcacccctgtctagccatggaactctttcatcttgcaaaactggaaatgccttactcgtgaaccagtacctccccattcccagccattccagtttcttgtagcgcatcttctctttgatacaaaatctttgatagggttttgattgcaggcaacagcaattgaatctgatgaattcaacagagaaagaattaactgaaggaatttggggtagcactggagtacttgtcacactggagagacaggcctggacaggggtcagggaccaatgaagcctgggcatccagaatcacagctgttagtgtgttttattatttaagagtgagctcagaggtcactgttcaaagctgggcactctgtctccaactatccctcttcacatcccagactcaatagcacctttctgcatagttacttctactgaatacttcactgacagcaatgaaggattgttggtttatgtgtctgtctcgtatagattaggcacctcttcagagccacagccacatcccaatgatttatctccagtcccaagcaccgaatcagaccccttgaccgtttactccattcaagtgatgatctcaggttagataatcatgaggtcagttggtcaaagcaaaaacatctttttaaatgtctttttgaattctaatttgtttatgcaatatagattactcctcctattttcttcttctttcttttttttccttaagagatgggatctcagtatgttggccaggctggcctctaactcctgggctcagcggtttctcccaccttggtttcctaaagttcagggatgacacgtgtgagccaccgtgctcagcccctcctcctattttctagtctgtgtcattactgagaattttactctttattctctttcctcaaattctaagtgaaaagacctctcctctctaggccccaagaaaggcaaatgtgttccacggaagaaggttgcagacccatgtttgattgctttataccatatttcccccccagaggctcttaaaagggcaaagaaggtgttgaaactgccactgtcaataccagagcatctgcttgaaaccaatgtttcttttgtgactccaggatccatgctgcctggctaagaagggcagtgtcctccttgcccaggtgttaaaccacaacagacctagaaaactgagatgtcactcctcccctggagtgacagcagtgttaggaagtttggaatctgccaacccacctcatcctgtccatgaagttgtcacttggctaggtgttgatgtaaatgtgctacagaaacaaactcacctcttgtgggacatggtgactctggttagtaacaatgtattcttcaaaattgccaagacagtagattttaaatgttcttcgtatgcaaacttggtaagtatgtggggtaatgcataggttaactagcttgaattaaccattccgcagtgtgtatgtatttcgaaataacatgtacatgacaaacagatacaattttcatcaattaaaataaacatttagaaaaataacataaatcctcacaatagccctttgaggtaggtgctgtcattttataggtggggaaactgaggttcaaggaggttaaataacttgcccagggtcacagaactacttagtaagtggctgagccaggacttgaacaagcagtccggttgtagacacccggagtggaaccatcacgctgtggtgtgtccgggagtgcttcaagcaggggttggttgggggtggggttggggtggggaaggcacagctgaggcctgagtggccagactgtaaaagccaaaggaagaagtggctggatgtgaacagctttgtggacctcatcaaggagctgggactatattgtttgaggcaccttgagaaacctgttgagatctgggcttttcttattagtaagtatgttgcccagactggtctcgaacccctggcctcaggtaatcctcccatctcagccttctgagtcgctgggattacaggtgcaagtcgttgggcccggcaatctgggcttttctaaagctcaccatgcagctttggggagattggatttgagttggacaaccctaggcagttgcagagctgtccaggcagaaatggtgatgacggtgaaaatgagccaggggataaggcaggaggtatttaggaggcagattccattggatttggtcactgattgattaggtacaaaaaaagggaggtgtctagaataatccctaggtttcttcagaggactaggtagatgggaggaggggaagaagcctatctctattaaatacttagtacagtggctctaaactggggcctgtcttgcacccttccttctcccctaggggacatttggcaatgcctggagacttttttttgagacggagttttgctcttgttgcgcaggctggagtgcaatggcgtgatctcagctcactacaacctccgcctcctgggttcaagcgattctcctgcctcagcctcacgagtagctggggttacaggtgcctgccaccacacccagctaattgttgtattttttagtagaaatggggtttcaccatgttggtcaggctggtctcaaactcctgacctcaagtgatgtaccggtctcggcctcccaaagtgctgggattacaggcgtgagccactgtgcccggccgcctggagacatttttgattgtcacagcttaggagatgcctctgacatctagaaggtggaggccagagatgcagcagaacatcttacacggcacagtacagctcccacaacgatcatctcgccccaaatgctgccgaggttgagaaaccctgctgtagtgtagtatcagttttacgtggttatctaattggatccgtgagccagtcatgttagatcataaatatgatttttcctgtttttcagataaaaaactgaggcatagacaggatgggtcacttggccaaagctctgcagctagtaagtgttagagccagaatttgaacgcaagtcttccagatgtcagaatctactccttctgcttaccctgctgcttcatatctcacagtgatgccaaggaagatgcacattggactgtgggttgttttttttttttttctttctgtcatggtggctccagactagaggaggcaggaaggaaggtggttatttatagtcagctgtgcataggatcgatttttttcaatcctgaaggacttgcagcaggtagttcaaagaaacctcctttagacgttgactttcccttgcagttgtaaatatgggaacatttaccatcttttgctttaaaatatactgttataattaaggtaaaatgtaaaacttataacttaaaaactttactccctgtgcatatgaactatggcaagcttctcaaattaattactatccctttgggataaattaaaatattttgatttgctagaggtaaggagcccttttgagaattagtttgttttagttgagaatgattagagggctagaatgatatatagctctaaataggaaggtttctgattcttttggctactctccacttttactggttattttccagttctgggaagattctgcatgtatgtagcagcctcccttggctatccatggtattagagctctagggacagagttctcctagttgaactcttcataatatctcattattggtattttcaaagttatatgtgtattttaagatagtctttggatgatgttccaaagaaggctgctttgttgagattgagatagttgttttgcagttgtgatttctctttgtaaaaagaagtctttgtgtcggtcccaggtcttattttttgcttgatcacccagtacgtgggtgcacttgggctgttgggaccatctggtgagtgtgaggtctctgtacttcacctgtggagtctgttgtcctgaaaggtgccggctcaggtggtggtgctttgaggggagcttgtttgctgcaccttccagtctgctagaaaatagatgcttagaggggcatttcggggtggaatctgatcatggagtttggtgagcaaacagggcctcaagttttatgttgtgagaaataaatactgagtttatgttttaattatggcacagattaatacaaaatctggtgaaaaatggagaaaaggagagcttaaaacttagctgtttgttgctgtcatctaaatgtagttggtagccagcctagatgggaccacagcatggcactaaagcgcggctgctgcttttcagatcccatgttcatattcgcatgtgtggagcatgaaagtaccaatagaaaattttgacaaagaaattgaagggttgggccagggacggtggctcacgcctataatcccagcactttgagaggctgaggcaggcagatcacgaggtcaggaaattgagaccatcttggctaacacggtgaaaccccgtctctgctaaaaatataaaaaattagccgggccttgtgacaggcgcctgtagtcccagctactcgggagtctgaggcaggaaaatggcatgaacccgggaggcagagcttgcagttagccgagattgtgccactgcactccagcctgggcgacagagcgaaactccatctcaaaaaaaaaaaaaaaaagaaatcgaagggtcgataatttcatttatttgttcttttttttttttttttttttttttgagacagtatctcactctgttgcccaggctggagtgcagtggcgttatcacggttcactgtagccttgacctccgaagtccacacgatcctcctaccacagcctcccaagcagctgggactacaggcactcgccaccatgcctggctaattttttatttttatttttattttttgtagagacaagttcgtgctgtgttgcccaggctggtctcgaactcctgggctcaggcagtcatcctgcctcagcttcccaaattgctggatttattgtcatgagccaccacacctggccagggtcagtaagttaaaagataccttctaaactcagcccaatattgaagagtaaacataaaaatacatgttttgtctattatactattactgttactcaatgcttaactaattgtgcttatgtttttttctttgccaaaatttctcttcaaggagcaagtttttctaatattgcttttcttgggaagaacaattagtcacgagatagtacagcttttttttttttttgagacagattctcactctgtcatccaggctggagtgcagtggtgcgatctcggctcactgtaacctccacctgccgggttcaagtgattctcctgcctcagcctcccgagtagctgggactacaggcactcgccaccatgcccggctaatttttgtattttttgtagagacggggtttcaccatattgtctcgaactcctgaccttgtgatccacccgcctcggcctcccaaagtgctgggattacaggcgtgagccactgtgcccagccgtagtgcagtatttttaagcttcggtaaggtagaacccctttagagaaaaaacatcagtgagaagccatgttgccttatttttactataatgtttctttttttttttttttttttttttttttttttttgagacggagtcttgttctgttgcccaggctggagtgcagtggcgtgatctcggctcactgcaagctccgccttccgggttcatgccattctcctgcctcagcctctcaagtagctgggactacaggcacccgccaccacgcccggctaactttttatatttttagtagagacggggtttcaccgtgttagccaggatggtcttgatctcctgacttcgtgatctgcccgtctcggcttcccaaagtgctgggattacaggcgtgagccaccgcgcctgacccaatgtttcttaaaatacatccaaacataaaaagaacaaggatgtttatagctggtatatcaccatagccatcactataacaccgtaacaaacatgcaaatttgttacaaatctaattctcaaatgaataccattcaaattaatagcatgattttaatgtgacaggtgatgctattttattaaaactctatcatctgtgctcaggaagtcatggctgctagggtaagttttcctttcctaaccaattatgtgccagttggtggtaacataacaccgttttcctttgtttcctttattcaaacttctcttgtactatgtactagagcatgaaaacgtctttgacctacagttatgttagctggagacacagcagaactactgttgtcatcttgatcctgaatacaagggccgattgaagccccagaaatcatggggaagtactcgtttacataaagtggtcatgtagataatctaaaatatgcccgttagtgtattaagatcataactgcctaaagcttcctgtgccaggagtggtcttagctctcaaagaagtcatagtctggccaggcgtgatgactcatccctctcatctcagcactttgggaggcgaaaggattgcgtgaggccaggagtttgagaccagcccgggcaacatagcttgatcccgtttcttaaaaaatggaagtgatatccaggtggggaaaccttcctgctgtagtggagcctcttgagatggcacacgtattttgctcacaggtgctatcaatatatagctctggttcttcagaatataaataactatcacctgaccccaataccttatctatattgagattgttcattagatccaaaacatcttgtgcatttcttgctttttagtcatgcacagaccttgtctttactttcaaagacagtttggtactgaaaattgctctggtaaattaacacaatttatttaatccctgctctttccaatctttagcaacgtttttttcattgtcaccatcagatgaccttgctgagcttccaagtggcaattgcttttgttgtattgtttaaaggcaaacaaaaatcaattattattggctctagagtgcctggcgaggtggagctcagttctttgtgcattgcgcactatgctgctggtgtctcagctgccatgcttatggttgcattactttcctgtctagctttggtattcttgcctttaaaaatttctttttccatttgcttttcttagccagtgatgacagtaaaataaggaacgacctatttattgttttaagagatacgctggatggtgcccaggcagatgagcattgccattcaaggtggcttcttggtagactgcatttactcttaatcgggtgcctgtgggtcagtgcatttcttggtcatccttactctgtcaaagctgccttgttagccaggttactagccatactagtctcattaccttacgataacacctcattcaaatggccttaacgaagttgaacacttatcttagtcactatggttggctttgaaccttttctagaagttaagtttattccctgggaaaaaacgtgtttgccaccacacagagtgctgggtgtactgggaacccggcttcaaaggcaactactccagtagggaaggttgaggagggtattgaatgatagctcactgcttaaataagtgtttagagtcccaaggtatatgtaatggcatatgaaatgcctagtgtttaaagaatattcagaaataatcagtcatactctttaatattcatatctcatagagttagcatcaggaaggaaacttggtagattaaataaaatagcagaaattactgctggatttttgtacagtagaaatgtatgcacatttttctcccctagtagtcacttaagttgcatatccatttcctgttacatctcatgacatgttttgggtaaaccgtttttggaagcgtccatttgtgtagaagttaggtggttctgagtttaactttgtacacatttctaggcacaaggaaattaaataactggctgagtgagagtgatctcgttgaatgctgaggcttgtttgggaattgggtttattttggtgaaatgtaaatttagatccactctgtattagtttttttttttttttttttttttaacggagtctctctctttcacccaggctgaagtgcagtggcatgatctcagcttactgccaccatgccaggctaacttttgtatttttagtagagacggggtttcaaccatgttggccaggctggtcttgaacgcctgacctcgtgttccactcaccttggcctcccaaactgctaggattacaagcatgagccatcgcgcccggccaagtccgtttttacactcctataacgacatacatgagactgcgtaatttataaagaaaagaggtttaattggctcacgattctgcaggttgtacaggcttctgcttctggggaggcctcaggaaacttacagtcataagggaaggtgaagaggaagcaagcatgtcttacatggaagaatcaggaggaagaggggtggggtgccacatatttttaaataaccaagcacagactcactatcacgagagcaacactgaggggcaaaatccactcccatcatctcatctccttgtaccaggcccctcctacaacactggggattgcaattccacatgagatttgagttgggacacaaatctaaaccatataaccctcatacacatgtattgtaattcagaatttgtcattttaaaaaaaaatttttaagattagcttatcaatttaaatgtttccagccctgaactctcaaagtcaactttaatgagttttgatttttgccgagaaagatcaacagcagaagaaagagaagtataacaaaacttagctccacaggagcaaactggagaattggagtactggtttatgattttggtcagttaagcagaatgcagtcctagtttaaacaagactggataaaagtccaaattcaaataccattcttacaagtgtttgaatttaattttgtcagtgtacatacatatatctagtaccatagtgatctcaggctttgaagaatgaaaagcaaaagaaatgatttagagtcctggtccaaccactcagctatctgatatccttttgctattttcgtttaaggggttatcagggaatgagctaatttgacattttctgcttaaagcaatggttggggctgggttggggtggagagagctgctctgaggaggtggtgtggggggcctgcgaggacacacttgggttacctggtacatctgcagttcccatggaattgggtctcaaaactgagaaatggaagtgtgagctaggaagaggagtagcttaatggggactttgccacacttttagtgctcctgtagctgcacacatgttgttctttgtaatgtatgatttgtgtcccagtggaacacttgaggagtgggagctggagaaaggaatgttgtacagtgttgtgcagatgtgggtgagatgaggtgatctgggaagctggcagtcttagttggcccaggaatgccaggacctgagatgacagctgctggtggcagcggggaatgcaggtgtatctgtgtcgaggttgggaattggactttgaagggctgggacttccagaaggtaaaatgggattgcactgtttgggagaaggggtacagatttttttgtttgcttttgagataaggtctccctctgtcacccaggctggagtgcagctgtgtgatcatagctcattgcagcctcaacctcctaggctcaagcaatcctccttcctcagcctcctgagtagctgggactacagacatgtgccactacacccagtgaatttttttttcttaaagatgaggtattgctatgttgcccagactgatcttgaactcctagaattctttttttttttttttttgttttgttttgagacggagtctcgctctgttgcccaggctggagtgcagtggcatgatcttggctcattgcaaactccgcctcccaggttcaccccattctcctgcctcagcctcctgagcagctgagactacaggcgcctgccaccacgcctgactaattttttgtatttttagtagagacggggtttcaccatgttagccaggatggtcttgatctcctgaccttgtgatccacctgcctcggcctcccaaagtgctgggattacaggcatgagccaccgctcacagccgaactcctagaattcttaaacattaaggacagaaacatctctgttcttaatcatgatttgcttttagtctcagcagatggaaaaatgatttacttgcaaagtgagagagctagatgaggaaggaaagaatatgattttgtaccactcagagaaaaatgtgagcatttctctactgtcttgggttggttattttccgttgattcaaaattgctctgcaggagacataggagaggcttgagagatgtcagtgggtggccatggctcagccttgatcctgagtgggtgggaatactctgttaatggggcaaagtggaccctccaggtccttcatgctccttttggaaagaagcgttcctggccagacacagtggcttacgcctgtaatcccagcactttgggaggctgaggcaggcagatcatttgaggtcaggagttcaagatcagcctggccaacatggcaaaaccccgtctctactaaaaatataaaaattagctgggtgtgatgatgtgcacctgtagtcccagctacttcagagctgaggcacaagaatcgcttgaacctgggaggtggaggttgcagtgagccaagatcgtacccctgtgctccagcctgtgtgatagagtgagaatctgtctccaaaaaaaaaaaaaaaaaaaaaaataggaaagaaaatatatgttcccctgtggttccctgttataccctcttctcttgaatagtttatcagaagggacaaccagctcctcatgcccttcctcagcaagtgtcaacagtgtgggagtgcagttgataaagcttgattttcacaactctgcaagtagctgagctccaccagtgttagaactgaaattgaggttatctcaccaggaaccaactttcagatgttgaagccagtagaaatttagtaatgtgggaaactgataactaaaagtattccaggttctaattattttgtcagctcagttttaggaagcagtcctagggattcccctggaagaaagtttggctggatagagggcagtgattgtgaattttctagatcttttgtggactgcttctgttgttaaaaaagcagcagtctctcagcacacgaatgggaagtgttaatgctgtaactgagtaacactgatactgagtttaaaataatggtaaatatcccactgaaatttcacccccagtacagattagggccttggaatgctggatagtggattaaggacatctgaaaatctacttcataaaagcagtgagaacattggcaaaacctattaatttcaagtttttcagaaccatggaaattagttaaagatttctagcaatctgaggaatgattgttcaagaaaacactgggatctcagtaggaacagtgaaccttgtgttttaacctgctgcaatcccattcccggcccctgaccacctccttggtggccttgaaaaccagcagcctcacagccatggcagctgtgaaactcagaagtctgttaaaccactggaagggacagaacagaactggagctcttgaaggaccatcctcaaagaaatgtcacaattcgaccatttggcagcttgcttgaaagggcctttctgagggctttgtctttgtttcacccaacacaggtcagctcacattgtgcaaacagctctacctgctgagcatttgttgaaaacaatcggtggtagttgtttaatcacagctgtctgaggtggtgttgctaattgaggccaagtggctgaccaaaaaattttttatttttattttatttatttatttatttatttttttgagacagggtctctctctgtcacctagcctggagtgcagtggtgtaatcgtgactcactgcagcctcaacctcctgaatttaagtgattggtcctcccacctcagcttcccaagtaggtgggaacacagatatgtgccaccatgcccagctaatcttttaattttttttgtagagatggagtctccctatgttacccaggctcaaacagtttttttaaaatggagaagtaaatgttccttgacgacttcaaaaagctccaacatattcctgggaatctagaaggctctgagcattctgagaaggctctaccttctctgctgtggcgatcttgaggctttatgcaagcctcaaggaagactaaggtagaattataaaccattcagcagagtgttgaaggcatgccccaatacccacacccacacgccctctcacctacccacccacccacccttagtaaaggctggaaaatttattaattcaaggcatgtaaggaaatctctgtgtagttactagcgaaccactaaactaagagtcttcagtggccatacatggcaaacaaaaaacaaaacaaacagactttatagaattagttcctgaaaatcactaatcagatagcaacaaaacaaaccctgggatgggggaagaatttgatttttagaattgacacattgtattagataaaatttctagtctttgacaaaaattagaagctatctcaagaaacaggaagatatgtcccatatacaggttaaaaaaacacacacacacacacacctcggtttctgcctagtttctaggatagaaactgtccttgatgaagcgcagatgttgggcatacttaaaacttaagtcactatgaaagttatgttcaaataactataggaaagcatgtctaaagaatcacatgaaaatatgcttgtgaggttgaagccaggaggattgcttgagcccaggagtttgaggctgcagtgagccatggtcatgatcaggccactgtactccagtctgggtgacagagcaagactctgcctcttaaaaaaaatattgggtgaccaaacagagaatgggaataaagaagtagagattataaaaaaaagaaccaatagaaattctggagtcataaactctagtaactgaaatgaagaattcactggaggggcttagcaggtatgaactggcagaagaatcagtgaactggaagacaggtcatttgagatagttcagtctgaacagcaaaaataaaagaatagaaaaatgaacaaagccttagagacctgtgtaacatcatcaaccatacccataatgggagtcccagaagagggaagatgtaaagggaaaaagaaggtatactgtgaatagttgtgtgtttgttctcatgccgctaataaagacatacctgggactgagtaatttataaaggaaagaggtttaattgacttacagttccacatggctggggaggcctcacaatcatggcagaaggcgaatgaggtgcaaagtcatgtcttacatggcaccaggcaagaataggagttgtgccggggaactcccatttataaaaccatcagatctcatgagacttattcagtaccatgagaacagtatgggagaaacttcccttatgattcagttatctccaccttatcctgcccttgacatgtggggattacaattcaaggtgagatttgggtggggacacagagccaaaccatatcaagttgtatgccaacaaattaggtaacctaaatggaatttatacaaattcatgtagatgcaaatggccataactgactaaagaatttgaaaatctgaataggccaataacaggtaaagagattgaaatagcaatcaggaaaccttccaccaaaaaatactgggtcacatggtttactgggtaaattcactgggtgaattctaccgagtattattataaactctttcaaaattttataattaacctgataccaaactaaagacatcacaagaaaactatggaacaatatcccttataaatacagaggccaaaatcctcagtgcaatgctagctttcctcccattctcactacttgtattctgtcataaaaaaaggattgtacaccgtgacaaagtggaatttatcccaggaacaaaaacttggttcaccataccaaaaccactcaatgtaatctgtcatgttaatagaataaaagacaaaaaccacatgatcatctcagtaaatgcaggaaaatcatttgataatattcagtactttttcttgatgaaaactatcaactagtaatagaaggaaaattctacaatttgataaagactgtctatgaaaaactcacagttaacatcatacttcatggtgagaaattgcatgctttctcctaagattatgagtgagacaaggatagtcattctcaccacttctatgtagcattgtactggagattctatctaggacaattagtaaaaataaaatagtaatataaataaaagcattgagattgtaatggagattggaatagaactataactagaaaagtatctgtagttacagttgacatgatcttgtatatagaaaatcctaaggcgcgcgcgcgcgcgcacacacacacacacacacacacacacacacacaaatcttgaactaataattgagtttacaagcttgtacatacaagaacattgaagcatccagaaatgaaattaataaaacaattccatgatacagtagtatcaaaaagaataaaatacttgggaataagtttaataagtttatgatttgtacacaaactataaaacattcttgaaggaaagtaaagaagacctaaaaaacaaaagaaaggacattccatgttcacggattagaagacttacattgttaatacggccaatactccccagattgagctgcagatggagtgcaatacctacaaaatcccagctggcttttttttttctcagaaattaacaagtttattttaaaaatcacatggaaatgtaagggacccagaataaccaaaacaaccttgaaaaagaacaaagctggaagactcacacttctcaatttcaaagctttgctacaaatctacagttatcaagacagtgtggtactactgtgtggacagccatagagatccatggaattgaattgagagtccagaaatagacccttaactttacagtcagttgtgtttttgacaggggtgttaggacatgaatggataaagaagatgtggtatatccatacaatgggatattattcagccattaaaccactaagctcagataaatgcatggatgaaccttgaaaacgtatggtaggtgaaagaagtcagacacaaaaggccacacgtttatttgaaaattctggaataagcaaattcagagacaagaaatagatgagtgttaatatgtgctggaggctggtgggaggggagaatagggtgtgatggtagtgggtatagagtttcctttgggatgatgaaattttctgtgattagctaatggtgatagatgcatagttttggagacacattaaaatcaatgaattatacatttgagaggggcagactttatggtatatgaaatctcaataaaacgtatttaaaaacaatatacagttaagagcgcatccagatacacctaaggtattagtaaagcggtgcattaagctgaaatatctggcttgtgcaaacttggggcatttgtaccttatgtagaattccaaaatctgcttaggattttccctgtccactggactgccactggcagggtctgcttccctgttcctgggttgagggagcagcattggagcatccctcaattcctgaatgaggaagttagttaaaagggcaatgtgagctgtagggccacactcatctaacaggtgagcttaagtttccattgatggcagacctatcagatgtttcctcccattctcactacttgtattctgtcattttgctcttatcctcccaaaatcatgctaagattttttttttttttttaagacagagtctcactctgtcccaggttggagtgcagtgatgccatctcggctcactgcaacctctgcctcccgggttcaagcaattctcctgcctcagcttcctgagtagctgggattacagttgcgtgccaccatgcctggctaattttttgtattttttttttttttttttttaatagagttggggtttcaccatgtgagccaggatagtctccatctcctgaccttgtgatccgctcacctcggcctcccaaagtgctgggattacaggcgtgaggcagtgtgtctggccactaagaatttttaaaataagtgacacaatgaagaacaaggccatagagatgatcttgggtaatttgagggtatcaaaaagtatctgcctgatggatggcttgagacactaaaaatgagtaaatgattacaaagtaaggaatgataatttgttttgaagaataaaacagattcttgtctctggtggttgagggatacgactgatgctgtatattaagacaagaagatgaagcccaaatggcagggaaattgaagagaagatacaggggtatctaggcacagggttggctgtgaaagtttcaatatgtaaaagatgataggctgaaaggaagaggatggtggaaaatacaaaagaggcattgataattcaggagtgtggagtgtgagagaagcttctccataggtgaagagttggatggacagtggttgttaggtcaaaataacaataataataacctagcacatatgtcagatatctgtttgggttcatcttacgcaccattctcttgggagggagcatgctttgaacagatccaatttatgatggagttttaggaccagaaagcgtcgtagtagcagagacttctcgtcctagagagcaaaggggaagtcattttttagttagttagtttgtgttttagacagtcttgctctgtcgccttcgcctcctggatgttcaaacagttctcccgcctcagcctcctgagtagctgggattacaggcgcacaccaccatgcccgactactttttctacttttttagtaaagatggggtttctccatgttgtccaggctggtctcgaactcctgaccttgtgatccaccctcctcagccccacaaagtactgggattacaggcgtgagccaccgcatccagccttagtttgtttctgagatagagttttgctcgtttcatcacccaagctggagtgcagtggtgtgatcatagctcactgcatcctcaaacttgtggggtcaagggatcccctcacttcagcatcccaaaatgctgggattacaggtgtgagccactgcatctagctgggaagtacttttaagagtatttttttcaggctgggtgtggcgcctcatgattgtaatccaagaggtttggaaggctgaggcgggagggtcacttgagaaaaggagttcgagaccagcctgggctaacatagcaagacccccatccctacaaaattttttttttaaattagctggtggtggtggtgtgcactggtagtcccagctactcgggagtgaggcaggaagattgcttgaatccaggaaattgaggctgcagtgaaccatgattgcaccacggcactccagcgtgagtgacagggcgagacccctccagatgatagctggagatcatgttattttcttactgattttcccccggtttagcaatacaaagtgatcgttaggttggcacaaagcacgatggaaaataaccattgttggcatcaagagaaatctcacaccacttgataaatatagtgaactagattactaaagagtgatttccctggattgcttgaaccagggctcagtgaaaatgttgctgtttgctttttttgtggtcaggattttttgattaaatgagaagcctacaaatatgcaagctagaaggtgttgtattttgggattaagccagactgtagcaggatgttagtaatttgagttgcataaactaatctggggaggcagagtgagtagctgatgtcacatgaagagcaaacccttgattccattcgtaatacataatagaacaccttcgtttctaaaactgggtgcagtaaagcataaaaaaacctttagtagctgatgaaagattctgccccaggcttgagtctattaaccagaaaaactgaaacaaaattaggcaaggtggtaagttttgctttcttttagtggaatattaggatatacagcaaatggtagcaggaccacgttgggaaaagggccaaaagactttttaaaaatcctgtttgaggtttggatccattttctttcatttttggacatacctttgagtagtgggtaaactgagagctcagtgaggtgagcctgtgtctttcagcgggcgggcgggctggagttggaactcctgtttcagtggttttcagatcctgctgatctccagaatggctccagttcccccacccctaatgctttattatgaaaaatttcaagcctgcagaaaaggtaaagaatgtacagtgagcacccatataccaaccacatggattctgcaatgaacattttaatatacctgcttttttttttttttttttgagatggagtcttgctgtgtcacccaggctggagtgcagtggtatgatctcagctcactgcaaccactgcctcctggattcaagcaattcttctgcctcagccttctgagtagctgggactacaggtgcgcgccactatacccggctaattttttgtatttttagtagagatggggttttgctaacaggccagtctggtcttgaactcctgacctcaggtaatctgcccgcctcagcctcccaaagtgctgggattacaggcgtgagccaccatacccagcctcataacggctttttttttttttttttttttttttttttttgagacagggtcccactttgtcactcagtttggagtgcagtggtgtgatctctgcagccttgacctcctggactcaagtgatcctctggcctcagcttcctgagtagctggagctacaggcatgtactaccatgcccagctaatttttgtattttttatagagataggcttttgccatgttgcccaggctggcctggaattcctgagttcaagcaatctacccacctcggcctcccaaagtactggaatctctttttttggaatacgtttcaaagcatgtgatagacatcggtacagtacagtcctaaacactgagtgtgcacgtcgttaactacagtttaatatttgttttgtttctggatcttttccagggatttttttcaagattaaattccaagcgccatgatagtttctgagttagaaggatggggcaggcccaggaatcagtactttgaaaagctcccaagtgcttcttgtgatgcatcgggtttgggatcttctgccccagggagcgcttcccgattacttcatagctaatcctcacctaaaatgcagaggtgggcagttatctttaacctgaccatagagctccatttttggttttcttggaatcttttgtttaaaacagtggttctcaaccaggggcagttttgtgcctcgagagacattggacaatgtctgggatggtttggttatcacaccagggggcatctagtgatgagagatcagggatgctgccgagcatcctgtaatgcaccggacagccccacaggatggggagttatctggaccaaaatgccaatagtgctgaggctgagaaacgtatttttttttttttttttgcctaaaagaaaattgcttgctccagatgactccagacaaaccaaaataaaaataaaaagtaaaaactaaaatgacaacatgaaatgaatttttaagagccaaatgagacctttagagacaatctcatcactgcctacctggtttccgtcaaatacagatttatgctccagaaagtacctaatttattaaaataagctgatttctaaaagcttgttagatggtcagtaatctcaaactttgagtgaatttacttgaaaaggtaatgttgctggtggcctttagtttcttttaatatatcttaaatatgatatcaaagaaaaacagaacatgatgctttgggatgaatgtaatgaatgaaaagcaggattctttggcaggtaactgtgtcccaggccctgtcctgcagggtggcagggatgtgctgagctgggtgaggggggaccgctgagggcttctctcagtagttgctctgtgtagaattttctgagtgtcttgggagaatgggggcatttttcctgaaggtctcacttgactccacagtgaatggctttacctgtctcttgagtaagatgcatttctagtaatgctctgactacttagtccacgtttgactagtttttaggaaaacaatatgtacaatggaacagaaagcttacagaaataaagggcagttcttttcttgaggtgaaagtgatgtggggagccagtaggtgacaggatttgctctggcccctccgagggaggaggaagatgaaggtgaaacgtggtattggtcagtccgtttcctgcttggttgatttcagggacctgatgagacaatatggtggtgaaaacagactgctggattgcaatgggcggaactgggcttagtctctggataggtgtcagttcatttcacacctgtcattgagggaaaataatacctgtatggctgttggaagattaaatgagactatgaacgggagctgtgtggataaaatgtaccaggcactcccagtgccagaaggtgttcttgttagttctgggtgtggcgatgtgcgaagacacccgtgtctgcggggtgtgtgtgagctgcagataaccagcaggtcctgctgatgaggcaaccttcttgggagtcttggctcagttccggggtttaattacgatgtatccttgggcaagtggcttaatgtctctgattgtaatttccttcattttttcatatctaaaatgaaagaggtgcttggatattcctaagggttcatctttaggagtctgtacttctggtgtggagctttctggaaaaaggcttctgggaatctgaaatggcagtagtgatgggcgtggtaacagcagtgttcatacgcttcctcagtaattttatgtaacaaacactcacagtgtacttactgcccctgagatcttaaaaactctcactttcaactttcacgacaccctataacttaggtaactgctattatccctggtatacagatggggaaactgagcctcagagaggttggtgatttgccccaagtcatagctgggaagtggcagacctcgatgggatgcaggcaccctgccctctgggctccgatcacttggccacctccccgcatgcaccacatgggctgtggagttggaggcatttgtgggcttcaagaatgagagttggtggggagtatgtgtgaggaaccggaggggtcatttccctgggactgggattgtggaggttttgattttgcttttccctttttaaactgggtgaggtatgagcatgggaactctgtacggaatgtgtcattggagagggacagcagggacaatgaaggtagtccccagagaagtatgagaaactggcattcagtgctcatgcagaattctctttgttttaataataatacaaataataacattaatattatttttagaggcagagcctcactctgttgcccaggctggggggcagtggcacgatcatggctcactgtagccttgaactcctgggctcgagccatcctctcacctccctcagcctcctgagtagttgccatgcgtaacaccgtgccttgctaagttttaaattttttgtagagaccgggtctcactgtcttgcccaggctggtctcgaactcctggcctcaagcagtcctccaccacagcctcccagagtgctgggattaaaggtgtgagccactgcaccctgcctaggattctctgtagatggggagcccacctgggtgagatgccagacacctggctccggcatatgcacagcagtttcacacgagcgtctcttactcaggtttcagagttctggtaaaagatttaggtttgacatccaccctttgaggtttttggttctcacatgtttgataacctgaagcttgtgggtttgatatgggcagtaaagtgggattatttctgttagagatccttattccctagagactttctggtctggaaaggtgagaggctatatattcattagctggaaccaccatgtggatcatttgttggaagaactgttaggaagaagacagatattgctatagagagcagggccagatgagcgagaaggcaaatgtacttcattcctgtacctgcaggcttattagggacagatgccctcaggcggggatgtgtagcttcacttgactgctctaaataaggagcgagagggtggtgtgtgtgttaaccatcaagattaagcaagcaagaaaaagacaaaagaaagccatcatttagtaactggtggagtgagttggagcctgggagctgccccaggacaactgttatttcccttgatcttcctcaaaccctaccaggaagtgagggcaacagttccctaaagcagccccatcaagctcttaagaaagcagtttcactgggagtggggagaggtagaattgggaggtggtagagggctggggggtatgaaatgtgagggccggagtcctcagcatcggaactccagaaataaaaagttgtctgggtctttgaaagcctcctatatgataatgttacagtaacagtgttctctgctactttcaatgaataaaaaacctagggtttctcagctacagtgtgcattaagagacatttgtggtctagttttggcacttcatttctatttgggaacatgcattctgagttttagacaactagcttccaaatgaaattttggaacaccaccctttttttttttttttttttttgagatggagtcacgctctgtcgtctgggctggagtgcagtggcgcgatctcggctcactgcaagctctgcctcctgggttcacgccatgctcctgcctcagcctcccgtgtagctgggactacaggtgcctaccaccgcgcccggctaattttttatatttttagtagagacggggtttcaccgtgttagccaggaaggtctcgatctcctgacctcctgatccacccgccttggcctcccaaagtgctacgattacaggtgtgagccaccgcacccagctggaacaccacccattttttaaagcagagaatttattgttatttgcacaaaaggacgtttgaacactttaggaaatctggatgctggaattaactcggtcaaaacaaagcaaaacacacagaatctcgtatcttttcctgccctgatgctgaactgcagccttgatttatgttttgtttttccacttttgtttctgaacctatgtggtacaggctgaacccttgtccctgcttcggagcacttaccttaattattatagaaaaaaattaagagttggctgactctgtgctgaactttctggtttttttccaggcagtttctccataacaaatgcgttttgcatagaattgaaattgcctatttacctcaatgacaccatcctaatagttggtggtaactacctaatctaataatctctcattgtgtgtgatagggctatttattgtattttagagtgaaataatgcattttgtttgcattttaaaaaggaatggtacaggaaatgattgtaatccaggactaaatatacagtttgcagtctttttattctaattgctttctgatgaatatatatatatatatatatatatttttttttttttttttttcttgagatggagtcttgctcttgtcgcccagactggagtgcaatggcatgatctcagctcacttcaacccctgcctcccgggttcaagcaattctcctgcctcagcctcccaagtagctgggattacaggagcctgccacaacgcccggctaatttttgtatttttagtagagacggggtttcaccatgttggccaggctgggctcgaacttctgacctcgtgatccacccgcctctgcctcccaaagtgctgggattacaggccttctaataaatattattttacacatcgagatagtactgtttatgcattttgtatgctgcctcttaaatctataagcattttcttttcttaaaaaaaagctttgggctgggtgcattggctcatgcctgtaatcccagcactttggggggctgaggcaggtggatcacctgcggtcaggagttcaagaccagcccggccaacatggtgaaaccccgtctctgctaagaacacaaaaattagtcgggcatggtggtgcatacatgtagtcccatctacttgagcgtctgaggcaggagaattgcttgaacctgggaagcggaggttgcagtgagtggaggttgcagtgagctgagatcacaccactgcactctggcctgggtgacaagagcaagactccatctcaaaaaaaaaaaaaaaaagctttgataaatattgtacatgattgcaaagcgtcccatcgtgtggatgttcacttagttatttgatacatatttttgtgttcttgggctgtttctaatatttctgtattacaaataaggtgatgggaagcagtttcattcatcaatcattctttttaaatgtcccttcctatcagtttctgttaatcagtcaaaagcgtatacattcttagcaggaacttaaattcttagtaggaatcttaacaggttaagatttctaagggtagagagggtacctgttttgttaaccggtggcttaataccatttaataccagtaaaggctcaataaatgtttattgactgaatgaacagaaaagatcagtgatcatgaagaatggcccagttagtggtatatatacgagaagtgctgcagtggttcacagtaacatgataataactaattgtgtaatgatttggcacgaggtactgatctaaatgatttatacattgttgcatgggattttggaaggggagggagtatacctctaaattagttcatgctatgggatggaagtaagactttaaatttaggtgggctcaaaaaacagaaacaaaccaggggccgggtgcggtggctcacgcctgtaatcccagcactttgggagtctgaagcgggtggatcacgaggtcaggagatcgagaccatcctggctaacacagtgaaaccctgtctctactaaaaatacaaaaaaattagccgggcgtggtggcgggtgcctgtagttccagctactcaggaggctgaggcaggagaatggcatgaactcgggaggcagagcttgcagtcagcagaggttgcaccactgcactccagcctgggcgacagagcgagactccatctcaaaaaacaaaaaaaacaaaacaacaacaacagaaaaaaatcaaatgttcgtcagctgatgagtggataaacaaaatgtggtatatccatacaatgaatgctatgctatgctgccataaaatggagtgaaacattcatacatgttgcaatatggatgaacctgccactcaagtagctggtactacaggcatgttccaccatgcctggctaatttttgtattcttagtagagacagggtttcaccatgttggccggcctggtcttgaactcctgacctcaggtgatccacctgcctcagcccctcaaagtgctgggattacaggcgtgagccagtgcgcccggcccaaagcttttttttaagaaaagaaaatgcttatagatttaagaggcagcatacaaaatgcataaacctggaaaacattatgggaactgaacgaatccaggcacaaaagaccacatattgtgtgattccacatattccacatattgtgtgattatatggaatgtttggaacaggcaaatccacagagacggaaagtagattagtggtggcatagggctggaagaggaaggaaacaaggactaactgctaatgggtacaggattttttttcctcaagtgatgaaatattcttagattatgaggatgcttgtacgactctgtggatatactcaaaacgatttaattgtatactctaaatgggtaaattgtgtataaattatgtctaaataaaaccatgaaaaattggatgaggtttagcattgtagaaggaaagatgggggtggtggtgtgttagtttttgagggctgccatagcaaaacaccacacactgggtggcttaaacagtaaccatttattttctcacagttctggaggctagaagtccaaaatcaagatgtcagcaggtttggttttccctgaagcctctctccttggcttgcagatggccacctggccaccttctcactatatcttgtggggtttttgtgtgtgtgtgtgtgtgtgtgtgtgtgtgtgtgtgtgtttgagacagggtcttcctctgtcacctaggctggaatgcagtggtatgatcatggctcattgcagcctcaacttcctgggctcaagagatcctcccaccccagcctccagagtagctgggactacaggtgtgtgccgcaatgcccagctaagtttcgtaattttggtagagactgggtcttcctatgttgcccagcctggtcttgaattcctgggctcaagtgatcctcccacctcagccccccaacatgctaggattgcaggtgtgagccactgcgcccagcctggtcttgtctttgggcacaaatatccgctagtgtctcattgcgtgtccacatttcctcatcagctctactggattagagcccagcgtaatggcctcattttaacttaatcacttctttaaagtcccagtctccaaatacagtcccattctgaggtagtgaaggttaaggctccaatgtgaattctgggggaacatggttcaacccaatgagaacaatggttatctgttgggagtgaggactgatatgagtggagatgcatcggtaaagatgcgcggaccacagatgtgacgcagcaggtgtgcacagaggtatgggatggggtcagtgtggagggccgtgtgccaggcagcagtgtggacttggtcctctacccagcgtaggggggtcattctgggggctgaaccgagggtgacactgtaaaaccatgcttcaggaaaattcatctctgcgccctggaggatggactgaggagggaagaggctgagggaaatgagtgtgcaagataatgaggcgatcccaagggaagtaaaaggattggaggccttgcaaaagcaaagcgaacccaagcttcagaacggaggcatctgagatgatgtcacagttttgaaccttatttatagaagaaagagggtgaaatggggaattaggtaaatgaaaatataggtcccattgttggtaagatacatggagtgtcattgattcagtatttagtgtgcttttccttattttaaacagctttcatagctcacttccaaactgtatttttgcaaccaactctttttctctctctattaaaaggagaatcttttattttacactaattaacagctgattctcctaagagagttttcaggaacctaaacctcagagttagatggagacaagtgtctttgttaatcatttatgtgaggtcagattgtacaatttgtaacagattttacagctggttcctttattaagggatgggtaggattcctactaattattattttgagttttactttgtttttaaccattgaaacttgggggatgtactctttggtttgggtagattttgcttatagatattgaagtttgagttgttgaatttcatacatattttattttgacttttaatcctttaaaacatttgactctgactccattgagctctgtagaacatctgtcatccagatcttttgccagaatatagagccttgattggacaccttgccagctaatttaaagcttcccaagatgcagaatactgtgtaaaatgtcctacctgttgtgtcagaagggagaaaataagacgagattttcatatttgcttgtagatccataagaaacttgggaagaattcctaagaaactagcagtagtggttccctgcagggtgggggctctggatgtgggtgtggcaggggatgggagagactggcaggttgaggagcagggtgagagggatgtttttatgatgtacattctcatatatttattttgaactatttgaatgtattactcatgtaggaagacaaacctttactttccaaaaatattagggaaaaactttcaagtctctcatttttagcctttttgttgttctgatatttccacacaggacagacggtaacatgcccgatacattttaagtacaaacaaggctgtaagttgccttacttgactttcttcactattttctattcaaaaaagtatttttgaatccaagggaattagaggaataatcttgaaatgattatgttttgggggaaaagtatattattaatatgatagttatctaatgttgtgtaacaaattgcctccaaatttagcatatgaaaacaataagcattcattgtgtcacacattcattctttcttttcagtgaaagttaacctgtttccatctgaatagatttctcactctgtatcctgccagtaatcattttgtactgtttctgtgcctttcaatccaagagtccaacctgatgaggttctgctggtgtaattcttttaaaagcattgtggatgtcctgtgaatctcactggagttcactttttaaacattagacttctgtggagactgctgaaggacaacacccttacttcttagggcctttggtttgccagaattgttctctgagccattgccttggattttttcctgacttcttaacaaaggattttataggtgggaccttcaacactctggaaattgccttagctacattcagccatctccttaggtacattttccatctcccacattgtagcaggcaatggcgttgctaaactttccatcaggaaataacaaagatctccttttccagtttccagtaacattttcctctctacaccatcatccacagtctcctgaaaggccctccaggttctagcttttccagggctcttcaggggttttcgaactctctttttacagtctttccagttcctgcccattgccacgttccaaagtcactcacacattttaggaatttttctttttttctttttagcaagcataccaattccagttaccagaatctgttagtttttgttatgtgttgccgcagtacagattgcctcaaagcttagtggctgaaaacaaggaacattactggccaggcacagtggctcatgcctgtaatcccagcactttgagaggccgaggcgggcggatcacctgaggttgggagtttgagaccatcctgaccaacatggagaaaccccatctctactaaaaatacaaaattagctgggtgtggtggtgcatgcctgtaatcccagctactcgggaggctgaggcaggagaatctcttgaacctgggaggcggaggttacggtgagctgagatcgcaccattgcactccagcctggacagcaagagtgaaactccatctcaaaacaaacaaaccaaacaaaaatgaacatttactgccatacacacttcctgggggtcagggatcccagagtgtctccgctgtgtcagtatgtctcagggtttcctgaggctgcagtcattatgcccgctagggcttgggtgggactgaagcacctgcttccaagttgcctcactcacatacctggcaagttggtgccgttgctggcaggaagcctgcttttcttgccaggtggacttctctgaggggtgcgtgaatgccttcactacagggcagctgacttccctcaggacacatgattcaggagaccaggggaaagctgcagtgtcattttatcacataatcccagaagtaacactctgtcatttctgcaatatcctgtgggttacacgtcagcattattcattgtgagaggtgactacatgagggtgagtccaggaggcaagaattattgggggctatcatggaggtttgataacataattggtaagaaattcagatacacctcagacttgattgtggcataccagtgtgttgtaaaacttgtgagaatggcttgccttagaaagacaagtagtccatccagtgtcttattcttatgttaagttgggattgctattttgttacccttgggcctctatatacaaagcctctcatagtaatagatctaattgggttgaagtttagtattatgtatatgccctctgcttttattagtagattttactttcgtgaaaggaacatataaacttcattattgcatttttgtataaatgcagctggggacatggttttattacccaatgtccattttgtaaatatttagagaactttttttttgcatcataaatcagtataaatagaagcttggtttccattgttgccctggctatgaggaagctgagagtgaaatttgtcgttcaagtgtggcagttatgttactgactggcgtatttatattctcctttatttgatattttgctatgagatgttccagtttacttgtgggaaaaaaagccaggtgttcttgaactcaacaaatatttattgaattccacttgctggccagacagcattccatgtgccccagatatggcactggacagatagataaggtccccactcgcctacagcttccaacctggtcgtaagaaaataccttagcttttgctccataatgtggaagaattggcctcagagaaaacctaattcatatgtaccacgtttctacccattcaagttttatttcataatttttttttttttttttttttttttgagatggagtcttgctctgtcacccaggctggagtacagtggcacaatctcagttcagtgcaacctttgcctcctgggttcaagcgattctcctgcctcagcctcccgagtaggtgggattacaggtgcatgccaccatgcctgactaatcttttgtatttttagtagagatgggctttcaccatattggccagcctggtcttgaactcctgacctcaggtgatccacctgcctcagacttccaaagagctgggattacaggcgtgaaccacgatgcctggccgtatttcataattctatctttccatagaaagaattggctggggcacgtataactaatgtgagttactgatttcagaggaagcttttggaagtggttgataggcactgaatgggatggggtggtgagtggtttaaaataacacttgaacctttggattcaaatggttttaaatgcatctcagaaaagtgaaaggtgaatgggagagctacatccattgagagcaagggttcatcagctagggctgtggcttaaactaagcagatattctttcctggcagttctacaggccagaagcctaagatcaaggcgtcatgagggttggtttctctgaggctcccagacagtcatcttctccctgtgtcttcacggggtctttattctgtgtctgtgtccaaacttccttttccttttttttttttttttgagacagagtcttactctgtttcccaggctggagtgcagtggcactatctcagctcactgcaacctccatctcccaagctcaagtgactctcctgcctcagcctcctgagtagctgggattacaggtatgtgccaccacgcccggctaatttttgtaattttagtagagacggggtttcaccatgttggtcaggctggtctcgaactcctgacctcgtgatctgctcacctcgtcctcccaaagtgctgggattaccggcataagccaccatgcccagcccaaacttccttttcttagagggtgggctttatctgtggttcttagttagcctcaccttcattcttccttttggtgttacggtcttgcttactgctttgggaatggatttgttgaaactacatgtgactagtttagggacccagtaggaggttttactataagtgtaaattaacatgtgcctttgggggaccttaaaagtttttgtcattgggccatgagatctgagtgcagctggtagaacctccttgttttctttggtatgagaactcctgggcttttgttggttccttccgttttctccggtgtattaccatttcacatcacagtgatattatccagataacacccatgatttgtttttaacggagtttcactctgttgcccaggctggaatgcagcggtgcgatcttggctcactgcaaccttcacctcctggttcaagcgattctcctgcctcagcctcccaaatagctgggactgcaggtgtgcaccaccacgcctggctaatttttgtatttttagtagaggcggggattcgccatgttggccagactggacttgaattcctgacctcaattgatccacccaccttggcctcccaaagtgctgggattacaggcacgagccaatgcacctggccacacctgtgatttattttatttcatttgagatttcagactttgtcgcttgttctttctgtagaagttttttcatagaagtatgttgtttcaaaagcaaccttcaaatagtagacttagcttggatgagaatctaaaagtctttgagtccaacaaccaagcaggtcccctgtccaggaagtaccttatagctgatgtttgagtatccctgcagatgggaactcactacctcctgaagcaccttacttctacccttggaatagtaacagagattaaaatgtccttccttaatttgaggtgaaatctgccttcttgtccattttacacacactaaccttccttccaccatgcaagctgagagagagccaggttgagcctgtgtttccacaacaactcttctcagacctcctgctgccacctaccatgcacttgctcttcactggctaggttccagttgctctgtacctttcctaaagtgtggtgaccagaatttggcacagtgagggaaggttccagagccctttagtgttatcgggggcacagagcttgggctttggagtcgctcagatcttgagttgatatgcacttctttgtccttgagcaaatgattgaaccttcttggactctcagttcctcattaataaaatgaagatgaaacaagatgagatggactgtgcacatttcctgatgggggctggtatgtgctggtgcccagtgcaaagtggctgctggcagaatggtgagtcaccagtacctgctcccttcactgagtgcttcctgtgtgcctggcaccattgctcagggctttacatggacttactcatttcattttcactgcagcctagagcgtaagtaagtatttgctttatccccatcttatagatgaggcatttgattctcaaaaaggtttcatagcttgcccatgttctagcagctagtaaaaggagaagccagagttttcatttaggtgggagtcctcaacctgctttcttaactgctgtgatctgcactgtggcatgagagtttgtcttaatgtaaatgcacatgtaatagcattattcacattgcctgagactgtggaagctcctttggcaaccagatgccacaggggactcatttcatgcttttagaagacttgagccactacatgccctgggaactgtgttgcttccccactggccatcactcttgcttttgtaagggatgtcacattgagccattaagtgtcatctctggaactcatgactctgttattccacatattaggttttctttgtagctttgtgtcaactccaagccaggtaaataaatcttggaagaaccaagttacagatgtgagtaaaagaggggatggcagggggcagaagtcagggcaggccctgtgacttgccaccagcatcctcccttcgggggaggtcctttcatctgggtgctagctggaggaattggcaacgtcggagataaaggtgtagatgcaccagctgaacgtcttgctctgtttcccattttacgtataagatgggtgatggcatgctgcattcagatccccatgggtgtatttgggatttggggtgggggattgtgtgtagaaggcaggaaagattgcccagcaactctcatttgaattgagggtggaagcggttctcgggcacagtatgccaaggcccagggcgtccaagggacagagcagagatcacagatgctgaacgggtggggaaggagcactaggcagggcatttctgatgagactttgatttgggaggtacgaaagttgtatgaggaatcttgataaactgcttagagtgaatggagatgagtaggaatcaccaccattcacatactggctctgcaagccactcagcacagctctgcacctgctcttatggaggagaagacaagcagaagagaatgttctgatctagaagagttcgtgtaagagcatgaaggcaacagcacttgagatgtggtgcacatgagcaaaatttcagtttatgtggaatttaagattaacagattaaaaggtaaaattctctccctggtaccaaaaaaaaaaaaaaaatccatgtactccctctctctcttttttttttgtttttttttttggagatggagtctcgctctgtcccccaggctggagtgcagtggcatgatctcggctcactgcaagctccgcctcccaagttcacgccattctcctgcctcagccttccgagtagctgggactacaggtgcccgccaccacacctggctaatttttttttgtatttttagtagggacggagtattccctctcttgactgatgtttcagcagtatgtggacagattcttttttaaggtaaatgaccaggggcttgtaatatgagtgtcacttaggcaacaggacatttcaatgaaatggtgatggaaataggttctttttgtagattgtgagctcttgggagcatggattttgctaaatatactgatttttaaatttttttgacatctagcatggtgcatttcacataggagtttttcaagaagtactcatttcacaggcatcttgaatgatagatgtttggtaagaactgcgcaagacagtgtactaatcactcattctcattcagcctctcaagctatcatggttggttagtaataacatttcaaaattatatttgtcccttaggctagcagagaatactgtttaacaggtttttcttgaaaagtaggagtagcgagctagagttgtctctaggtggggtaaataaaacatctcccaccccacccaaattgaagctgaataccttcaattcactactgtgcgcatattcatgtttcatgctgagcagttcacttgagactttctcacggaaagaagtgcgatacagttggtggtagtcttatatttgctacgtgctcatgtgttgtctgatgatagaatgcagtggtcaaatattgcacaatttacgccagaggaggagaattcccatcaactctccaaccatcataaatactttattccacacaataaggaaattgaacttttcagaagaatgatatagaacatctaaaataggttaaacttggaggaattatactgtccattgtaaaattggagccactcttgaaaaattgctgcatgccccactgaatgctagagcaagacatgcagtcccagctccaggggcttccagagtgattgaggcagggctgtgggctgctttcctgaagcctgactcctttctttcctcattacactgccacagatggtggcagatacagcatggattggcataagtcactctctactacctgcagaataaaggcccaatttcctagtgcagcttgcaaagtccttctcatctgccaccttcctgcctttgtgatttctcctcctgggactcctgcacccccttttttttttttaatttttcttttcttttttttgagatagggtctccatctgttgcccaggctggagtgtggtggcgcgatcatagcttattgcaggcttgacctcctgggctcatatgatcctcttgccacagcctcccagatagctgggaccacaggcacatgccaccccgcctggctaattttttgtatttttttatagagacgggatttctccatgttgcccaggctggtctcgagctcccgggctcaagcgatctgcccgcctcagcctcctacagtgttgggattacagacgtgagccactgcacccagccactcctgcacccttaccttttcgccgccctggccggctggacgactgcacccatttcacccggcattcttgtgcctgactgtgctctggccatttcctgtgtctggaatacccccattctcccatgctcagccccgtggactgtgtttattcgtaatcacacctcagagcccttccccttctccatggactccacccctgctgtgtagatggccccaacatcattttgctgagtggagtgccactgcaaggcatggcatggaggagcctgactgcataggtggcggcaccttgagggccttacagacctggcagttgaaggtatgggctagaagacagatgattccaaattacggctaagaaataggtaggctgtaaggcttgattgccgtgaatgcctctagaaagagcacttaaaaaaaaaaaaaaaaaagaagggatttccctgttcatggcctatgagtttaaaaacaagcaccccatgtcattagccctttgctcaccacagagttgctgacacattagacgatctagatatgtgtctgagattttggatgcctattgattgtgtattcacttagactttggtgcttttctagatgtttcacaagttaagatgttgttaagaggttctcattgttttattcctatgttctttccttccactcccaactcactccgatgtcactcatctgggttcttctgctcctgcctgggctgcttagtatttattgagctacacactgtgcttggcacccagggccatggaggcaggcaaagaggggggacatttattcagcagcttcttactgagggtatgggtgccaggtgctcgctctgggaaggtgcaaatgaaatggatgatggctgagcctgaagaattcccagggtgaacagatggggggaagccagttcgggcagagggagtggcaaaagctgctgcttaaagtcgttgctcccaccgcgtggggagtaattggatctgtctgcagcactgaggcctggacaggaagatgggactggaatgcagaggggccttgcagggctcagtcggggccaaagggcagagaggcagggcacagagagaagctgtggccgccttggttggtcccatggaatcctcgcccattggggccatgggcattgatcgacactgtggagcttgaaatctcaccaggtggaaacatctctgccagccctgtaatcatttccatagtttcttctggttcttttcatgaacattttccaatatttttatttgagcattaataaaaggtttgcctatatacttaaatttctgccagaaagctttgacttccgtgatctagagcaagcttgtgcaaccacaagcaggtcacatgcagcccaagatggccttgaatgtgacccaacacaaattcgtaagcattcttaaaacattatgagccttttgtgtgatttttttttttttaaactcatcagctgtcattggtgttagtgtattttatgtgtggcccaagacaattcttcttcttccagtgtggcccagggaagccaaaagattggacacccctgatttagagttttaggacttaggttttgggaatgccaaatgtttacatggaaaggctcatccattaggatgagcatggttttcctcatgaactccttggtagaacctaatgttagtgtgtggctcttttcctttattattttcttctgtacagggtactttataaccaatagctgtttctgaaaatatgggaaaactatttttgaatattgaatcaattacattttcagggtagtttgataaaaggcattctgtggtcatctttatctaaaacgaatcctcctggccttagtgtgattattttattttatttattttattttattttattttattttattttattttattttattttattttattttattttattttatttatttgacagagtcttgctctgtcacccaggctggagcgcagtggcgcagtcttggctcgctgcaacctgcacctcccagattcaagcaattctcctgcctcagcctcccgagtagctgggattacaggcatgcaccacaatgcctggctaatttttgtatttttagtagagatggggttttgccatgttggccaggctgatcttgaccttagatgatccacccaccttagcctcccaaagtgctgggattacaggcatgagccaccccacctggccttagtgtgattttgtattttatgttgtgagttttgtttttaaaaaagaacatcagtaagttcagaaaccaactccatgcttatttgctgtaatgaatttttcccttacattggaaaaacacagttccatctgtcctgaaggcccataagtcacagaatgcggtgtgttggaatgtgaaatcctttcagccttgcagaatctttatcattgtgctaaattgccatgtggaagaatggcaggtggcagttagaacttagggctttctatttattctctttctattttgcattagtcagttaaggttctgatcttcagaactttgtatgaaagtcagtgcttcatacaatttcacatcaaactgtggcattgcaagaggcaaaccatttggaattcttccttaaattacaaaaagaaaaaaaaaagtgaatgcacgaagattgttttgttcgcaagacttatgacacagccctccagctctgtggcttttcattctgatgggaaggaaatgagaccattgtaaatgactgttcagaatattagtgccagctccatgccaagtgctgttaagaacatggagagagcattcgagtgtttgcctctgaatttttgcccaggccatagttcgcagttggccggcaggctgcaagggccattccaagtgggagaagcattccatccctgggacaagtaaacagaacctaaaacaaacacatgtttagttgaagtgatacagcaccaggcaaagtgttctacttttaatgagtgaaggacatcagaaacaaaggatcagagccccccacgttgcattctcaactaattatagcactaaggcaggaatccttggccctttatctggagtgagtcagagagtatatcatgccttatctaaagtctaaagttaattgagcccaaggcccttctgaatagacacacactgtaatcagatatacagatggagtgggaagaggtaaatggtttcagatgccagcctggtgtagttgcatgccggaggggacttaaaggaaacagtgagaagtattagaaaactgtagttgaccaggtatggtggcttatgcttataatcccagcactttgggagactcaggctggaggatcgcttgaacccaggagttcaagaccagcctggacaacatagctagaccccatctctacaaaaaataaaaaattagctggatgtggtagtgaacctatagtcccagcaacttgggaggcggatgtgggaggatcgcttgagcctgggaggtcaaggctacagtgagccatgatcacgccattgcactgcagcctgcgcgacagagtgagattctgtctcaaaatagcaacaaaaacaaaaaccaaaagtatagttgcagagaatggctttccctgcttagttttatccagatgactgttagaatagtggtgaagaatctgacaagtggcagaatgcagggccatgggaagggggagagttcatgcctaaggtcagctgagcagaggagacttggagaactgagaggggatccctctcctgtgtttgttgggagggacagagcctgttgcccagcctgcaggtgtgggagggaccctgcaagaagtccctttggtcaccctcttcaggccccacattgcctgatgaggttcagactcctaggcctatgaagggtaataaggcccgtctgttcctgcctttacttttcttctatcagtttctaagcactctcagcctccgggcctttgatcgtggagcgccatgatacagtggcgttgtcctgagtggttagaggtgtgaattctcgaggccgactgcctgggtttgaatccttgcttggccatcttccagctgtgtgaccactctatgcctcagtttcctcatccgtatgataggaatagtggcagtacctatttcatggtgttattgagctgtacagttgctagctgctgccatcatcattgtcatttcctcatttcttttagacccaaactctcacactttccggaattatttctggagccccccagaaggaattggtctcttttattctagattccctaagaggcacagagggatactagggtgagaagatagtggtggctcacagtcatcactctgtacttactagttttgaaaatgtatcaaattgctgacgtctctgagcaccagtttcccaatgtgttaaagaaggatggtgatacccaacccatgtcacagggtttcgtcagtaaatgctaaaccatgtggtaagcagatgttctcagtgagcaccaggtcactattattatgttacttgtcatgacgagttttacttgccaccttgtattatagttgtgatgactatcttttttctagctccacattgggacacatgaaattatagagttaaatgaactcatttgtagatacttgaaaattgtaataatctttgaatatctgtacctgtttgtgtccagattcttctggttattttgacttccttataccccagtgtccttttttttttggagacaagtttttttctcttgcacaggctgaagtgcagtggtgccgtcgtagctcactgcaaccctgaagtcctgggctcaagcaaatcccagtgccttataagcaggcttcctcaaggcctgttgtcttactcatctgtattttccttatagcatctaggtcagtgccttgcttataatgggcatttggcaaatgtttgttgaatgcatttatcattacttagtaataaatactaaactattttttaatgggaaaataggcaggtttgggttctcatgcacatgacccacatttgtcgaatgtctgctgtgtaccagccagcagctttcttcctttagtgctatttcctgttagagtgggatagtggtatttcagtccacctgatgaccatttaggccaatcacatgttaatgggaattgaatgcatgcattaaacacaacaccagcgggtgctgtccacattaaaaccaggaggtctgcttcattggttcttgactatattgaaagagttggaaatctgacctgggcatttgaggtagactctaaggggtgtaagacggccctttgttttagagacttaggattggtgtgagtgactggcagggactgctttagtgcccagacctttagtagcacagacacaatataggaaaactcttcaaggaaaaccagccccaaataagagagtaggtaatgttctgcttctcttgctttatattctgcttgctttacagaataatctgagatagctaataatcaaagtgcaggtcccccaaaatgaaagtgatcatcatagaaccagaaaagaagggataaaatactgatttcaaggactcctgaagccaatggcagctctgagtttcctggcagccaagacaaagacagaagcatgctgggatgatgcatcctcgggctcggtaaaggaagcacaggacctgcctgctgctgtgggctcagggaagtgagtactattttccctgtctggagtggggaggagcacttgtctgtggtagggtgaggaggaccacttccttgggctatcagtcattaaggccccttaacatcatggccgattctgaaattacctctgaaagttgagatttatgttagactgtagctctcaagccagttcccttagaggccagagtaatgacagtgtaatttacttgccacctgcttgagagagacaattggtggttaagggactttcccaaggtgataaattgttttagcaaacagatccagaggacagctcctttcccctggtctatgtatgccttttgaacgccaagaccttatcctaaactcaagtttcacgaataggattaaaataccctttggggacctttcttacattgagaacagaggctgggccacagcttggctaaagcattccagatctctcttctgagcaagagattttgacttgttcataaaccaggctctctctcatagtgggcaaggccttaaaaacaaacaaacctgcaaaacctgaggaaacatcttcctcctacgtacttagctgatgtaggcattaatggaaatggatattggagtgggaggctccttttagggggcagaaaagaaagaatgtttttatttttaattaaaaaaatattttcttttgagacagggtcttgctctgccatccaggctggagtgcagtggtgcgaatatggctcactgcagccttgacctccttgctcaagtgaccctctagccttggcctcccgagtagctgggatgacaggcgcacaccaccatgtctggctaatttttgtattttttgtagagatgaggtctcactggcttgcccaggctggtttcaaggtcctgggctcaagggatcctccctcctttgccttccaaagtgctgggattataggtgtgagccaccgtgcctggatgaaaaagaaataacttgattatgggttatggaagtttagcaatggcttcaaaaaatgtcagcagggaatggatgtctttttctatcagatgaaatttcagtagtcatctgatacagccaaccaggagaaggaaaactactaagtagaaagacttagataagtggagtcgaacatctctgggcttaaaaggagcatcactcctggcatattcagcgtggcccagctgtgtttctctgagggcgatgtcctcctcagggtctgtgaatggctgaactcagaacaaggcttttgcaatctgcgccttctgaatacagtttttgttctgttggtttaatttgcatttggtgtctggagtgcctggtcatggaaagagcccgttctttgttttgggtaatgagggctgaggtttccaataagtatttctcggttccgtccgtgtcgagtgtcatttgagtagcaagtgactgttgctcattgcactgggcctgcgagcctccatttgcacattagatttttgcataccctgcaattagtaaattacagaatgacatcatgaaatagaaaactgtattcccagatggaaatgctttccgtattctatgcatttttattcaaaggcagatgcatttgtaaacctctttggatggttgttctgcctttgtcagttacttcatagcaaatgtcaactgtaaaccaagagagagaatgagccaggatggagaacttttttttgtttaattgtgtcatgttgggtgctttttggaaagtgggtgaattattcatgatgacatgaatgggggtattattttaaattagtatagaagcaaatggttcacaacccatttattaagaccctaatgttgatgtggctaccaagaagctttaccagcaagggccagtgtgttgccttccttggttggttagtttttctacatccacttaactcctagcctaattttatcttttttttcctctgtttttctttccctgaatgtttatttaagctctgataaatcattttgaattaaggtcgggtatgtatttcctttcttctcatcttcttccccctccatgactgcctgcatttgaatacatttccattgtgtgagaggcagtaatggtacagaggggtggggggtggtgactgcttggtgagctgtggctcacatgtctccagagacacagggcctaggaagactgattaaaaatcaacttttaactactataacggctcactttcctgaaacttgttatgctgtaaccccacctattgaagacataatcagaaccagaaagtgaacaaaattgaccctggaaatatgtggcaaaaattctgtgcaataagtatgataacacttttctttcagtgaattctctctcagggcccactcacagaaccaattttgacatcaaattttcttccttttaaaaatacagttaacccccacccccatctgcaggttctccctctgcagattcaaccaactgcagattgaagatattcagaaatttagaaaaatgaaaaataacaatataacaaaaagtaatgcaaataacgcagtatcacatctatttatgtagcacttgtgttgtattaggtattatatgtaatctagagatgatttaaagtatatgagagggtgtgtgtaggttatatgcaaatcctataccattttatgtcagagacttgaggatctgtgaattttagtatcctcaggtgtcctggaactactccaccatcaatgctgagggacaactgtatataatataaaataaataaaatatgtactgtaaaattgtaatcttgaaagtttgatcctgtggcagctgctattttcaggcagctcagcctttgtttgcatgctcaaaaccagcttgtgatttggtttctaagatcacggctggcttattatctgtgctggcttatcatgacagtggctcggtgttatggacacagtgagcatttggtgtcgatactcccagaatgaactgagtagaatggacaggagactgacctttgtctatttgtctatgtagcagtaatgccactaacttgttgcagtgctctttatcctcaaactatttgctatatatagtaatgcttaaattacatatattatatatattacatatacatattatatatgtggatatattatatattataattatatataatatatataattatatattatatagatggttctgactttgcacagttctgatatgcatgagttgcaattaccatgatttaaataataccagttccccaacaactctagtcaaatctcagttacccccgtgtgttaattgagtaattgcatgaagtacacaagcttgctgctagtgcttcagtatacaactcaccatgtaaataacagatgcatgtcagaatccgtggccaatcacagcacttctttcaaagcccatgggtgattggtcagtgcacatgttccttagttcatgcacagacagcagagtgtgtagttctgtggccttcttggctattggggataaaccagtgtgacattttacaaaaataccaaaaatcgagagggaattggtgaacgaagataaaagtgcagcaaagaagctgaaagtgataatgctagaagtgaaaccaaaacctacatggaattatagaagaaatagctgactgtgggaatattggcagtacagctgttggagagactgcctgcgcagcccgaggaggagaatgcaggtttaccacataaacaaggaaagtggttgtgaagaaaagaataaagctgtcctagaggacatgaccttggcaaaacaaacaaatttcacattaaaggatctctcagaaccatttcccagcatagaaaatgcaaaggatgaaatgtatgcttattcaaacttacggctcctagcagcactgttcacaatagtggaaaggtagaaacagcccagttatccatcagtgggtgaatagattaacaaatggatgaatagattaaaaaacagattgtgatatatccacgcactggaatattgatttaaaaagggacgaagtactgatacctgctacaatgcggatgaacctgaaagataccatgctaagtgaaagaagccagatacaaaggtcacatatgataaggttctatttatatgaacgatcttggtaaatctgtagagaaagaacacagatttgtggtttggtttctaagatcacagcaagcttatctctaagatcggggctggggcgcggtagggaaatgaggaacaactgcttaatggatgtggagattccttctggggcgacagaaaatgttttgcaaccacgcggacgtggtggttgtatgacattgtgaatgtactaaatgcgcttaattgtttactttaaaatggtgatgttatatgaatttcacctcgattttaaaaacgtgacatttcaccaagtcatagaaaagatgcttcgcttgtataagttatgcgacaaaaagataagcacttttaaatatttcttgataagttttttgtttccagggttttaaatggcaacgtgctgaatatttcactatttttcacttccttgtacatttataactgacagtaatagagtttttaatgctttgacaaaatttttaagaagtcacagaacaattgcattttttccttttcatcactaacattgttttgcaccgtttcagcttctatggacattcttatggtttcatactgagtactgcctgtgcacatgtatttcactacacccccgccccccaaccaacccctccaccccccaaacacatcccatacccattacagcacgttgttgcagggaggattctgagatgcgtcttctacaatagaaaaagatgtgctgggcttgctgtgaaaaagcagaggaagttagaggtgggatattagtggtgaagttggtagaacctcagctgcttctagggaagagggaaggtaaagtcagcaggtattagggaccaggggaagcctgtaacttataaggtatggtaactatcagagcagtttgtgggattggctagcagctgtgtggccagtagctggaagaaccagtggtctggacatgtcctagttttgagaaatctgtcggcaaggagagcgctaggactgaaggtatgatgcctgaagcccagaaacgcataatgggctgtgacaatgctgtttcacttgagctcatcggatgctttcgaggattcaatccatatctccctgttctccctgcattttgacacaggccgtgcttgcatgacagttgggttagtgtattcccctctccaccagagacttgggagggtaggggagtgtgccttagtcattctcgagactcctgtgcctggcagtgcctagcaacggcttaataaatacttgctaatgaacctaattattatgacattaagattttaatctaaatcttctaaatgactatgggaatctgtttatttttgcttaggatcattggtaatgttttctggccaaagctgcttttttgtctgagctgtgtgtttatttttcattcctgtctcttatttatattgtgaaaatgattaagaaaaataggtggtatggctcatggtctgatatcacgagtcaatgtgttgttttgaagccaactccacacataatggttcaagccctctgactacatcttagttttactccagattttctccatcaatgttgcttgcatttttcagtggtactttttggaaggaaagaatacgaaagccagcccgcaaaagatcactgggtgggggtcatagtctgtgatggtgactgaattatctggtaaagcatatttttgccgttttcagggtcaggcttcagcataatgagattccagaaattgttatgaaaaaagaaaccttaggttacccagcagctaaatgattactgcatcagctagcagctccggaatggccatttggccctgtagaaagatcattcttgggcaggctgttgatgtggagagtgagaggagcagctgttctttcacctgaggccccatctgggtagcagatggtccccagctaggcacaagccctgtgtagggacatccgtgctgcccaggatcctgggacactgcccaaatcaactgtcaggctgggagcctgtgtccagaactgtggatggcattcactttgggttgtggaagttggtttgtacctactcttaagtcttgccccttcaactccagctcaggctttttaaccctagtagaagctttcttatctgtaggtatttaagataagtttgaacctactggtctgtgggaaggtaccgaaaaagccaaaagctgcagctcctggggagcttacaggctcccccttgttgagagtctcccgagtgctaggtactgtgggtttaagggagaccctgcagtggtcaaaaggctgcctggtgaaggggggccggttcccatacttctcagatgtgcctttgggcaagccacttgcctcctggtgcttctcttttgtcatctgttaaaggggttagtgaaggacccttctcatagggttgttatgaagattaaatgatttaaagtatgcagagtgctaagaacagtgcctggcagatgattaaaaaaattgttacagaaatacagtacaataacatttttggtcacatttaatcctcaaagcaatcatgcagaaagggcaattgtcatacctattttgcatgagagactcaaccactcgcccaaagtcacagtgctagaaaggacttgagccaggatctgaacctgtcccctgaaatcttcacctgctttgcttcttgacacggcaggagaatgatgaggaagtgggttagtctgctagggctgctgtaacaactgcagatggggtggccaaaacctcagacatttatttatttttttaatataatcttggatgttggaagtcgaagatcaaagtgttgacaggcatgggttcttctgagacatccctccttggcttgcaattggtcaccttcttgcttcttcacatggtcctccttctgtgtgtgactgtgtccaaatttcctttctgtaaggacacagccatattggattaggcccaccctattgacctcatcttaacttatttactcctttaaaaaccctgactccttatacagtcacactccgaggtactggggattaggatttcaatgtatgaattttggaggtgagaggacacaattcagccaataccagtaaatgattagtaatcaaacacagggattgaatacgcagatattaaggattggaatgaagccagaatttggaaggattagaactgatggaggcaggtgcttggtctgggtgatttttgaaaatgattttcaggccaggtgaggtggctgattcctgtaatcccagcacttttggaggccgaggctggcagatcacttgaggccaggagtttgagaccagtctgggtaacatggcaaaaccctgtctctacaaaaattacaaaatatcagccagaagtggtggcttgtgcctgtaggcccagctcctctggaggctgaggtgggaggatcactggagcctgggaagtcaagtctgcagtgagcaaagatctgtgcctctgcaccccaagctggacaacagagcaagaccctgtctccagaaaaaaaaaaaaaggctttcaacagagtcagtcgtggacaaagaggaaaggacttttttcctcccctgcagctttaacctcccaggctcatatgatcctcccattccggcctcccaagtaattgggactacaggtacgcatgccactatgcccagctaattttttttttgtatttttagtaaagatggggttttgccatcttgcttctgctggtcgtgaactcctgggctcaagcaatcctcctgccttagcctcccaaagtactgggattacaggcatgagccactgcacccagctggaaaggactttttgtgcggtgagaggaggatcctcagaatacggagatctggggtccgcagacccattgtgggatgcacattgatttagttagatcttgagtgaagagatactgtgttagctgactgcgtgataaacgttagcctgagaaattagtttgttattttgataggcatttgagtcatttattgaactaaaagctttggggtgcctcatgtactaggcacgaaatcacagtacagttcttatcaggggagagatcatttgggtctcagtttcctaaaagtagcttttaactccaaaattgttttaatctatgtttgtagaggaacatcatgaaaatattttgaaattaaacttcttaagtataccttaattttatactgttattattttatttcatttttatgtttattttttgagacaagtttcactgtgtcgcccaggctggagtgcagtggtgcgatctcagctcactgcaacctccgcctcctgggttcaagtgattctcgtgtctcagcctcccgagtagctgggattttaggcatccgccaccacgcccagctaatttttgtatttttagtagagacagggtttcatcatgttggccaggctggtctcaaactcctgagctcaggtgatccacccacctcggccccccaaagtgttgcgattacaggcatgagccaccgtgcccagcctactgttattattttaattagtaaattttggtataatagagactggattttgacttaaggctatctgggtttaaatcctggctctgtcacttaatagctttgtcagatataccatatgacataaataggcagagtttccatcttatcacctgtgaaaagtggataactgtacacatcacattggattgccacatgcagtaatggatgtggaggttctgtccagcattgtgtctttcccatgataggcacttgtgctaatgctatgcaagaaggtagaaagttgaaagtggatagctaaaagtggaggcaaattaagggacttcttaaaatatttttatttaatagaaaacaatatatagcaagaaaatttggatcaattctttcatgcattcaacaattgaagtctgagaaccagccgtgattaggtgctccaaattagaataaggcaaggctcctgccctcattgagcttccaggcaggcgggaagcccaggagggcgtgataagtgctacaattcaggtgtgttcaggttgtcatgcaggtattgaagagggctacttttggatttatgcccacagaagagtttcacagtttctgaatttttgccccaggatgggagcaggcacttgcattaacatttgaattaatcacccagagaagagtggaaaagttatttcaggcaatggtaacagcatgtgcagaagtctagagggatgggagaggccacatggcatggttggaaaatagcagctcaggaatccatttgctgtgggggtggtaagtggaggactagatttgtgaaaggggacagatcacacaggctttgggaacaactaggaggttttttttttgtttttttttttttttttgagacggagtctcactccatcacccaggctggagtgcagtggcatgatctcggctcactcaacctctgcctcctgggtacaagcaaccctcctgcctcagcctcccaagtagctgggattacaggtgccccccaccacacctggctaattttgtatttttagtagagacggggtttcgccatgttggccaggctggtctctaactcctgacctcgtgacccacctgccttggcctcccaaagtgctaggattacaggcatgagccaccaaacccggctgactaggagatttttaagcagggaagcaatttgatgatatttacagttttaggaagaccaaactgacagcagcttggaggctgatttggaaaggaggcagagtggaaggcagggttgttgaggggggatgttttagaaagattttgtgatgattctgctgagactgaggttctgaacttgggctgccctagggctgccctacagcagcccaggaggacagattgcagagctttgagatagttggcatcaagatgggtgtgtctggggtgggcatgactgggtttctagcttgggtgtccaagtggataaatagcctttcatgtggaggctgagggcatgggcaggttgagtactgtccttcttccccaaaggtagctggccagccatgggagtcaatccacatgggatggaaggatggagaatgccagctcctctttaaagacttggccctgaagaatagagcttgcaattttgtatctagggtagtcattaagatccgttcacacaggtttggatctttaatctccagaatagagggtgggatgctccctgctccattgagcccaggtcatcatgtgacaacctgtgactaattaggcagtgagctgatgagattcgtgtggctcttgagctaagcttttgaagccagggtgagactctctggccctcattatctcagctgtggtgcttggcatgtcccagaaggtagccgtgctgtggacctcagtccccgagggagcgctgtgccaccgccacccacgatggacctgccctgagagagaagcctttgttttaggctctttaagatgacatggggattttggtggtgtttttctagcctaatctagcccttcctgactcaagtttttgtgtaagagaccaaaccttgctcattttcttttccttagctacaaatcagttttgaacttaccctttttcagtatatgcctgtgcatgtgtatgcctttgtgcgcaggcagacaaatatagctaggaccaaaagcatttctgctgttaccattatccttttgtccaaggtatttttcaatgaactaaatgtcagaaacacacacgctttcttaaaaaagcagctttattgagatatgattcacataccttacaattcacccatttacagtgtataattcaattacttttattatattcaacgttgtgcaaccatcattatgatgttaatttttttgtttgttcctcttgttgagacagagtctcactgtcgcccaggctggagtggagtggcacaatctcggcttactgcaacctctgcctcctgcgttcaagcaattctcctggctcagcctcccaggtagctaggactacaagctcatgccactacacccagctagtttttgtatttttagtagagacagggtttcatcatattggtcaggctggtcttgaactcctgacctcaggtgatccacctgccttggcctcccaaagtgctgggattacaggtgtgagccactgtgcctggctgatgttaatatttttattacccataaaaggaagcctgtacgatataaccatcaccccccagttctcccacacatccctctccccatccctaggcagcctctaaactactttgtatctctacattttgcctattctggacatttcatataaactgagtcatgccatgtatggttgtttgtgactggcttctttcaattagtggagtgttttccagggtcatcaatgttatagcaggtatcagcacttcattcctttttattggtcaaatactagtctgttgtatgggatacattgtgttataaaaccatatggtttctagagatggaagccatgctgacccctgtagagttttgtttatccatttatcagttgatgaacatttggattgtttctgctttttgcttctatgaacctctatgtagtacattcttgtacaggttttggatgaatatgttttcatttctcttgggtttatacctaggaatggaactgccagactgttttccaaagcagctcaccatttgacattcccccccagcagtgtctgagggttccagtgtatctgcatcctcaacaacacgtgttgtctgtccagtgatagccatcctactgggtgtccctgttgttttatgtcatttaacaccaaacttagatcacatttctgcattactgactttgcacataccgtccccaacttgcaacttatgctgtcattaacttgtgtagatttatccatgtttggctgtttatgaggatttgtccgtgtcaacatgtatgtttcataaggacattcttaccttccattaccagacctacattctcaatttaagatttgatattttttcagtgtttaggttttcaattgaatcaactgacaagtttagtggcttaaactttcaagcttaaactgaaatgccaatcttgttttagaccaaaaattacatcctatctcttctcttaattgaggaacttaggtggtggttcctatttgtctttatttatttatttatttatttatttatttatttatttatttatttatttttgcctacttcagtttggtcggtaaactatcaattgtattttcagtatgtatatatatatagagagagatttttaaaattttattattattttttgagacagagtctcactctgatgcctaggctggagtgcagtggtgtgatcttggttcactgcaacctccacctcctgggttcaagtgattctcttgcctctgcctcccaagtagctgggattacaggcatgtgccaccatgcccagctgattttttgtatttttagtagagatggggtttctccatgttggccaggctcatctcgagctcctgagcttaggtgatctgcctgccttggcctcccaaagtgctgggattacaggcatgagccaccatgcctggcccattatatatacatttttaatataatgtgaaatcatgtggtctctactatagactgaatatttgcatcctaaaccccaatgggatggtattaggaggtggggcctttgggacgtgattaggtcctgagggtagagccctcatgaatgggattagtgcccttataagaagaggccaagtgagcttgtttgctccttctaccatgtgaggatacagcaaagaacgtgctttctgtgaaccaggaagtggccctagtcagacactgaatttgccagcaccttgatcttggacttcccagcctccaaacctgtgagaaataagtttcggttatttataaaccacgcagtctgtgatagtttgttagaggaacccaaacttaaaggcagcttctaaaggggagcaatgctgaccactctgtagtttgtatatttggtcaacacactttattgagtgatgagtctgaatttcatgcttgattgatgatgattggtgacagagtagacaaggtccctgcttcatggagtctatggtctagttggggaaatatacctttattgaatcaaggcagatgtgattacagattgaacaatggctgtagaaggaaagggatttccaagagagaattagaggggcttctcaaattgagtttgactttctctttggtgggggttgagtcaggaagaacctttttgaagcaggaaaaatctttagctgagacctaaaggaaggggaggagcttgcctgggaaggacactgtggtggctggagggggtttcccaggcagggacactctggcaggttagagtaactgaaataaagtctgtattggagtgcagagactgccagaagaggggctcatagaggccaaagtgggacggccttacggacgagctgataatttgggcattattcaaggtggggtgctatgtcattgaagggttttagcagaggggaggcattatccaagttaaagaacaaaacaaaacaaaacaaaacccactctagttgctgtgtggcagatggattgggattgggggtgtggggttggtggcaagaatagatgcagggggacaagttatgaactgagactgggacctcatgggtcttcctgcccaagaccgagatggctgggggtgggggctgcggctagggacatggggcctcagtgcccacgttttctgtcctctgtcccctgtgagggtatgtgcgctctcataccagccgcagggcactttggctcgcttgtgttgctgggagagatctcctttaatgtttttttgtgtttttaaaatatgaacgtaggccctggcagagacaaggcagaaaccacttttgagtttttagggctgtgcattcttaaacaactctgagtgacccttccatcattacaatttatcaactaaattagaaaacgtgctttcacagatttctagtacttgggcaaatttgttatttacgctcaagatgaagtgttgcttctagtgacagttttgctgttgggcagcatttgtagggtaaaggtgtttttgcttttggaatccattgggagatttaaaaaaaatatatatatatatacacacacacacacacatacacacatataaagtaaaaagcaggaagtctatgtgtgtgccaggggatcccaaactcttggcctccagcagtcaagagattttttaaaacctttatcttttaccgtcttgctttttaaaatccattatgtctttgtatagtacttgacatacatgggcagaagtcatgctggaacgtgaagatgggagcatggactttctggagcatcccaggtggggttcctgtggctgctgtaaggcaggaccgcagagcggtggctgcagacagcacggatttgctattatatctcatagtcatagtcctgtagggtagagtctaacatgggctaaactcaaggtgtcgccagggctgtgttcctcccggaggctctaggagaggatccccttgcctttcccagtttctgcaggacatctagcagcctcagctcattgtcccctccctgcgtttgcaaagccagcagagtagcatctctgtggccattcccacatggtcacatctcctcctgggatgctctccttctgcctccctttgcactttcaggagcccttgtgattccattgtgtccatctggataatccaggataatctccctattttaaggtctgctgattagcaactttaattccatctgcagccttaatcccccttttctgtgtaagctgacctagtcacaggttctggggattaggactcgcgcatcttgggggaccgtcattccacctgcggcagtggtaggctaaaccttaggcgtctgatattgtgaacctggctcactggcctttgtcttcttgccgactcctattggtatttgcctgagatgtttttcttttctttttcattcttttttcttttctttctttctttcttttttttttttttttctggttctgggcccacagtaggtgccttagaatcatgcagtccagttgccttctgggaatccattgtagtaagtggtagaggtttttaaagcagtcctaggggagatgcaattccctgcttacattcaagtttttcgggaagacaagtctgtttaggaaacataggaggttagttgcattttcctcattaatgcaggatattaaaatattcagagggaacccaggagtcctctcaagatgagtttaaatttctcatacttgtagaagttgttgagaaatactggattctaatttccagaactctggtggggaaggagactgtgaacctggtctgaattgagaatggggattgaggatttttggacttttgaaagattgacttactctctcccgttagttctgttgaactgctgcctaaatggagggaatgtgcatcctctcttgtgttgcgtggcaatgccgtggggacacttgggacatgagcaaaacgttgacagaggggagcacttcccggaatattattaatacagagttagttttaacttcaccttttgggcaaacttgacattatagatcttgaaataggattatttttcccttgctaagaggttagcaaaatcagtacagtgtgtctctttgacaggccctagaaagcactctacgtttgttaactttaaatttgggttggaaattgatgttattggaggagcaaggcgtgtttaggcctgatgatttttggatagcttgaccaaacccggtacagccaactttcccccaaaactactgtgtccttctcagtggttcctgtgcctgcacagggacccagcgcacaccccagtgtgcctctttgggctctggctaacttaggctgacatcctgatagaacgcagtgaccacctggtcatttgattacagcgcttcttccagacagcacgctcagaattgcgtttcttacttccagtcttcttgccctgtaagcattttctgtgagtcaccaaatcaaccacaaaatcatttaattttatggaagtggaaaatcagacttattaaaatactgtgtttttgttttaaagctcagaggtatagagatccatgaatttttttccatgccttctcataatgtggttttggtttagctgcggttcttccaggcgcagatgtcagccctctgcagatctgctgcatcagagtttatggcctgggtcttaggaatttgcaatttaaaataaccccttcaggtgcatctaatgcagcctaaatttggggccagctcatgggttgtaaactgtactgccctatacaatagtagcacagttctaagctcaagggactcaagggggtccagtaagtacagttcaccagagaaataacaaaagcatttgcagagggagaccagagcatcacctttgttagggcaaaggcttaacatagaggaatgtggcttctatgtccaggccagtgggcttcctaacacagaacatggaattaggcagacttaacatcccccatgcccaccctggtgagtgccagcatgggcttgagctgctcttcacactgatggtccatcctttggactgatctccttgtgaaggatacaatacagcaaggagcgggggcttggcttggcacagccagttctttacccaaactcctgccaacgctggcccttctttcttaccctggttggagtgtgtgagggtgggagaggcaggaggaatatgctggacagagcttcttccatctagaagggaatttcaggagtaagaaagcggcagctcttaacatacctgggagaaagcaagtgcttagtaaacagttgaggaatgaactaagaattttcagacagattttcctcttctggagcatttgcagaaccgcctctttgctcaagtgctttgttttttacagattcatttaaggtcatggttccagacactaatgtaaatcagcacatatattattgaagaagtagaatacctccaggcccagttgccttggagcaggaaaaacagttcatcctcattaccatccagaataatttatgttcaagataatacacaatcaatttactttttatcatattcgaatttgatttgtgtacacttttgagtttggatgtcagccacattgcttctgtgtgttaatctttatttacgggaataaatgggaagcagtcagccattttttattctttattggggaactgcattatagtggaaaaggtaaaattataagctaatgagaccagaggtctgtatgtatgaaaaccatcctcatcgcttcacagttgtctttgaaccagtttccctgggattgttcgaaatgtagcaaacgtggctcacggttaccctgacggggccagagcaatagggggaggtgtgggcacctgtatacatttgcgttgaaaaacgtacccgggctattctgaggtcctttcctgcccccagcctggtttctgggcctctctggagtctctctttctggcacttgtgttctggaatcgcttatcagcctggactccttcagcagcagctgccacagtgtctttgtagtcacactacacacctatatactccatgacatggagtgtatagaatgtttcccgtcttcctcgtcagtgctgccaggagaagcttcccctctcctaacctctggatagtggctggctctgctttattcaggcattgctttcattttttagaacagctgctccagtatgcttagtgtgaatgacagcccagcagaaagaatggacttgacactggagactgcaccactccacatttctttgtcccctcaagatgacttaactagctcccttcccttttccttcatgcaatagcctcagaagttcggctggcattgccaagttgttagagtgaaccttaacctgtgtatgactcagaattcacatctgctgtgtcagtgaacacacagatctctttgtgaacacatggttatcaagaggcacatgctcttacgtatcctgccggattctggtaaggcgctgcttgcgcagtaagcacttgtcaggtgcttatgatgcctgtgacgtgaggctgtggatgcagaatttgtggtctgaacatttttgagtagataaaaatggaaactgaaattggtgaagcagacttgtggcttttcctactttctcatctcttttatggatataactagaagctctgcttcatcaatgagtgtgttaaaacaatttgtttacaaaatcctatttattaaaataaaaatctgaaagaactgcgctgctgcttttcagtgctcgccactctaggaacctgtattcctcctcttgttcatcctcccttttcttcttttttgttttgttgttgtttgtgtgtatgtatgtgtctgtgtgtgtgtggcggggtggtgggggcggtgttgccaaatcttttgcactgaatctttgaagatgtcctgaaatacttaccaaatcactagagcgaagagaagcccatctgatttcttcatctcccagctgaggaaggacacactttctcccactctccagtgaaggcccctgtgtcctgtgggtgggggagctgacatcacactcagtgctgacatttcttgttccctgggtgggcgctgattccagatcctcttcagccccccaagcggaactgggtttctcttgaaggtcctaacctcagctcacaccacctgctactacctttctgggtcttggattttgttgttacccaggcccggggtcatcccaaaggctcttgatagccctgtggctgtgcttgctaatacactgtcctcatcttttgtcagcgaagtaaatccaataatgtttccttctctttaatccaagccagtcttcattgaaaacacttcacctctaagctctcaggctctgcagtctgccctctccaaccttacccctcatgccccaccttccctttgtccccatctttcccttctgttccagtcattctcatgggccatggagagtggaagcctgggagggctttgccaaagtccagttgcctgctcactttcctaagggccagagcaatgggggaggtgggggaggtgtgggcacctgtatacatttgtgttgaaaaaggtacccaggctattctgaggtccttttctgcccccagcctggtttctgggcctccctggagtctctctttctggcatttgtgttctggaatcgcttatcagcctggactccttcatcagcagctgccacagtgtctttgcagtcacactacacacctttaccccgatccactgacctgctgtcccggatggccctggtgtgttctctctgttcctagccgcagaaattgctggtgaatgtcaccaagctaagcggtgtagctttataacaagtggattcagccagctgggactggacgactgagagtttgcagcccctgctggaccctgtgtaactgtccagttcgcctagctattggtttggcccagtggttttcaattttggctgcacatcagaatcacctgggggaggtttaaaaccctacctctgcccccatgccctggggttcacacccagaaatgctgacttcattggtcgggggctggcaggcctggacattggcggtttgcttagaagctgcccgggtggttctcatagcagccagggtcaagcaccacggcctgttcttacctggctccccaggccccctttaatctccctctgcagcagattggcacacatcgcattgtggagcaagccatctgataattttccttaatcgtctttgaagatcttccctctgcctgttgatcctttaaggaagaagtctccttgccaggatcggcctctccagtctctggatcccttcttgcttgctctcttcagaacccatgaaacctctctggctgccttgacgtcagccagattggactgcccaaatagaaaggcagaaatccctgtcgaggccagacagcaaggatggagagaggcagggggtgaaatgaaacacaccaggaggagtaaagacaaggccttctgatgtcagccaagagcaggtgtggattaggcagtcctaagtttgagtcctggttctgctattcattggccaattgtattctccctccctctacgatgaggttaattacagttacctcactgggatttgtgaggatggaatgaggtaacaaaacataaaatactatcagtacaatgcccagctcataatgagtatgcagcaaatgttcaccctttaaaaaatgccacggccgggcgtggtggctcgcgcctgtaatcccagcacgttgggaggctgaggcgggcggatcacgaggtcaggagatcgagaccatcctggctaacacagtgaaaccccgtctctactaaaaatacaaaaaaattagccaggcgtggtggcgggagcctgtagtcccagctactcgggaggttgaggcaggagaatggcatgaacctgggaggcggagcttgcggtgagccgagatcacgccactgcactccaacctgggtgacagagcaagactccatctcaaaaaaaagaaaaaaagtccctttctaccttcaaattcaggaaaattttctttagtccaacagatgtaatccccccctcactcccccatccccactggtatctttatgtactcaggtgactattaccatattctgcttggactgtttttatacattgcagataatttgaagatatggacttaggtaggtttttagatttataataattaagtgatgtttttctatcaagtgatgaaagtttcaacagatatttgttaaaatttaatttagccaaaggaagacatgccatttcagcaatgtgatctaagtaaaagtgtcttctcttttttttggtggggagaacagagtgtagaatgatattagtaagatagagaattgatgaccaaaccataactgctagcattttagtagaggacacaacagagaaaggattctcacgtgtgttattaggatcttggatgagagtgggctgttattttaactttggcccctgttggagcaaattactctttgggggcccggttttcctcaggaactacctacagaattcagtgagatagattttagaacccttctgaatgctgctggtttggagattctgtctgtagcaagttttgttcagttgttaatctttctttcttttctttcattctttttttttttgacagggtctctctatcacccaggctggagcagtggtgtggccctggctcactgcaggctcaagcgctccttccacttcaactgcccaagtagttagaaccacaggcgagttccactacagctggctaattaacaaaaattttttttgtagagatgaggtctcactgtgttgcccaggctggtctcaaactcctgggctcaagtcatcatcctgtgttggctttcgaaagtgctgggattgcaggcatgagccaccacacctggccaactatatgttttctatgtttattatattttctgatttgtaatgtattttaaaattatcccaataatatatgaatgcaatcttgaaaaatactcagcatagcctttaggctaaaaagtggaggtctgccatttctctgccttgccccattcccttcccatgtcttattttccctgttaccaggttggtgtgaagcctttgagacctttttctctgcacacccatatatgtgttttttctatgtttttatagtattgtttcatttaaaaaataaactaggtttttgaacttgagaaatttcaactcgttctgctcagagctttgttttattaaaatcagtgcctgggagttgctcaagtctttgggctgtgtcgccctctagtggtagccctttggcttacagctgccattcagccctagggctggggtggaagtgatggttttgtgcccacaacctgatggcagggttggcagtgtttagttgctgacaagtgtctaaaactcaatctaggccgggtgctgtggctcacgcctgtaatcccagcactttgggaggccaaggcgggtggatcacctgaggtcaggagttcgagaccagtctggccaacacggtgaaaccccgtctctactaaaaatacaaaaattagccgggtgtggtggcgggcgcctgtaattccagctactcaggaggctgaggcaggagaatagcttgaacccaggaggaggttccagtgagccgaaattgcgccattgcactccagcctgggcaacaagagcaaaattctgtctaaaataaaataaaataaaataaaatataaaagtctagtgagccctggagtggtgtttgccttgctacctccaacttgccctttttaagagacttaaaatttgtggtaacttttcacatgatgtgtatttagatactgctgagttaatgaggctgctatacctggctgatttattgtttgctttcaaagcagttgtcaagtggtgtccacccatcccactgatggattttttttcttttttctttttcttttttttttgagacagagtcttgctctgttgcccagactggagtgcaatggcatgatctcggctcactgcagtgtctgcctcccaagttcaagcaattctcctgcctcagccccctgagtagggattacaggtgtgtgccaccacgcctggctcatttttgtatttttagcagagatggagtttcaccatgatggccaggctagtctcgaactcctgacctcaagtgatccacccacttcagccccccagagtgctgggattacaggtgtgagccactgcacctggccccactgactgtttatatctgttatactgttcttgcctctgtgccttttgggttccctgtcatggcagcatccttacatcctccaccacctctgaatgttcccgcaccttctctttctaatggaagcctggctggcccttgaagacaccgccaaccctgctggtctcttcacagagtatccacccagcaacctggcctgtccattcttgacttcttctggtccagctgcctttctgtacctcattttagtgaccctttttagatctcgtccaggttagcctctagaaccctgatctcaggcaccccactctgcgatcttccgttcccagccttcccacttgaaatcgtcttggaaatcccgggctttgccaatctgtggacccaccaccttttcaccccctttccggtgccctcaggggactttgctgtagcctgaacctcatggtcccttcctgtaaacagccaaactgctttgtactccctgaggagacccccgccccggttggacaccccaccctggttaaacccactttcacaattattccaaaactgccaactggacttgcatctcttcagatcggctgtcatcactcattgtatcaggaatcttattacacttttgcagcagtttcatcggttcagagaaaactctttcataccttctgctcatcagttctccacacctcccatcattctcctagctgatgactttgctgcttgtctcattgaggaaagaagccgttcagtcagtgagaccccctgtctcgcctccacctttccacctgctgccgcggaggcttccccagctcctgtctcactcaggccccttgccactctcaaggcatcttcttcctgcttcccaaggatgtcactcctgcagttaaccctttttcctcctgcattattcgtttcttcctttcttccgcatccttccaaatagcgtaaaaacaggccttatgacgtttctctttaaaaatgtccttaccagtgccacgtccctcttggccactgcccctgttgtgcctcactccgtagaaagaagtgacctgtagagactatatcctgccctctccagcgcctgccttccgattgccccttccagtctagtaactgtgtccattccttctccaatgaccgggtgacaagctgtcccttctgagagtgccagagggtgttccccgggtgggaggccggatgtcagtgccagctgtgctgtcctgggtgagcctgtgagggaccacatctggtcagactcgtgcatggcctgccctcatcttcctccgcctgcggtgcctttgagagcattgactccactaagcccgatttctgtgtggcatgttgtctgttcctccccggcctcctcgatggctcctccttggtctccctctggctactcctctgcttctccgcctccaagtgctgctccaagtgccttctgtgctctgtctccatccatcccaaaccttccaacactctctgtaagtggaatctcaccttgaggctgccagcccagcctcctcacctctgtgctccatctttagagagtcacctctctgtctggcattcccacttgaggaccaagatgattctcaaccttaacgtggcccacatggagccgctgctcttcctgcccagatctgccttcaccaccacatcctgcccactgtcactaaacggcaccagctcttacctggtttctcagtaaaaaaacaagtttatcatcttccctcacatactttattcaataataatcactaacatttattgagtgcttcctatgtgcctgacaccattctaagcatttgaagaagagtgtattaacctgcatgaggaaggctattaaaacctatgtaattaattaattaatggatggatgtgtggatgaatgaatggcagggtcttacactgtcacccaagctggagtgcagtggtccaatcatagctcactgcagcgtcagactcctgggttcaggcagtcctcccacctcacccttttgagtagctgggactacaggtgcttgccaccagctaatttattaaaaaacattttgagagatggggtttcatgatgttgccaaagctggtctcgaactcatggcctcaagcgatcctcccactttgacttatagattgtggggattagaggtgtgaggcatcgcgcctggcctgtaataacctatttgtgaatgagaaaggtcaggcacagagaagttaaataatttgctcacagaaatttcctgtgttgcagctgagatttaaatccaagcaatgtgtttctaagcctgggctcttaactgtaacactgtcctcttccccccaccaggagggtgtgtgtgtgtgtgtgtgtgtgtgtgtgtttctgaatctgaccagttgaggcaggctttcatgtcattctctctggccacccccttctttgttcacctccagtctttggaatagtcagagcgatgtgttcatggtagaaatgaaatcacatcaggtcctcagtggcccatcacatttagaactaaagctcactcttgcctcatgcctctgagcccttatatgatctcgagtcaccaccccactgccagcctctccactctcttctctgtgcctcatgcagcccaggaaatataatttggaccgcaaatgccagccacctatgtacggtaacttttctagtagtcacattaaaaagaaaacaggtgaaatgaattttaatgcattttagttaactcatgatatcaaaaatatttcaacatgtaatcagtattcacacaaagattaatcaagtatttaacagtcttttcttttgatccggggtcttggaagtttgacctaccacctctcaatttagccagccacatctccagtacttggcagctgtttgtggctacctcatggacagggcaggtcccgccacccgggcatccgtctgcctggcgcacgcaccaaacgggttccagtctggggaagttggcatctgctgttgttacttttggtcagaacgcccttcgcctgcatcctcacggggctgactccctttagccttgaaggggaccgttgctccgagaggcctgaacactccagctgcagctttctccccagtcattattgagatcaaattcacatctcttacaattcacccatttaatgggtgatgcaatgcggtggcttttagtatattcacacacatgtgcagacatcaccatagccaattttagaaaattttcatcagctgaaagagaaaccttgtatcctttagctatgactttgtgattccctgttcccctgagcccctggagaaccctatctttctgtctctgtaggtgtgctgattctgaatattttgcataaacggaatcatactagggggtcttttgcttgggacccctttcacgtggcgtgtttccacggcccatcccgtgtgatagcatgcatcagtacttcattcctttttatggcagataatagcccattgtatggatataccacctgtttttttaaaaagtccattcatcaattcatgagcatttggtttgtttctactttttggtagaatgatgctgccatgaacacttgtgtgcaggtttttgtgtggacatagacttaggaatggaataaccatggagttacggtaactctacatttaagcatttgagaagctgctggcctgtttttcatctgcaccatttgcattcccaccagcatcaagtgggagctccagtctctccatatcctccccagcagtcggttacccttttctgttgcctctgtagcactttctaaacataaaattagcttatttctttgcaggtgtctattgcaccccccaggaatgtcagttccctgcagactctcactctgccttggcacccgcaccccagcacccaggggtgaggtgcctgcctgggcagccctgtcctcacctggggttgactgaccagagaacccttgcgattctctctctgggtttctgtctgcattcctgtcgggataggtgagactggggtgacggctgctcgcggcttggtcaccttcttctctgcttacctgttcatgctctcttgcttttctctgatagcaaaccccgtctcctgtcatcctccctcctggcggaccagagctatactggcccataaaggagtgctggccacaccaggctagattccagttgagcttaaataaaacaaatagaaaggtcctccgtggtattagccatattgtaggtgctccgtagacacatgcggctagtggctgcccacaggacgctgcagatgtggacgtccccgtcatcacaggacgacattctgtgggcagcgctgtatttgtttacaaacacaattctttggctgtgtgaaggttcaggatgatacctttgccattatgattcatttattcatttcaggctggacacggtggcccacacctgtaatctccacactgggaggccgaggcgggaagatcgcttgaggccaggagtttgggaccagcctgggcaacatggcgaaacctcacctttatttaaaaaaaaaaaaatcggccgggtgcggtggctcacacctgtgatcccagcactttgggaggccgaggcaggcggatcacgaggtcaggagattgagaccatcctggcctaacacagtgaaaccccatctctactaaaaaataccaaaaattagctgggcgtggtggcaggtgcttgtagtcccagctactcaggaggctgaggcaggagaatggtgtgaacacgggaggcggagtttgcagtgagcggacatagtgccactgcactccagcctgggccacagagtgagactccgtctcaaaaaaaaaaaaaaaaaaagaatcaacatttatttatttattatttatttttttgagacagagtcctgctttgtcaccgaggctggcacgatcttggctcactgcaaaccccacctcccagttcaagtgattcttgtgcctcagcccagtgccaccatgcccggctaatttttttgttttgttttgttttgttttgctttgctttcctttgttttgttttgtttgagacagggtctcactctgtcgcccaggctggagtgcgatggcacgatctcggctcactgcaacctccacctcctgggttctagtgattctcctgcctcagcctcccaagtggctgggactacaggctcccgccactgcacccggctcatttttgtatttttagtagagatggggtttcaccacattggccaggctggtctctaactcctggcctcaggtgatccacccgcctcggcctcccagcgtgctcatttatttattttagcatcccttcttgtgcctggttgtaaagttcttcttatcccaggaaacttaataggtcaaagaaccctccccttgaggcagtttggatggggctggctgggaattggtatgtccagctgcccatatcgtggcctctgagtcaattatacaggcatctcggcaacttgaagttttgagtcccaaaacaacagattccatagcataaacagtgcaacgtaaatcctgtcccttgtccctcttccattggatacccttgtttatgttctctctggcaactgcctgtagcagggacggatgctggaaatcctggcggggccacgtcttctgtgctttgtaggcagctatggctggatggtgcttgctgtttctgtgtgtaaatgttgggatttttaaaagcccttccccgcttaatgcgttgtggttgagcagcacatttaaatgcctgaagtgtaagatgaagtctcttggatgtagagggcagtggtggtttttatttttcctggttgaacttggcctttggattgctgactgcgagctcacggtactgttaatgattttctacctacagtcacctgctgtgctgagcacatcaaatacagtgcggttagttccaagctatgaagcgcctgtcacgcatgtataacaggcagacctcattaggagggggccttgcataggggtcacattttccagcatttgttttcaaaatggaaatccagatcacgcatttgagattaaaataaaaaaagcggcctgtgctttatcattttctttaacttacatgcctgctggtccagcccagattgctgatagaggaagccctgagaaagttgcccagccagttgcccgtgcttcaagacacaaagggctgactgaggcatccgtgcctacccttggctgctgctgctcagcctgcttgcatctcgtctgttttcagttatcagtggtgtgagaaaaacacaacggtggattcagaaggagaaaccaagtcatctgcatttggcctcagtgtgtggactgtcctgaaatttgagtacagatgtgttcatgtcctgggattagataaaaagagaggaaacacacagtgaattcttatggtctgtcatttcagttggccatcttctgcccctctgttctggaagcttctccactaaaatagagcacccaacttggttttctacttgctttctggcccatcttgagttggaggaatcatgtgtttcagaactcttgctggtggtgggtgggagatcaacaaatgatttcattaagctgtgtgttcttaataaactttgggaagatttgtcgcagagaaactcagatagggaccttgtgatctcagcagtcatgggtttatcttgtccacacgcgtggcttcattgggatttggttggttgcgatccagcagaactgtggcggtgttgggctctgttggggtttggttgtgagcggaactgtggtgttgggctctgttggggtttggttgactgtgatctagtggaactgtggtggtgttgggctctgttggggtttggttgactgtgatctagtggaactgtggctgtgttgggctctggagtttggttgtgatctagtggaactgtggcggtgttgggctctgttggggtttggttgactgtgatctagtggaactgtggcggtgttgggctctgttggggtttggttgactgtgatctagttgaactgtggctatgttgggctctgttggaatatggctgtgatctagtggaactgtggcggtgttgggctctgttggggtttggttgactgtgatctagcggaactgtggctgtgttgggctctgttggaatttggctgtgatctagcggaactgtggcggtgttgggctctgttggggtttggttgactgtgatctagtggaactgtggctgtgttgggctctggagtttggttgtgatctagtggaactgtggcagtgttgggctctgttggggtttggttgtgagtggaactgtggtgtcgggctctgttggggtttggttgactgtgatctagcggaactgtggctgtgttgggctctgttggggtttggttgactgtgatctagcggaactgtggctgtgttgggctctgttggggtttggttgtgatctagcggaactgtggcggtgttgggctctgttggggtttggttgtgatctagcggaactgtggcggtgttgggctctgttggggtttggttgtgatctagcggaactgtggcggtgttgggctctgttggggtttggttgactgtgatctagcagaactgtggcggtgttgggctctgttggggtttggttgactgtgatctagcagaacagtggcggtgttgggctctgttggggtttggctgtgatctagtggaactgtggcagtgttgggctctggatttggttggttgtgatctagcggaactgtggcagtgttgggctctggatttggttggttgtgatctagcagaactgtggtagtgttggcctttgttgggatttggttggttgtgatctagtggaactgtggtggtgttgggctctgttggggtttggttgtgatctagcggaactgtggtggtgttgggctctgttggggtttggttgtgatctagcagaactgtggtggtgttgggctctgttggggtttggttgactgtgatctagcagaacagtggcggtgttgggctctgttggggtttggctgtgatctagtggaactgtggcagtgttgggctctggatttggttggttgtgatctagcggaactgtggcagtgttgggctctggatttggttggttgtgatctagcggaactgtggtagtgttggcctttgttgggatttggttggttgtgatctagcggaactgtggtggtgttgggctctgttggggtttggttgtgatctagtggaactgtggcggtgttgggctctgtgggtttggttgtgatctagcagaacagtggcggttttgggctctgttgggatttgcctctgatctagcagaactgtggtggtgttgggctctgttggggtttggttgtgatctagcggaactgtggtggtgttgggctctcttggggtttggttgtgatctagcagaactgtggtggtgttgggctctgttggggtttggctgtgatctagtggaactgtggtggtgttgggctctgttggggtttggttgtgatctagcagaactgtggcggttttgggctctgttggatttggttggttgtgatctagtggaactgtggcagtgttggcctttgttggaatttggttggttgtgatctagctgaactgtgatggtgttgagctctgttggggtttggttgtgatctagtggaactgtggcagtgttgggctctgttggggtttggttgtgatctagttgaactgtggtggtggatcccaggagctgctgctgcttgtgcgcttcaaagttggattttgtgtttttttgtgtgcagatgcttcttggaatcttgcgttgctgtatgcctgtatacctggaaagttgtgggaagaacagtttaggattttgaaccaattttctcaacaagtttgattatttcatttgagacatgttctgatgtaaatatattctgaaaaggtgagatcaaacatccactttttactctaaagcaggtccccttgctcctctctgctagtgcattctctttcctttacagctccttctcctttctgaagcaggaattaagctgaagtaactcagaaagtgccagcgttaaccccaggggacagaaaccacagacccagggctgagggattgagtttttaatttccattattctccatcagtgcgttcagtcttttgaacttaccctgactggtattatcacttgaaagttgttgttattgttgttttgatggtagtggtggtggttttttgccacccacaggagagaggggattagaagaaaaagaccaatggagtttccttgggattaattaaatgtggggctgccacacaggaatgggtccaagggctgctgtatttaaataacttacttattttgcagaggtgaatttaacctaacatgtactacagtgatggagtaaaccttttcctgtttggaatatcacaaaaggtacttcaataattgcggatcttcctttgaaccctcctattgtcagatggggtagtggtacagttccttgttccagaatgctcttagcaagttgattaatctgtcacataccccagtttcctcattcacaaggtggcataataataggacatagagttgccgtgaagtttaatgagttaatgaatgtatgatgcttggcaaatggtaggggctcaagccaaccctcgttgtcttactgagcttagtgggccttggacctgctgaggactttgaactgagcattccgtgttattctcttttttgtttttttaaggggatgagagtgtgtgtgatagagttcatgacaatattttgtttaagaaaattgtcaaaacaaagttcaaatgcaatggatggaaagtgatttttaacatgtagggtaactagagatttgagatcagacaaatcgattaggagatcaccaaacccaaacagagaatgtgagttaactcatacttaggagatgaatgctggctttgaagaccatagcgtgcattttcaaaccagatggagaggccacttttctctgcagatttcagttattcgtgatgttaaatgactcgtcttctcttacttgcctggcatgtggaactgagtaaattctgtcaaaagaactcactgaaggaatgtgtaacagctgggaattggatgtcttttcagatttgggagagcctgtgttttgactgtgatggaattcttatggtttaatatgcttaaatattactgtttaacattttgacgtttttgaggacagggataattaggagaatgcacttataagtttctatgccaactgtttccactgctcccctgtttacatggtcccagggtttatacagggctctctgtagccccacaatgaatcttgccccagtgagcgggctctcacctcccttctatagatgaggttggagctcagaagaacgtagagaaacttgtgcatagttattatgccagatttagcagctggaacaggactggaacctaaatcttttttctttagataatatgttctttgcattaatgagtttgtgggttttttgggaggcgagaaatatgtgtaaataagaagtaaaaatcctaaattgcaagttgattttttttcttaatatagtaatacgtataatgcagcaaacatatcatttcccctccatgcttgctagactggcttatgcacacatcatgatgataatgaaggagctaacatagcaagcactcactctgtgctcattcataaggtggcataataataggacacagagttgccatgaagtttagtgagttaatgaatgtatggggcttggcaaatggtagatgctcaagccagtcctagttgcctttctgagcttaggaatcatggaatcatgctctaaaaacttcatgagtatgagctcgcttcatcctcataacaactctaggagatagacgttactttatgtccattgtagggatgagagtgtgaggtatgaaaggaagtgagcttaatattctttatttttattttttatttttattttttgagatggagtcttgttcactggcccaggctggagtgcagaggcatgatcctggctcaccgcaacctccatctcctgggtttaagtgattctcctgcctcagcctcttgagtagctgggactacaggcgcgtgccacaatgcccagctattttttgtatttttagtagagacggggtttcaccatgttggccaggctggtctcaaactcctggcctcaggtgatccatccgcctcgggctcccaaagtgctggcattacaggcatgagctaccgcacctggcctaatattcttaatttggctgtcggttgtcacccaaatcagttaaagcaattccatttcttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcaattccatttcttaagtgaaaatcagaatttcttttcttttttccccttctattttttcttttaatcttttttcttttgtcttcaagcaattttcatttttttttttttttttgatattcagggaacctgaggcgaatgaaggggaggaacctgggagctactgactgtgattacagtggatattcacaaaggaagacctttagtacagtgtgaagtagtgagggaaagggtgatggagtaggagggatttaagtaaaacctttcaggtttaaggtcaatggaaagcgaaggaacattctagaaggacattagattttccttagagtgacattagagtttctataattggactataccctttagtgcctcaaatcaagggtttcacattttctttttttttttggaattgcctgctcatgtatttccatctccttaaaggcaagggctggccgccttatttggctgatactagcctccatggcatcagcctgtccagtggaagtcctgaaacagtacacgatgaatggataaatgaatgaatgaatgaatgaaatgaatgagggaagaaatgaatattgtgcttccagaacgaggagagaagggacgatgatgtggcaaattggcccagcatcttaagatctgtattgactttagcctcatgtggtagtttaatgatactctctcttactcagggaatgtgccttttaagctgtggtctgtggtcaatgtgtgtgcacatctctgagagtcccggctgtgttgtgtttgtgatggctcccatatgtggtttgcctttgtatctgattgtaaattaaccttgacatgtaggtcacctgaccgtgtatggagagagaaaaatcactttcttcttctctacaagctatgtgagtgcagactgaagttccgagttgtgatctcaagcagtctgcagaaactaacctttggcatacttggccacagccgacttctttctagtaaattcccactggttcttggcttttcttgtagaattaacacatttgcaaagttttcttcattggtattcctggtacgtggactggaatattcttcatcccttgatttgtgggatcgttttgtctttgggccacacttgtcatgggaggaaagtcacagctagactgggtatggaaagaatggaagtgtgtctcctgcagggagagcccaggttattgagacagtcttggcccgtgtttcttgaagaagacgttgggttttgttttgctcattgatggccataccccttgtgtggttggccaggaagctgaacgcttgctcccccttgtggctaaatacaggtggttctgctggcaaacccagtggtcaattactgcatctactaaggattaagaagattataaatgtaaactcagcttgaaactttttgtggcttagaggtaaagcaagaaaataattaagataacaactcacatgctgagggtgtttcatgtgttattattgtggatgttaataacaattttggctctctgtgggaagccatttccttcacttaatcagttggcaaagaaagtacatcagggaagattgttcaccctgagccgagaaagtggagtttcaagtaagaaccctgctccgcatcctgccactgagttgagatcatctatttgatttagctactgataaagtgtttttaattacaaattgtctgcttgcttggggactgacacaaacacttgttttgttttcaaagtgccttctctccccagtgttgggtttggagtagagcaagagtaacacagaggttgcagtcagtgtcttccagcgattttcattttgtttgatatgcggggaacctgatgctgatgaaagggaggaacccaggagctactgactgtgactacagtggatattcacaaaagaaggacctcagtacagttccaagtagtgagaggttgatggattaggacagatttaagtaaaacttaacaggtttaaggtcaaagaaaagtgaagcaacattccagaaggacccagaaaagccgagcaagtcaggcactgagatcttgggattgagaggagttgctggttcagacccagcactgttctggaactttcttttgggtactctttttttgtttcatcgattcctttaaaaggtacaatccagaactgaacatgtcattccacaagtggcccaaccagtgttgtatacactgactggacaggttttgccactaaaatggaataatagtctggttttcctaattccaggaaaggaaaatcaaggaatagatacattttttaaaaaagcatttaaagaatttctcctgtagacattatcttaaacttttggtccctgccattgtatgtgtatcttgaatccaagggtaatacgatacgcagtctggcaaaagcagtcattttaaatgattgagcaatatttagtgactttcaaagagcagagagcacaacttggctaccatagaagctccaccatgatgggcgcagggtttcctctaggctggaagttgtgttctggttatcttgtgagagaaatgcatcctgtgtgatttatgtggattcatttattcttagaggaaatcagacaaaaaccatattgtaaggcccaacccatctaaaaagacaatagaaatgagttctgtgtgtttttcagcagggcctcatgggcaccactcgtaagtccagaatctcttccaagaacaggaagtttctggagggcagtggagaaggggagtgagggctcagctctgtgaggtcgaggtgggtgtgaggaccagcaccagtggggagtgggtttattagctgggaaaggccataaggatgaggaagagaagcttgtgtttgagaggataacagggaggaaaagtcgccgagcccagagtgtgtattcactgcctgtcctttggaggcagccgcttccacctcttttgactgattcttccaactcgtatcctccagtctccaaaacatgattgtggtgcagctgcttgaattttcaaacttgatttccattttagaagttaaggatttgtttttttttccaaccacataccctgtcgctaccacatcaaatacaggtctctcatactgttggtcagctccgttttccgtgttgacctctgatactctgtaaacactcttgacacgtaagctgggtggtttatataccaccattacttttcctgcccagctttgtctttttcttccttgtattttatttgtaaagattccccagctcgtccccagttgtgtcagcctcttttcagtgtgctcagacccattaggtataaggcctatccatgttcctgaggaagtctggcccagagccgtccaggtggtctgacctgggcagggccccgggtctgccatcacccagcccatgctctcctgccgccccactgaagacttccttcacctctcttggacgttagggtttctctttgatggctcctctctttttctgggtttctgatattttctggttgagtggtgctactttcttctaacctatttttatttcattaaataaataggattcactaaatggatttcatacccatgggttgtatgatttgcactttgaaaggcactgggctagatgaccactttgagtgatgctgaggcattgctgggtgacttccttctttccttcttccctcccctcctcctcttccctcccctcctcctcttccctcccctcctcctctttcctcccctcctcctctttcctcatgaagcatgtgcacaggtgcatccctgatgctttgatcaggtatggcctgaaagacaagccattttagttagtttttggatacattacgaagtaatgtgggaagtaagcatcttcacctgtccctcttccctccttggctgagggacagtgtcctagtcagttccatgtgctgtgacagagtaccataggctgggtggcttaaacaaaaaacacttaatgctcacagttttggaggctgggaagtccatgatcaaagtactggcatatctggtctggtggggacctgcttcctggtctgcagatggccgtcaccttgttatatccttacatgatgagagagagagaaagcaagctctgttgtgccttttataagagtactaatttcattcacaagggcgccatcctcatgacctgatcacctcgtaaaggctccaccttccaataccgccatcttggggattaggatttcaacacatgaattttagggggacgcaaacattcagtccctgacagggttaggcactgtgtggctggcaatcaccaggatgcctggagccctgccgggaccacgctggctcatttcagccaccctggatgaatcatccagcctaaggcccatgcctggacattctgggtcctcagtgccttgcctttattttacctgatataatccttcaaacgaaaatgcttgtacttatttttgatcacttaatatacttggccatttaacaatacagattaaacttgtgttattctgttagaaaactgagagattgttttctgtagtctttgactgcatgcatagtctagggctggacttgggaggagaggataatttggccacaataggattccttattatctgtctcttccctcccaacccctcccccgacccccgccccatacaggagaccctcagatacatttctgtcagtaccctcagttacatattttgggagacgtaatacttaatgaaccaaaactctgttttgctggcagggaaaaaaattgggctgatacaatcaagataatcctatcaactttaggattattaggaatgttgataatcctatcaacattctatcaactctgtaatcagaaaaatatatttaaaataatgcgtgtttgttaaaaataaccaaacaaaatacagaaaaaagcaaagtaaaaattgacaatcccctaactccagtgttggtagttagggacagaagaagggtggaggatgtcttttgtctgtgttacatgattacagcaaaagtcactcttcattctggtagagccatagaaatctggccgagcagaggcagctgtgcctgaggagcctgacttcgaatcagctgtgttcatctttgctaacctcccaaagggaggaagctcaggaaaccaccgtagaaccccctaaaaggggagggtggctacagctgagcaggtgggggcaggcaggagtggagagaggcgaggatgatgagtcaggcaggtgagatggaggctttgtaggttatgttaaggctcctagacttagcatttcaagcagggatgtgacctgatcagatttatattttgcttgcattgctgatggacattggttcagtgctcattgtactggaagggtcaagaatagaggcagggacccaaatttagggggcttcccagggaatccaggggagaggtgttgtggcctggactagatttggaacatccagaaggggactggagcaatgacatacctatacctagtcccagagggccccgatctagctaaggacagagcgtgcagtcttgcagctgctgggctgatgacatgctggggagtgtatacctgggaaattctggtacagagataaaggaaatgctcaagcctccacctatgaatttgcccggtgattaaaatcatacttcctaagctttatagaagccctctgtttgtcccacaaagggccactagcacaaggaaatacataatgtgttcccttgtcattttataaaaatgtagactggtgctgcctgctgtgaaaatgccagtcaggttgcttccttcatagtaatcagtggattcttttgtccatttctgagtggaggattagccctctgtttgccccacaaagggccaccagcacgaggaaatacatagtgtgtccccttgtcattttataaaaatgtagactggtgctgcctgctgtgaaaatgccaatcaggttgcttcctttatagtaatgagtggattcttttgtccatttctgagtggaggattcctttccataacgtggtgtatttgcagtgtttctctcagaggaggagtgcctttctggtgtcatctgtcctgttggtggcagagttctgctgctgaattaaacctttgtgtcggccttggccactcttatggctctgctggaggtaaagccagtggagtggccttgtggcatttgctccgagttgttgctcatttttctgagattatcagaggccttagagggaagcattgaggatttcattatgctccgataactatcacgttgtcaataatatggttctgataagagtgatgggggatggtggggttttgtgagttgacagacgtgggtttgagacccagctctccagtcagaagccagcgccaggcctgtttctcttctctgagttttagtgtcctcaggtggaggggaggataatattaataacaccttcctgatgtggctccactgggctggccacgccatgggcacccagcacggggtggctgccctggttcgtgttaaccatcagcagggttggagagctccctccttactggtgttggaggtcattacctggcgggggatgtggtagataaagcaccttttattgtccctacacaaggcaactatggggtaacacaatataagttattcagattagagaaaatatgaactcttgctacagtgttactgcagacaggcacatatggtttgttaggatgacatttaaaaaaagtcattttgagttacagaataaaatcaaacaaaattcctttaatcaccagggctgggatggaaataaggcaaaatgttgattcctttgaaagacaatttttgggttttttttgttttttttaaaaaaactttatgtgttgatggtttactctggtctagtcgttcctactcctattctgaaagcaggccttgaattcctgattgtgtacaggattgtgtacaaacaatcaggaattcatcattcatatgaagaagttctgtttttccctctagtgtcatgaatattttcatgtacgtatatgttatgtgactagtgttaagaatgcatgtattatatatgtgcatgcgtctcatttacattgaatgtagctaaaaggaatatttgaaaagtataccttgcctgtctccaatttctacatttcaagttaaaaatgggaaataatcttagaatccatgcctgtggttcataagcctggctcagctcttgcattcccagctactgtctgacgaaactcacaggagctgtgaaaacaacgctgttttgtgaaagccaagtaggagcttagggtcatggcaaacttcagagaaatgtaaaggagcaggcactgtgggttttgtctaccccacccccccgaccccactgccttccaaaatttctttcttttttttttttttttttttttttgagacagagtctcgctctgtcacccaggctggagtgcagtggcgtgatctggggtcactgcaagctccacctcctgggttcacgccattctcctgcctcagcctcccgagtagctgggactacaggcacccgccaccacgcccggctaattttttttttattttttgtagagacgggatttcactgtgttagcccgtacggtctcgatcttttgacatcgtgatccacctgcctcgacctcccaaagtgctgggattacaggcgtgaaccacaccgcgcccagccccaaaatttctaattgaattttaaccttccacttttaagttctgatcctgatttataaaaacctatgtaattttcttcagctttcagaaggaatgtcttgtatcttcctatgggggtgttgggggaactgatattgacagaggtcctctgacatttcatagcctggcaaatagggtcaaacatgttccagacctcagaggattgctgaggatagctttctacttaagctagataaaagaagttttgggaatcttaccttgcactctgttttgtagaaacaactgtgtttaatatatttctcattactggctgaatgacctgtatgtgttcaggagatctctctatttaccattttaatgccacatatttaatgagcattcaggcccagactgtgaagactctggaaatgagaattttgtttcctatctcctgtgctgtaacaaaagcagcttaaaaattgcagtgtatagacctcaccttttatcatttttttttcagatttttaaatattaatattaagggtctttatctcagatgtttgttgtttaccaggtcatcagtatctggacgctggcagggtccttagcaatggagggagggagagggggtccagcctgcatgattggatcagtgttgaacctgtcccacctgtggggaagaggcagcatgcggagcagacaggtgcctgctgcaggtcaggagagctggccccaagtcctgacttggagggaaatggtacatattaatatcctttagtgccaggtactggcgtagctagtttatatgcatcacttgagcccccttgcatcactggcatcacttcaagatagacaacaaggggaatgcacatcatatccctgttcactggcgttcactggtagggaaactgaggcttaataatgtgcccaggtacacacagctgataagtaaccctgcaccctcgatctcacagcatgacattggaatccacctcattagacagagctcagctgcctattctgtcaaaaatgttgagttgtatcagctgcagtgtctgtagtattcctagacatttctgtgattctcataagtatctttgaaagggggccatttagtttatttctgcatttctcccttatctgccgaaatgcccgcaggctctgggacaagctataaagctctccgtgttatgctgtgttgcaaacccagtgccagtaatgatgcagtgctatttaaagataagaaagcaagctcacagagggagagcgcagcaggatgtttatgttccagaagcataaacacatgacctgtgcccgtcccgtgttcttcgtccatgtccccagagaggccgtggatgggatggtgcaagaaacccatcaggaagcagaattaatccttcctgcgggtggtccctgtgaagaagacacagcggccggtggtgtgacagcccacagctgtcgaaggaagggagaagagagggaccgagggccagcaatagggttttacagctacgtgctaggttgtctcacatctaggaaagagaatgttcatattatatagaaatgggcattttccctgtggcctgatatgaggtatccagaatattcctttaggtattattaagtcataggtttctgttttgatagaaacagcaggtggttcagttagtatttttgttgttgtaatagtagcttagatctcttgtttttgttttctttggccaagacagaaaacattctgccacacacattacttcatgactctggttatatattgagagcagcattaaaaaaaaaaaaaagtccaatttagtccattaggccattcttgcattggtataaagaaacacctgagactaggtaatttataaagaaaagaagtttaattggttcttggctctgcacgctgtactggatgatacaggatgcatgatgctgacatctgctcggctactggggaggcctcaggaagcttctaatcatggtggaagatgaagggggagcaggcatctcacgtggccagagcaggagcaaggggttgggtcacacacttttaaacaaccagatctcatgagaactcaccattgccagaacagcaccaagccatgagggatccacccccatgacccaaacacttcccaccaagccccacctccaacaccggggattattgtcaacatgagatttcggggacaaacatccacactatgtcgtagccttaaggggatcttacctctttgaagcattgtagagttcagagagtaggacattttgtctactgtattttaaaatactaaatgttctgattatgaaagtcagtcctggaaaaaaaaaacaaacaaacctgaaaccatagatgaagataaggaacaaaataaaaattacccacagtctccctcgcgtgtaccgcacagttcatgttttagtgtgtctacacaccatttaatgcaggtggacagactcaggggcaggtgtgccttgctactgctatgtccacagcacctggcagagtccctggtacagcataactgctcagcagttgggtgctgagtaaatattaatacatgtgcatgtggtaccagtcagggcccaacagagggacctcatgcgaggagttgctccacaggtgtggaggatgaaagaacaagttggggcgaccctgagagagcccagagacaagctctgcaggaagcaggcaccaccactgggccaggtgacctgagcccaggagccaagaggatgccctccactgctgatactacctctgcagtgggacgacatcggaccccactgccgatgctgggacggtgcttcccctccccctgaggctctcctaccagggccccctctcatcaggccccagctggaagccaactggaaagggagtcggggaagtttcatttgtgggggtccaagtgccaagggacagacaagggaagggtggatttgcagctaagaagatagtaaataaccagactacgtgacagtctgaagaatcaaatctggaatcaaattctactctgctctaatgtaaccctgtattttactgtgaataatataccgtgggtatcttccttgcttgatagatacagctccacataatttttctcaatgaaacagattctggagtaggcaacgttttcctcttttgtaaaatacaccaaattgtgaggattgaatgagataatgtcaaagtattagtactttaccctagctgattgacagtatccagtgatagtgataataagggtaattactactctagccaattttatcaaacctatggatgtttaaggaattgggttttttttttttctcctttgatgaatactcctgtaaatacatcgttgcctgcttgtctgagtctttctgtgggtttttagaagtggattacttgcagcaaagtctcctctacttaaggctctttgtatattttgcctaattgtgctctagaaatacatcaatttccagtcctccttctctcagaccacctgtccctcacattttcaccagttctgggtcttgttattctttttactctttgtcagtcaggtgattgaaaaatgtacatttttttaaaattggcatttattagtgagcttgaggatgtttttcacagtcatatggaaacagttctgcttcatgaacaagaccttggggccacatactggcttgttcacctggatgcattttctcagtctccctcagaatcatttttctccctgaaaaatgggattaaaagtattaatagtagtgcccatctcacagagtcattgcgaggattaaagagaggatgcatagacgtattgaatcagtgctgggttctggtagatgttcagctagccctagagattattagccatttgatgtgctgatcctcaggaaggtgggcgggagagacctagacgcagaaaaggagctctggagttgaggtttctagagatgaggtggtgcgtggtggcccagtccagcatggctctgggtgtgagcacaacataggcagatgtgtctggggctcagggagtcatttgtggattgagggtgctatgtgggtgtggaccacggtgatccaggatgatgcaggatttgggccggggaggaagatggcaacccaggttccatgccatctttaaagaggggatggttactagggtgtccagcgaccagccaagtggcctatagataataaggaggactcttcatgacatggaggctgaggtggaaagtcccagagtagggttcagccctggccctaaaaagtgccggagaacctgtagcctcctggaagctgtgctgtgtgcagagccaagcttcagtgtgacaaggaatggtgggagcaatttggagaagaatgaagacttggtgcagtggctagggaggcaggcagggtgaggatgtggaagggtgcagagctgctcaaggtcagcttcctgagcctgcggtgtggtcccttgctccacactcagaagggccctgtgtttgatttaatgctcttttcttgccatcttgaaattcttgatagtttttgaacaagggatccatgttttcattttgcgctgggcctggaaattacgttgctggtgctgaggggatgtgcagagcagaggtgggcagagaactgacgagaaggacacgtgggtaagggtgggatgagctggcctcaggactccgagcagagctcatgtaaaggtgtcgggcccaggatgcgttctcaggctggggtgggaggcctgatgatggcagatttctctggattacaaatagaatatgtagcagggtggttcatagctttgtgtgtctgtgtgtgcattggtaaatttttattttgaaactaaaattatttcaaaattagagaaaggctgtgagagtgcggttgagctggtgttggctctggaacagggtttcccaatgcaggcggcactggtaactatgtgccttgggtcattctttgttgtgggggctgtcctgtgccccatgggatgttccctgcacccctggcctctgccttctagatgctggggggcactttccctggtgtaatattaaaaaaaactctccacgttgccacatttggggggcagaatcaccccctccccgaattgagaagctatgttattggaacacagtgtcctgtattttgtctagcctctgctgcttagagctgcctgagcttggagaagatacttgttctctttccaaagcttcactgtccctttctgtacattgtcaggacggctgttaataccactgctctaaatgtgctcagttttgcataaacatcagctaatgttaaaattttaatctctgctaatataagaggcatcgaagtacacgcgagttcagtttgcatatggtgaggagggagacggcctcatatcgtatgtgtgtatttgccgattctatattttgaggttgattcctgttgtcttttgttcagttgtctcattctgttttcttttggggctttgaatgcccttttcatgcctgtgacctctctttactatgccttttcttctctgccagcaaatctcatccattcttccagggcaccttactgtcccccaaagccccagtgactgctctgtccacagggcttggtttctgtgctctggctctgcaatgcaatgcagaaggggctgggctcggaatggggttgctggtcaggccatgtgcccaggggaaggacacaggactcaaggagtccacccctctctcccccccttttttttttggtcactgaaatattttctttccaattctactagtcctgctagagctgccataacaaaatacccaattggtgacttcaacaacagaaattgattccacactgttcttttttttttttttctttttgagatggagtcttgctctgtctcccaggcaggaatgcagtggtgtgatcttggctcactgcaacctctgtttcccaggtttgagcagttctcctgcctcagcctcccgagtagctgggactacaggcacatgcactgtgtctggctactttttatattttttagtagagatggggtttcaccatgttggtcaggccggtctcgaactcctgacctcaagttatctgcctgcctcagcctcccaaagtgctgggattacagacgtgagccacttcgcctggccatgatcccgcacagttctgaaggccagaagccaagatcaggagaccagtggattgtttctcccgaggcctctgttcttggcttgcaggtggccccttgctgtgccctcacatggcctttgccctgcatacatccgaagccccagtgtctctctgtgtgtccaaatttcctcttcttagaaggatgccggtcatattggattagggcccacccgtgtgacctcattttaccttaataacctctttcaagtttctgtctccaaatacagtcacattccaggggctagagcctcaacatggaagttttggagggagacacacttctacccataacaccaatgtcatattaagctttatggaagaatagaccaatatgtggtgggttcaagaatcttttcttagaagaaaagtgaatctgtatatttgatactttatgatttccttatttgctctaagcagttggtaagaatctcagtgtcacttggctgaatgatacactactggtgcctccagacctatgaggagcctaatatttttgtcttggttgaaacaatgcaaatcctgggttttggagatgctcacagccagctgtctgattacgtaaactgaaagtggcagagaggaagcttttgcgtggggaaaacatgaaatatacaagggttcctttaaaacagagtgtacttctgaacatttactgaaggtggagggccctggacacctgatgttatcttatgtggcgttatctgggtcagatttcattgcatttcctgaagaggtaacttggcagtcctgggagaggctggaccttggtgtccaggtggcaggttcataagacacctgtgatttgatgtgagccagtcacagaggaagccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcggtaagactttgcttggtgggggaggaggttttaccttcctgtggcattctgaagctctccacatccacccatagtcatgattgtgttatatgacctcaagatgctggagctgttaattcatctttaacataattgacctgattacttctttcttgaaggattttgttcaaacctcagggtttatttaggaacaagtctaaccaggcctgattggttttcctaagtggagatacagctttgggaaacaaattaagaaaatgaatggattgaaaatgtaggaacaccgtgacagttgtgaatttttcttattgagggaaaaaatgggtatctgtgaatatttctcttacactatatagtgagaaatgacactctgctgtggatggtaatttatttctgtgtaattgcctgagtaaggctttctctgatattgaatactgagtagaactcttaggttatttttggaagaattatggattttctcttaggttttagaatattttttgtttgcctgttaagagaatttgatgaagatttcaatgtaattaaccaaataaaatggcattctgtatcctgggaagggacgatgtctttcagttctaaatcaatgcatcatttacctcctatctctcttgctggccgagccatcaatcctgtttttattaaatgttgttgttattgttttgagacggagtttcactcttgttgcctaggctggagtgcaatggcataatctcggcccactgcaacctccgcctcctgggttcaagcaattctcctgcctcagcctcctgagtagctgggactacaggcatgcgccaccacacctgactaattttagtagttacagggtttctccatgttggtcaggctggtctcgagctcccgacctcaggtgatccgcctgccttggcctcccaaagtgctgggattacaggcgtgagccactgcacccggccgttttttgataaattttaaacttctggtttgaaacttttgtttcctgtgcttaaaaggagacagttaaaagcactctgatttggactgacagaatgttttttagatgttagatagatctagctttgaatatttatttgcagagaagtagcagggaggactaggaatgactttttcttaggaggtgctatgcattccatcaggtgactgacccctttgtgagctgtagtggtcagtcccagcatggcccacacttgttggctgtcttagccatggtggctgtggttggcgggtacccagccaagggttttccatactgggggccttggtccagtgggggcgggtcgtaccatgacccccttctcctgtgatcttgcctcactggcccaggtaaattggtggacgtccttgactcctccacctccaaaaggactttgaactttggcactgttgggagtttaggctacacctcaaccaggcagagattgggatctaacctacttttaaaagccctctacagggaatttcataactttcctgagtgttaggttttggtgattaacagccttgactttttggagcccttcctttgccaaacatgcattcctcaggtgctcacttaaaatgattcttcacaatatgcctatagacgggtctgtctggtacagcatcctggagtggtgtcaagggaaagaaacatgctgcttctgccacagacggaccatgcatgggaagaaactatttgagaatggctctccaaggggctggtcggccttgtctgcccactccctctacctttctttgttctgtttctttctcttcagtgttggtccattttccttttttcactgttgcgtgttagcacatcattactcttatctccatatatttggatgtttcctgcattatggtgagcttcagtaggtcttggatgagttagttgttctcattccaaaatgtaaatttctggtgtttagtaggtgctcagtaaagcttgagaaagatgaaagtgagagcccagaactagtataaaaatacggataccaccatagcatggtaattaaaggggtgattgtgaagatgaggtagctgtgcctggatatgtgtgtgtgtgtgtgtgtgtgtgtgtgtgtgttggctggagaaggcttaccagtggtgctggacatgtcgggtagagtgttaatagtaacttaattgactgaatttggaaataatctatggggttagagagcaaggaggtagctgtgtaagaggatggggtcggtgaggtggggtggtgtgagcaatggagctcaagggctcaaggtgcaggcctggactgatggccactaggaccaccccaatggcttcagggtcaggacaggaagggaatgtgattattgcagcaggtagtagggcagtatgagtgtattattcatatatgtgtgatgaaatggagcatcaaataatatatcccataggatagaaaggcacagtgagtgagtttgggttaaaaattcgatgagataaagtggttgtacctcctatgaaaacaatttaatttcttattatgaaggcattactcatgttcttcagaaaaattaaaaaaaaaaactcagtcattatagacaattgtactcaagatgaaaacaccctgtactgtcgcaaccctgaagcacctctgttaatatgtgtgtgtcttctcacggggtgattcttgatcagagttactgaaacagcaaggcttgggaacaagaggcatgagagcaacactcaggacctgttcagttttctgcacagttccaggtgctcttccagcattgctggctccgagagagtcaaatattcagagcttgcaagctggggaggaaaggggttagggtggagataaagatctgggagatctacagatacggatcatctgcatttggaaattttgtttgcccttctcacacatttccatccaagttttctttggggaagaggggatccctgcagaggagtccagttgcaaatgtgaaatcttaaaaatgtatgtaaatagcatctttcattccgtgatacttgtttgtttgaatagaacattgttaaattttattgtgcttcagaatcatctgggtgcttacaaacatagattgctggactctggttctggagattcggattctggaagtctgaagtggggcttgggaatctccatttcttccaagttgccaggtgatgctgatgctggtagtcgggagtccgtactttgagaaccactcttctacctaccaagacttccaaaaaattggtactctgggaagatgccctgtgccagtcctgtggcttcttaggcacgtcttccagcatagactcctgcagagaacctggtacctgcaagtacctagtacctgcaagtacctgcaagtccagtgtgggaaatctcatgacaggcatcaacattccgtgacggttgacagccacctatggggtggctgatgccttttctgtgtcttcagggttttaggggaaggagagtctaaatgagtggttctaggttgtgggaagagcctggctttgatgttcagacacctggcctcaggctgcatcgcccatacttcctgtggaatggttatcatgagtcctgttgtcctgtaggtgaatcattgattcctgtctttgcataacctctcacttgatgataatttttttttaaaaaaatgactcttggaaacagaacacacagttgtagagggacctacagtacagcagaagctttgtggaaggatacaaaatgtgagggactgtagtcgaagagatttaaattggaagtgggaagagattgacttttttttttttttttttttttaaagacagagtcttgccctgtggtccaggctagagtgcagtggcacaatcttggctcactgcaacctccgcctcccaggttccagcggttctcctgcctcagcctcccgagtagctgggattacatgcatgagccaccaggcccagctaatttttctatttttagtagatatggggtttcaccatgttggccaggctggtctcgcaaactcctgacttcaggtgatctgctttgtgtctcttagggagcatgtttgaagagtcaaaggaaaaccaagtctgttagctttgcgaaacgtttttttttttgagatggagtctcgctctgtcccccaggctggagtgccgtggcgcaatctcggctcactgcaagctctgcctcatgggttcacgctgttctcctgactcagcctcctgagtagctgggagtacaggcgcccgccaccacgcctggcaagtttttctggaatttttagtagagacggggtttcaccatgttagccaggatggtctctatctcctgaccttgtgatctgccctacttggcctccaaaatgctgggattacaggcgtgagtcaccgcacccggcccgaaatattgttaaaaccaagtacctttgtgaaacattgttacaaaaaccaagtaccaagtgtgtggcattaaagtcaaacattaatttcaagttacagaaagaaatagcactgagtagaggttgatcgataaaaaatgaataaaatattcaacagaaactccttaaaaataatgtgagaaatggacatgtgacatgggcgtttaaaaagtctgtaaggccaagaaaagtttcctgaaaggaacactgtgcccaggcagtcctggctttgcaggattccctgataaccgagctcaggcatcctgcagagtgagtactgcccagatagaaccttctgcctctttggggtaaaattcgatttcaaagagagagaactgtggggtgagaaaggaagactgggacccaaggggccaaactagtgacaatgactgctgtcatgaagggtgacaaggacaatacctgctgagctcaaaccaccctttggacccagtgaagctcagatgttgcttccagtgcaggagtagttaagctcaactgttttacaatatccagttatttggctgggtgtgatggctcacacccacactcctagcactttgggaggccaaggtgggtggattgcctgagctcaggagttcgagaccagcctgggcaacatggcaaaaccccatctctactaaaaatacaaaaaattagccagacgtgatggcaggcgcctgtaatcccagctacttgggaggctgaggcacgagaatcgcttgaacccagggaggcggaggttgtagtgatccaagatcatgccgttgcactccagcctgagtgacaagagtgagacttcgtctctaaataaataaataagtagcaaaaacaatccagttattcctcaaatatttatgagcacctcttaatgtttcagatactattgtgacaagagaaaaatgtgtttgtatatgtaaatagaaaaacaaaagtgatgtggaagcgattacttctgtcattttggaactaccttcctcccatattaagtccatattatgacaattcaaaaataatcaaacttcgtaagatattacctgtgaaaggaataagtatttaaaaatgtattttagatggccttttagaaatctagtccatggacacaatctagcatcatgcagttgccttcaaaaagaatatcctaaagttcttgtttgttttctttttcctttcaaagtgttctgttgaaaataacccatttgtcattttagttttgatatgacttagttatacatgccttttgaagcagtacccacccacatagtaattgcgactatcttgtgttttgaaaaaaaaaaaagcgagacaatttgactttgatagttttaagtttaaaaaaaaaaaaaaacgctccaagttagactcagatgaaatcctttgatcttaggtattttatgaggaaactggaaaaaataatttcacaaatttctattttgctttataaaaattttatgattcataacacagggaaaatccagtaagctaaggcgttttttagtcgtttatcttgctagtgagtctttgatgtgagttatttctttgcagtaaggtggcatggatgggtgatgaggctaagctgaaaagttaaatctcataatggacatttgcaccctttaaggaagtaaagctctcaaagcatgattatggccaagatgaggccggtggcatgtttgtctcctaaatgtgcagccaggaatctcgacggtttgtctgaggtatgcaggtgcctggtagataaattagggtgagcatcattcatggcgtgtggtcagttgcaggccttcagccacagggatgacagaagggaagtgaggaatcagggatgggtttgaactgcggcgttgctttgggagtctctagacatgatcagttgcacatggactgttctccttgtcaccctcaggatctactgtcctgtggttgaagcctgcagctctcccaagttggtggcactgggcttcctgacttctcgatgtctaatgagacagtggaattctacttgcagccccactgcaggccaggtttatctctcctctgtcttcccagctggtgatttggtttctcagtgctgttttgggtgcacttttgtggaggattcaagctggtccttagccactccttgaaccagaacctcttttactttcttatgtagttcttctcttcctgtttttatatcctaaaactagtccagcgaccagcccatcgtagtagaagcgttggtgttcttcctaaaaggaattgtaaacatctcttggagagtgggttagccaccataaattgttttgggacttcggatacccccttccgcaaatgctatctagagatgctttaatttcatttcaattggttattgcatccctgatattttgaaactgttatgagtagaaaacattctggtttatgaacaatctgcttttcactatgaaatagatgggaattttaattattcctgcgctttgtcttagagaagttacatgcatgcatcaagtgttgtgtgatcttgtgcagttcttcttagattgagtttttggctcctcgtgtgcaggccttctaaaatcacaatgtccctgagttgggaaggaacatcaggggctatctggttcattatcctaccccccaccgcctcccacgccccacatttctggcagcctacgagtctttggtccctccccagtgctacctggccagctctcagccttgggaggccacctgcccgtgtttgacctgggttaatgaccgccagttcctttcccttaatacgactcatctgctctcctgcatgctcgctccttgggtgagagctgccctctgcaacctcataacggaaaatggcttgacttctgccacctcctcctccttcccatgaaagaatctggtcttttctatctctctattatttttaaaaccagattaggttggttgtggtggctcacacctgtaaaaatcccagcaccttgggaggcagaggtgggcagatctcttgagccccaggagtttgagaccaacttgggcaacatggggaaatctctaccaaaaaaatacaggaaaaaaaaaaaaatagctgggtatggtagcacacacctgtagtcccagctacttgggaggctaaggtgggaggattgcttgagcctgggaggtcaaagctgcagtgagccttaatcactccagtgcactccagccggggcaacagctagaccttgtctcaaaaaaaaaaaaaaaaagaaaaataagaaaaagaaaccagattaaacattcctaagtaattctttttgtgacttttgcctgtttattaactatcctggctacttaaaatgaatttttgagttatgaatacatttagatggttttaaattcaaagaagtctcttttttctcagtcacttccatccccagccaaacagttcttatccccagagtcagccagtgttaccagtttcttgtgtccatgcagtttgctttatgcatttacgtaagcaaatattcgtacacacacacacaccctttctatcttatggaaagttatttcagtggcacatgtaagtatctcagcatctcttgattgtcattctttttggattttttttttaaatttcatacttacaaatgatcatgtatcttaagttttctgaagtagccttggtttcgcattttgactgtatttattatggtatcaggttccatatttcttaaaagtaatactgctgctgcacttacattgaacaagtcaccaagctctgttaattttgcctgaaaaatgccactgctttgacatgatagaaaacacaggcaatagtctttatttctcactgctgtttttttcttattttgaagaatcaccctaatacataggaaaatctcgacttagcaaagagataaatgagactgtaattattgcattgggtttttcacaatgtatgttagttatctattgctacataacaaattagttttagagttagcagcttataaagcaacagatatttattatctcacagtttctgtgggtcagtaaatcaaaagtggcttaactgggtggttctgacatgtgcctttccacagtgactggtatgtagcaggcaagggtctcttatgatcctgagtgaggatgtcagccaaggctgctgtcatctgaaggcttgactggaacagaaggacccatttctaaaatgagtcactcacatggctggaggcaagaggcctcagttccttatcgcagagattgctccttggggctgactgagtgtctgcacatcatagcaacagctggctttccccagagggaatgatccaaaagagaggtggaagcctaatgtctttgtgacctaatctccaaagtcacacactgtcacctcttccatattctattagaaaggagtcactaaatcagatacccatgggaaattacccacctcatgaagaaagaaatatcgagaatttgtggacctgtttcacaaccacacagcatcattttttgaaggtagagtcaccttgagcatttaaattagggttctgctctagaagtctatccctttattttttcccatttgttaaccctttttctacttggcataatagcagccattacccagtagaagttgagagatttaggttgcacagaatcccacagtcttttcagaaactcatatccttagggtgtctgcttgttgacagcattgtagaattgaaacttgaccacgtgttatgtgttgggctgccagtggtgatcagagatgacggtgagtagtccgttgagttagggctgtttgcctctgtcggtgtcatctgggtttgaactggacttgcagtcctggtgggctgctttcatttccaccctgggtctttgttctcaccactcacatcttacgcctctgttccaccgctgtgtaagaggcaactgtgcacacaccttgcctctgccattgactgtaagctcctgagagagagagagaatgtgtctggttcagttttgtggccctcctttttgctagcataatgcattgaacatagtatcattctgcatttttgttgagtgtataattagatggtcaatgtggagaactcagagggattttaggagggggtggcagcaatataaggttgtgggacccaacattaagagagggaaaggtgtagcgggaaggcgttggtgtggggagggagaaagtcaagaggattcaacctggcaagagttggaagtgacaggaaggtgtgtggggtggggacgcaataggacagtgtgtgagattttttaaaaaatgcaggcaggggagggatgagtaggcagagcaccgaggatttttaggacagtggaaatgctctgtatgatactataatgggggatacatgtcattatacatttgtccaaactcaaggagtgtacaacaccaagagtgagccctaaggtaaacgatgggcttcgggtgatttcgatgtgtgaattgtaacagggatactactctggagcaggatgttgatcatgggggaggctgtgagtgtgtcgcggtagggggtacgtaggaaatctccgtgccttctgctcaattttgctgtgaccctaaaactgctctaaaaagagtagtcttaaaaatgcatgaaataggatcctgtctcaggactggggcaagagcaggtagaaatggaaagagtgactgtggctgctgtgtagcaggcacacaatggtcatggtccatatgctggcttagttattttttaaagcaactaaagttaagtaatgtatacgtaacttacatatttatgtggtccaaaaaacgttggtcatctgttttaatgcagagagtgtttaccctaagcctgcaaatgtgatgggtaatagctagaactagaaaagtactttagaatatggaaggtaaatacatgaattaatttaggtaagagtgacaaaacagtggaagtccctgacttagaacttattgtccgcttggacagctggtgtacgtgatcctggggtcacagtggctccctgtgcaggaagaacactatttcccagctcagataccatctttttaggagagtacctgccattgtggaaaataaggataaaggataacaagttacctccttaagacaaagtcataggagaaatggtaaattccagtatcttgagttttgagttggaacttgaaatttattttactacaagaacactgttgatggattatgtattttatagactttgtgggtggctatgggactctagtaactgcttatgcacagtttatatgagtagggctgctggatttccagatgacgctctcgcaactgaaccttcagattaccacctgtttctcagtttggacactattagtgtgctgctgtcacttatggctcgggcaccttatcttgttttatgtcttgatgaagaagtacaaaattcagtgtaaaagaaaaacatatgtaaagcttatagaatcaccccgttacacaataacaatgcagaacaatagattaataacaggaagagatgctgaaacttctcttcagcctagtttctactctgatgtttcttctctgcattgtacagccaatctatgaataatattttcattgtctaagcaaagccaccttagctaaatatttaattctactggagtcataaacagggttcaaaatatcacacatagattttatgaaagtaataaaatgcttcagaaagtacagtggctcagcctggggccactgcatctgataatttggttacacaccttgtcatgtgcttcctaaaagaatgacgatggttgcttatctgtgtttaagcttgtcattttgaggaaacaaagataagacatttttgctgtgtctctaaaatgcatgtgtaaactatttttatagagtaatgcttcagagaggagtaaaatttcctgcaacaggtgcttgtaaacagtaattgctcagtaaaggtcacctcccagctgttgcctacatgttacataagagaaccccttcacgtcttccgtatttgcagctctgtacctttgtgagtcacctaaaaaataactcatagggttgtttttctttctttcttttttttttctttgagacagggtctcactctgtcgcccaggctggagtgcaatggtgcgatcccggctcactgcaacctccgcctcctgggttcaagcgattctcctgcctccattctcctgcctcagcctcctgagtagctgggactactggcatgcatcagcacgtccagctagttttatatttttagtagagacagggttttcaccatgttggtcaggctggtcttgaactcctgacctcaagtgatccacccatcttggcctcccaaagtgctgggattacaggcatgagccaccgtacccggcaggtttgtttttcttatgacaaaatcaagcctggatggtgtcgttaacggtgaagttaaaatttttcttttgctttccttaatatttccgtgtttttttctttttctttttttttttttttttaacaaaagtctggtttctaaaccaaaatatttaatgcttcaaaaggaaaaaaatgtaagtcagtccaaagaaatgattcattttgcagaggtaattactactaacatcaacctttccaggtctttttctatgcagctatatcattgacatttttttaaaaatgagattacattgtactggagggtagactgctataacaacttttggttttggatgggaataaacagaaaaagtctcatctccagttcatttctggggagggtcaggaggtggggggtgcttggctctactcccttcgtatgattttcccttctttatctccaggatcttccccatttcacggagagacatggatgagaatgaaggctgctgagtgggaggggcttatggggccagttttgaagaggcctcataccttttggccacattccattggccagaactttgtcatatgactgcacctaactacaaggaagactgggaaatgtagtcaagttgcatgtccgggtagaaaagggacacttttctgtggaatagctagcatgtttgtaactcaattttataaaccattttgaaacttttcttaaaaaaagcttatttcagacacatttttatatgctggatctgctcacctctccatctctatcttattaaaagttcttgccagaatctctctccaattgttctccctccttctgccctgttccctcacagcagccacagtggttctttcaaagactgaagctacattttatcactcgcctgcttaaaactttacagtgcttctcccccagtggtcgggataatgttcaccctctcctgaagctggcctctgtggtccttgaccccatcaggtcccacggtgccctgcatggactctgccatccttcaccagcttccccccatcaaacggggcttgctgtcagctcttcctgcaactcccagccctgccgcaccactcagccttcttccttcaggcttcagctccagtgtcttttcgccaaagaagcctttcctgatctctcagccataaatgttcctctccccagttgctttttccctctccctctactcagttgctttatttaactgtcatattgtctttggagcacttgccaccatcagaaattatcttgcattatgtatttatagtctgtcttccgcctactagatggtgggttgcttgaggcaggaactctgtcttgtttacatctctatctccagataacgtgtctggcacgtgatgggtactcagtaaatacttgtggaataaagaaatgtcattacaggttctctatgcattaaaattttttagaaatggggtgttgcagccgggcgcagtggctcacgcctgtaatcccagcactttgggagactgaggctggtgtatcacctgaggtcaggagttcaagaccagcttgggcaacatggtgaaaccccatctctactaaaaattcaaaaattagctgggcatggtggcacacacctgtaatctcagctacttgggaggctgacgcagaagaatcacttgaacctgggaggcagaggttgcagtgagctgagatcccgccactgcactccaccttgggtgatagagtaagactctgtctcaaaaaaaagaaaaaaaaaaaagaaatggggtgttgctatgttgcccaggctagagtgcagtagctttccacaggcttgatcgtagcgcactgcagccttgagctcctggactcaagtgatcctcctgcttcagcacctccccgagtaagtggtactataggtacttcaggttttgaagcatgtgtaaaaaatactctagcagggacatcatttgagctgagcaggccatggaggcatcaaatgattagcagtagggtacaacttgttgtgagaaccagaaaagagccttggcctacataacatcctgtgctaaagaaagaaccctgactcccagcctgtgagtgttccagagatgggcagagcagtccctgcagcgcttcagggaacagggaagagcagctaacccctgatgcttctgtaagcactttgggacgccctttgctatagtagggtattgtcttagttatccctgacttgcctggtgttactttacatcccttaatcctttcatgaagactggcaaacacattcagtcctgccaaccttgaaagtaggccatgtttgaaagaacattggcacaaacgagttgcgaacatcttctttaccatattcatgttctttaccgtattatgaggacactgtgcttgccacatgggcagtcttgttttggggatacgtggttggatggacggttgggtggatggaagactcctggaatgtgaagtatctcaaggatgtgtgtccattgcatgaatgtatgtttgatctatgcagctaattgacaaagatccaccatcctgtaccctccatgttttatttttgccctgccattgttctcttcgacattctataatcatcaaggttttcttgccctcacctaggtcttgactaaacatgttgggtaaatgaatttcatattactactttcttgcgccgtcagccattgtgttcttggggactccatcctgagccttttttttttttttgagaccgagtctcaaaaacaatgaaggcaggtgactggtgaggagagttccagccactggattctccctcagtcccctgtgctgtggcccttggtgacccctagatttcagtgcccctgcctgacactggagtccctctgtaaagaagcccctttctagctagctagctgttccatcccgcacacccccacagaagccttttgctgccattagtaagcacgcctctattttctcacctgtgattgatcatgcatgattgagttttgtctattaaagcaattgataagttactaaaatggcaccaaaagaaattagaaaaaaattgttgcaaatgtcagtgaaatcttttaaaaaactgttgtactttagaagtgcctcaagtgactaatggaggcttaggactctgagtggtgtcgcaaggaaccttatgcacagggacactgacattagcctgtactgtcacccaggctggagtgcagtggtgtgatcttggctcactgaaagccccacctcccaggttcagcaattctcctgcctcagcctcctgagtagctgggattacaggcacatgccaccatgtctggctaaattttgtatttttagtagagacagggtttcaccatgttggccaggctggtctcgaactcctgtcctcgtgatccgcctgcctcggcctcccaaagtgctgggattacaggcataagccaccatgcctggcccctgggccattttttattcttactcttaggctaggtttctgcagaccttggttataactgcaggctctacattgataactgctgagtctctaagtcagaccagacgtttctccccatttagtgatacatgttttccatccaattgcttcatagacaccttggacacagtgctctatttcaatttatgttgacagttcatgacccaaactggaaacctgagttatcctggacttctgcctaccaccttctcctaagccatctcacctgtcctaaatgtcgtagcccttatctagttctctaagctgtcatagggtcctgtactgctgggctgcttgttgccttcaatagagcctggagcatattcatgtcggtatttcaaggccccgggcataagagcttcttaggaaatattggaatgaatgaagaaatgatgaataaatgaacaaatgaacagttgattgatttccaagacactttggggtggtttccatttagaatggtttttatttctttttactggaactaaggaattatttttgcttgttgatgccaacattttaaaagcactataattttgaaatgttttaccacattaaattcttttctattgcaggtcacatacaaatatgtcaacttcaaaggaggaattatttgttatatttatgcaaacttgtggcacttggacatttatctagatggttttttgtgtatgattgtgttcttggtacagctggaaaagctaactttaaatggcaggagtaattgatcttaatgacttactttgaattaaacttgtgcttaattaacttggatgttctaagtttctagagtcacagacttttagagctggaatattgctttttgaacttcagtgtaaggaagaattgcttatgctcgaattgatttgttctgtatcccaatactggactgagtagaaatcaattactttaatattggatgagagagtgattgattgaagatcaggtttttaacctctttttttgttctccttctcacagggagagtcccgtattctcagagtaaaagttgtttctggaattgatctcgccaaaaaggacatctttggagccaggtatgttggctttgtttttatttctgtggacttctgaaaaattgacaagcagttttcaaattcaggcacgcatcagaatcacctggaggacttcttaagacaaagctggctgggccccacctgcagggattctgatttaggaagtgatgctggcccagctggttccaggagcacattttgcacagggcttctggacttaccatcacaacagtagttaacagcctgttcttcacatgggctaatttcatgagattagcttctggtgttgtattctcagtagaaaaatacagtgtgggactatggctctgcttattttaatacttcaaaaatatttcaaacttagggaaacataaaagtgtcattttgtttctaggagaactggatattctggacatgtataatctgaattaagagatttggtgatttggggcgaatgtggtgatttctgtggcatttctagaagtaccagcagggaagcagccagatctttctgtgtgtttcagcttttttattttcagtattgcacttggatattcctgtatctttaaatcagcccttttgttcctattggctgtcagcaatgtgttgcatgaagttattggactgggagcagggtgagggtagccgtagagccacctggcactagaatttagccagattttggagaccaaagatcttttgaactttaaacctggaatggacatgagtgatgttctagtccaacttttccattttatggttgacaaagcttgaatccagaaaggttaaactacccgtgcaggtcacgtgggccagtgatgtttgaggagtgacaggaacactcctcctgcctctacccagtacattttcctttgtggcatggtggcctgaaaatactgtgaggtttaacaatgaaggcaggtgactggtgaggagagttccagccactggattctccctcagtcccctgtgctgtggcccttggtgacccctagatttcagtgcccctgcctgacactggagtccctctataaagaagcccctttctagctagctagctgttccatcccgcacacccccacagaagccttttgctgccattagtaagcacgcctctattttctcacctgtgattgatcatgcatgattgagttttgtctattaaagcaattgttaagttactaaaatggcaccaaaagaaattagaaaaaaattgttgcaaatgtcagtgaaatcttttaaaaaactgttgtacttagaagtgcctcaagtgactaatggaggcttaggactctgaatggtgtcacaaggaaccttatgcacagggacactgacatcagcctgtactgctggtaatgtcagagtgaagcaaatcccacctgaaggcactctcttgcttgaccgtgaagtcacactgagtggttcaccatgtgcctgcactcatgcaaggataagccaggtctctaggcatgggcagaaggatccctgcttcccttctcttccctttcagagcaacactttcagccatttccatgagtctgggctcttgttacccagctgaaatactgtttcctgaaactcacaaatttgctctctaccaaagcccaccttatgccctgcctttccatgaagcctgtcaagaaaattccaagaaagaaaatttgatattcctatatcaaagcgtgtgtctttcctctcctaatccctcttagctgccacagtaggtgcaatgtcattttagcttttgcagatgcattacctggtggtttcctagtatttctttcacttgcctcgattgctagattagaaatttactggggacagacatctttttaatatctttctcctactacttaacatatagagcatcaagggaaaaaaaaacaaaaattatcttttaaaaatgtaaacatttgcatgccaaccggtagtggattgtgcccttaggttaaaaatatgtattctcactctttccaatgaaatctgtagtgctgaaggagcaagttggatttagaaaattttggtgatttctttttaagcttgattgggtttttattttgttttatccaaaccctcccattaaaaaaaaaaattgattcacattgtatttctaagccagttaagtagatttaaggttgaatttgtagtggaattaggctccaaatcttagaagagcaaattcgtaccttgaatttttactgtttagataataacaggcagggtcatttctaagggacatggtggaaaggaatattcgtgatattaattagaaagataaatcgtattgtggccaagtggaccaagtgccagaaaatgcatcagaaactctgaatcctgcttctggtcttcattttcctagattgataagtaggcgcacacattcctgctttcctccctcctctgaagtgctgtagttcttcagggacacatttgccagtgggtctgagatgcaagtgtgaggtggcagtgtgggttaatgccatcttggtgtctcactctggagtggcactgcttattgccttaaaattttgccagatgacctgcattctccctccatgctatcttgggcaaatcccttaaaaccactcatgccactgtgtattagtgtacaacaaggataacagtttctttgtaactggcatgtggggaagaaccgcaaagtgacttctgtcggcagcagctctgtcgtgttttaaggtagtagtcaccgggcagaggtttggtagtgtcctctctggcagccaccgtctccttcagagccctgggccactgacatgccttttctccaagtctcttccctgagtattccccgcacctctgtgcctgatcagacacctcattctcccttggcagcaagaaggccgggtaggcattggagcccttgctgtagacaggataatgggtgaaagaggaagaacattttcatgagaggcatttcagagcctttaaagtggtagaaatcctgtagacaatgatgtttttaaaatcagggatttgcatctctgggactccaactcctttgtttccaagggaggttccctgggccacttggcctgaggttgggaaggggtcggtggttgcggggcagaatgtgatgcttggggatgcaggatggtcaggggcgggtgacggtgggaggagtggagcacgtcatctctccttgcccttccgaggtggtgatggaagctgcctacagctccagctcagaggccgggggtttctggggcccttggtgtggggcctctctcctagctggaggtggccccttcccccttgagaggcctgtgcctgaaatgcccttgtccttttcggccgtctcggccccagtccagtacttaggatccaagatcattttcagctccttccagccaagtctcactttattaaaggagctttgtttggagcagattggataaccgagccgcgactccacttgaacatctgagcagttggcccgcgtgggaaacagcaatggcagagaaagatgcttccctttggatcataccttgaggacaaaaaagggcagtcatataatctgtcatctaaactgggacgcttttgtctggaatgaatgcgacattgaatgggacgtccggacataagatgtaaattgagactgcagtcaccctaggtcagagacatccagcctttattatccatatcatggggaaaaaaaaatggaatgtgattttttttccccaaaacagcttaaaaaaaatgctaagtaaaagaaaaaaataaaaagcaccttttaaaaaagcaggcctcacataaaatgccactaagacatcaaaagagaagtaaaaccctgctcaaaacgcccacgtggggcggccacagctcacccttgtgtgcctgtgtcccgtttctgctgtcccctttcccaaggacgtactctgccctaacctcaccctgatctggtgactcctccagtggcccatcctatgttcaccagctgggtcctcatctcctccgccacacaggctgctgctctgtcccccagcagacctctccctgtctctggggtgcccatgacccctgggaagtgctgtgcatagttctgtgagtgaggttgacttgttgttttatgcttagaattgtttctttctcctgaaattagatttttctcctctgatgactaggattctattttatttatttatttttattttccacgacctattatagcacatagcacctaacaggtcctcaggaagtatttaccaacagattgcatgaagtgagcccgttcttcctccctctctccttccctccctttcccaccccttcactggaaactcacagtcactaaatatgccatgaagttgctgccttttgcctttgcctgtgttttcccctctgcctggcatctgctcacatcctttctggcagctgccctctcatctgtcagggcccagtttgggtggcaacactcctgctgaggcccctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccacctcatcaccccagcccaagaggacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcatcaccccagcccaaggggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcatcaccccagcccaagaggacagaacactgctgcccgcctcatcaccccagcccaagaggacagaacactgctgcccgcctcatcaccccagcccaaggggacaggacactgctgcccgcctcatcaccccagcccaagaggacagaacactgctgcccacctcatcaccccagcccaaggggacagaacactgctgctcctggggctgtagtgggtgtacaagttccctcctcctacggccccttgtcttagcggacttgggaggctcagaggctccagccctgtcttattggtgtttgcaggtccagaaatcttggcacatgacagttgcctggtaaactgccttgaattcattgagtggaacacaatatggtgtgctgtggcacctgatggccagcctggaggaaggggtacttttttctcattgtcatggaggtcccattggctcttcaagcatctctcccaagcatctaggagaggtgcttatttctcattctcacaaaggctctttgtggaccagcacaggaggcctgcctagggcttggatgaaaaatgagcatagagagaagaggttaagggaagcaagctcaagagtgggctcagagaaaagaatctgggggagtcaatgagatggcaggcaaggaacagtctccatttgatgctgatgtttgtgcagaatgactactttataccgtacagaaggagcacactctcttcttgtggtaggtcccagaaacttctacttgggggtacatgaggcccagctgggattgggcacagaaggtcatggctctgcacctgaccctcaccttaggggtcaggagagagccaaggacacgagtgatgggttagggaggactcaggcaccatggaatactgtggccatccttccatagaggagaggtacaggtggcaaggcaggcaccaggcagccgccgacagggtcaggaaccaaggcaggtccaggaaacagaggccaaaacagcagcaggaacctcaggcttagcagaccactgactcttctggaagtcttttagacgctctgtggtggggcagggacaagtccttggtgtttggccatggtgaagtgtgcagttagggtaggtgagtcgtgctttcttaacacgggggtaaggaaggagggtagagtttcagcagctcctgtttcttgagcacttgctatgtgccagatgtggtttgaactgtttacatgggagctcgttgggtcctcccagcaaagtcctatgtagcaggcactgttgttctttttgcagataaagaaactgaggcaagaaaggtttagtaagttgtagagctaggtattgaaccagggcctaacctcttaacagaagttagttagaggctgttacttgagtgctcacaggttggctggcaatgtgtttggaacccaatgtaatgtcattagattctgcctaaatcttgtgaagaggggatttccatttgataggtaagaaaattgagaagttatcatcagcccgagatcaaacaagggtatagggagtggtgggacctattaagttcagatttatgtgacttctgatgctatgctcagtgatagatctcttcttgaggataaaagtttgagaattagggttcctcgaaaaccctgagatttctttttttgaggggtacctttttgtgttagcagatttaaagagctggccattgtatttgatggtagctgagtaagccttttgaattggagtatcatcaactattactagatttagaataggtatattttgctaagtaagatcttaaagtttttcctttaaacttaggatagctgttcaaatttcaaactcttcttttttcagtaagctggagacatttaaccttttgtcataggcttaaagcagtcattaaacagggtcatttcaatgcaactttttaaacctaactcccctccctttttctctttaattatgatcagtggcttcatttgagcttacctaggatgcatttgagactataaagctgctttcttaaaacttagcaatgttggctgagacaaaccaactgtagaatctcatgctttcataaagaaggttgcaagacattcattcacagttgctcctttattgtgtgtgatgagccattggcatcaaacctgcttgggttgctatcagtttttcttttgagagctggtgacttgcaatttaaaacacacatgggctcaagggtattggagggacatggcagaaagtccttctgctgcctagtgattgagagtgatggggtcctaactctgtgtgaggatagctctttgacacagctcacctcagtcccctttacctaggtttaagttgttagcattttgctgtatttgctccatctctttttttccctgaagtattcagaagtgaattacagacatcatgacgtttagttcctaaatacttcagcccaaacctctaaaaaacaagaacatatttctatataactgtagtactgttctcacaaaattaagactaattgcctaatggactctattacctgatccattatctgaacttccccagctgaccttaaaatgccttttacagctggactgtttaaaccaggattcaattgagaattctgtattgcatttaatcggtgggtctattaagactctcttaacctagaatagtgataaaagctttttactcttggtctctttgcaaactggggacccccagccagcaacaccccacctgggtctcactctaccatgctggggtgccctagctcacctgtgttatagcttgtacctgtgttcagtggttcccgagttcttgcatggcacccaagaagaatgaggatatgctggacattgagggtgaggagggcagagtagaattttactgagcaatggaatagctctcggtggagaggggctgcagtcaggtgcttctctccttcccgtgtggctgggcccagggctttttatgggctcagaataggggaggggcaggctgcaggtagtattggaaaaggcaacatttgattcattaaaaggcattgttcagaaagaatcaatcaggaaagggtgggcagacaggaacagaagttctcgctctggttcgtgggtttcatccgggaccagcagtccagtctttcagccttcaggctgtttttggctcgaaggtggggtttcaccggggacccgcccctatctgcccaggcgtttggctgcttcctatcactatcaatagtccctccccttcaatgacttgtaggaaggttgtttcgcttaccacattccatcgtgtcctggtggcatcatcaatgaatgaacatgttcttttccccatgtttcttgtacgtactgtgtattagaagttggactaaaggcttgatcaaatttgaggcaggaatgggtgaggctacgtgcgactggagggacacaatgactggttctgtcataatcagtgattgaaattgatccctgggtaaatgtgggggcagtctcatccctccactatcaaaaattaacattttttttccccaggtgaccagcaagtaacgaggggaggggctgttttggtactgtatacctgcaaattttaaatattgatttactttacttccaaaggattggaaattttgtttttttctttctttgcccttctttgaaaacattgtacaaagtaaatctccttattttactaatggagaagcttctgaaagaggctgaacatacattgaagtacctttgctcagctgtaagcccttctggatcagaggtcagaccaaagtttgcagacagttggtccctgtggaccagactgaatccacacatgagtttatttggcctgtggagcactgaaacaaaaaaatgcaaatcctgagccaacgtttgggagatcccatattataatacaaatcgagatttccaggtttctggaaggtcttggcaatctagccacactgggcctgcatctgtgcaaggctgcatggctagaggtgtgtgctgggcacacccattaggtgggactgcgcctttctggccactagggaccgtacacctcctgttgttttcatgggggctggtttcccttgctgacacgtggccatgaggtccctcgaggtacaggccggcatttggacttgtcctctgcactgtttctttgttagcatttagaactgacttctcctcttcctcccccattgaggagcagcaccttactctgtgcagagtctgtctgtgatctgcaggctctttgcagagctacatttctctctggaggccttgctgagcagcctccgctgtctagggcattgctgagaatcacaacatcaacactaatggcccttgggccaaaaagtgtttgtcttaaaatccctgcaccaaatagcttgtgcaattactcctgtgagagccccagaggatctaactcttaggctgtttgttctagctgtattccttcccaccccccaaaccgaaatgacattaaaggatagtaactccctcccgcaaatatagataaaaacctctttactccctaacaaccacacaactatttacatttttgtgtttacctcctagtctttaagtatatgaatgcatgcaacgtcctttaaaaatatgtcaatcctagcctccacaccacccagccgaccaggtttcccagagggaagcattggaaatggcagatgggtaaatgcacagagctggcaaatctccatcctgcgggaggcttgctgtgcaatatagccatcgccacaataatggatcttcctaatgatccggaatcactgagcaaagactgtgccatgttcagtatacactaagtgagcatgcagggaatatatgatcagtttacaaacatttccacataagcttttttctctctcccactccagttttggtaaataaaagagcaaactagactgctttctttctctctctcactctccccctgtctccctccctcttcctctctgtccctgtccctctctcctgcctccctcattcactctgtcgtcctctctctctcctcctcctccttccttccttgcttcatttcccccctcatctctttcttcctcaccctttttaaaaagagacaggagtcttgctctgttgcacaggttagagtgcaggggtgcaatcatagctcactgtaacctcaaactcctgagctcaagcagtcctcctgcctcagcctccccagtagctgggagtacaggcacactaccatgcccagctaatttttaaaaatttttatagaggtgttgtcttgctgtgttgcccaggtgggtctcaaactcctgacctcaagtgaccctcccgccttggcctctcaaagtgctggaattacaggtgcaaaccactgtgtccagccagacaggtcacttttctgtaccattccctgatgttgtgagattagtgagagtccctactgtggaaccttgttcacgttgccctgactcctgatgcatggatatttgctgttaccaaagacacctctgctttaccaaatgttttgacagagtggaaggaaaactacaagacttcttgccctcgttttcttcagtctagaatgatgctggggtcactgagtctgtagggcagagaatctgatgtgttttttaggaagcggaaggtgtctgacacatagatgtttgacaaattttgttaatctggtcagagtgcagcctagaaaattaaattaaaaagctgctgaggagtgctggggtcgcattttgacatagatacaaaggcaccaatagggccaaaagtatgaggccagtcctagggctggtgaagtttggatcccctgcctgacattgtgtcctgagcccctggccccttcctgcacctctccctgagccgccggcccctcctcattccttcctctcctttatcttccgctgtctttgcctgtgcccccacgcccgtgccctgaatctggagtctttgtcttagtgcattctgtttgtctcactgtcttcctctgttttccttttcttgcggggaggaagggtagaaagagtgtaagaagctcaagtatgaggaagggaaggttgccaacttgagatgagtcagaaatgaaagcagttctgaatgtgtaagacaatgaggaaaatatttatttaacaaaaattgaactaccaaccaagccttcaggaacacagccagaaggtgctgtgtagggagaggtgtgcattaggatgctggagcgtggctgccggcgtccccaccccaggaggaagggactcgtttctctgaacctttttaatggttctccccattgtagacaggactggctctccaccccatcctcagtgggtgcagctttggggaggccgtgaggctggtgatcttggggcctcctatgcatctgtgttattgaaggtaacaatgtcccttctacccaaaagtcatgcttttaaaaacgcacaatcttgaatccatttgggaaacatctttggaactccagaatgttgtctttctcagatatgtattgccaatgttgtattacttcatttgctaagaaacattgtcatcgactttataaaattattgaataattctatttgggggagaagcctggaagctaagattttaaaggttatttataagttaagtgaactggcaaattcttaaatggtaaataaaacctttcctacatgctataggtagttatctaaatcagggcctaacaagcttttttatttattttcctgtaaaaagccagatactaagtagttgaggctttgcaggactgatggtctctgacatagcactaaagcagccttgggcaatacataaacaaaggggcatgtgtgtgagctgatggtccacgggctgcagtctgccaacctctgatgttataagccattgattttctacaacatatatatttagaactgggagtgtcagtgttattttgtcatggtttccagattaaactctttcatattgctgctggtcggtcaatgacagactaattctgctagcattgactttctgggccagggaatggggttcctagatagtgcagtagctttttatttattttcttttccattcaagggtaacatgcttaaaatacagcgtatgaagcttttggatatccactgtaaattttaaggtctaaaaatgaatgcaattgtgaaatgtttttgccttagagaaaacgctctcactgctttgtgttaataaatgcatgaaaaataatgatgaattaaatgcatacaaacagatgcagacataatttagatgagtgtattgcaattaaaatattgcccactttcgctacggaatattcgttggacttatgaccttagtgtaagtaatgtttaataaggaatctgcaatgtgtaactcctccgtaaattattaaaaggattggcattcctactgtataatatcaacacaagggatagaaaatatgcctggattcttaatgaatgtgtgctaacgttccttctggcataggaatgtgtagtaaatacacttcaagggttgttcgcatttttatccgtcattgttataggcatgttattgtgtgtctcctattgaagaactgattgatcattgttttaagcttctgtgacttttagatgcttaaaactaggcgttcatggtaggaaagtagagaaacatgtggaagaaatactgcgtttcaagtttgggagtggctggtagaaaaatcaaactaggctagtcttacagctttatcgcagttttgttttttttcctagtaggaaaatgatagtattggttgtatattaaaacactctctctgacactgacttgaatcacgtgcgagttcattgagaacagggattttaacttggttaggtgattttaaacattatttagcaaatctggaaaacaaaagagaaattttcaaatatctttcttccacggtggtgtactggctctctggagtgtgatttcatcttctcttattattgcatatgtagtcaagccatcatgttcttgaagtgagacttcacccactagtggggccgtataattcaggatcttttgtttgtccttacatagtttcttggcctggaatgtcaaaatatcagaaactgttctttctctggaatcatctgtctccgtgatggcctcgccatctgtacagtcatccaagctagggaccaaagagtcgtcctttactctctcatccttccggctgctgtgtctggctttcagtgtttgtgtagagcaggggtctccaactcctgtggcgtgttaggaagtgggccgcacagcaggaggtgagccatgggtaggcgggcaaaacttcctctatttacagctgctccccatcattcgcattgctgcctgagctccgctgcctctcggatcagccaccagcattagattctcataggaccatgaaccctattgtggaactttgcatgtgagggatctaggttgcacactccttatgagaatctaacgcctgatgatccgtcactgtcccccatcacccctagatgggaccatctagttgcaggaaaacaagctcggggctcctactgattctatattatgaagagttgtataattatttcatcatctattacaatgtaataataatagaaataaagtgcaccataaatgtaatgcccttgaatcatctccaaaccatccaccccactcctccaacccccaaaccagcctggagaaaaattgtcttccacaaaaccagtccctggtgccaaaaaagttggggaccgttggtgtagaggactcctcaagcagcgtccatatctgccctattctctctattcctccacctaggtatagaattctatctctaagacacagacagaccatgttcctgcctgggcaaacacttcggtgactgtgcattgccctgggtgaacgggggcacagaggtctttgtgacgccctgcaacgcatccctctccgagccgcggtgcgctcttcctcctctgtgccttgccggtgcccagaaccacccccttctccctctttgcacaagtgccttgctctctcctttctcaggccagtgctgctgatctgtctgtgtgacccgggtgcacagtccttggctctgtgcctggccctgtgcaggtctctgtggtggcacttagcacatggcgctaagattctccctgataggccttcagcgccgcaagggccagcaccgagtcctgcacatcctgctctagtcccacatcggcccaggggcgttgagctgaggacagctccctaccccctttctgtgcttggccgactccagcgcccgttcttctgcccctccttggctctgcctccccaccccttggctgaatctctcctcctttcgtgcttgttctccaggtgacttattcaggtccatattttcattacccttgcatttcattaattttctcatttattttattctgtaggtttaggacattctttaaaacatgcaggttctgaattttaataatataaaagtcctctgtgagtgcccatcacattgcttttctgtcctccctacattaaagttagcactgatgcctttatgtttaaggaaagcctcctgcagaggggctctgcccatgtaagttcattagaaggcaggtgtacagcctctgtcacctgaagacctcttaactgtctattccttctctggtctatcgaggtgtattgggggggttacagcaccctctggtggccatattgtcaggtgcatttttgttctagccaaataaaatgataacacaaatcgaatagtcgattggagttctttttcagaggacatcgttaattcacattttgtgtgtttcagcaggtatttaagccattctcgaatagtgacacttatgcagaggagagaatgattttatttaagtaatttctactttttacatagctagttttaaagtagataatacatagtcttaaactttatttcccctttatttctttcttttctgttagagaatttcttaaacttgtagaattatccaaataaaatgccagtcactaaaaaggaataattaaccaatagtgggaaaaaattaaattcttcaaatgaagagtactgtattcatttcatatggtcccagagataaaatgtttaggattcatttttagttttaaatgtttatgaatcagagcttcaacactcttccaggtttctttaagaaaggaatttgtctatctacggattaattaattagcagagcctctctgtgtcaccaagactggagtgcagtggtgcggctgtagctcactacagccttgaactcttgggctcaggcaaccttcccacgttagactcccaaatagctagaccatggtgcatgcaaccatgcccagctaattttttttttcaatttttctgtagatacagggatctcgctatattgcccaggctggtcttgaactcctgaaggcctcaagcgatcctcctgtcgtggcctaagaaaggaattcctcatatagaaaaatattgttatataaatagttgcctatatccatgctgtttatggtaacagctaaggttcatctcaaaagtatttgtatttggctttggaataaaaagaaatttcccctttcatagggttctgagattgtaggagtttttagtatttcaaaaagttaatggaacaatctgtgatgtgaaagagactcagaagaggctagagaggtctttaacacattttttttttgtattgttatcccttccctatagctaactttgtagatgacattgtttttcagactgatgattgtgaccctcaaccatggcagcaacaatttttaatttaaattttttaaaatgcaaggttgggtgattttctctctggatgcttgagttttgtttttgataaaaattctaccaggggcaggggaaagagtccattaagtcttggtgcaagaaacctgggcagattgcctaagtggatatgcatagcaaagaactgaaaacagagtagggggtgctgaaaacacccacagaggaaaatgcggggcggggggtgaatgcatctgctcattttgtaataaagtccttcctttcctttaacatctcttaatgttacaaataccaacaaaaaccatgcatgtcttcagtgggacagaaaatgagggaggcatttagggagaaaaaagtgtcagttgagatgatgttaaaataaagtttattttctttgcagttgcagacattaagatttattctctgggctgttaggacagttcctgcagctctctgtggtgacctgagcattgataccttttttttttttttttttttttgagatggaatcttcctctgtctcccaggctggagtgcagaggcgcaacctcagttcactgcaacctcagcctcccaggtagctgggactacaggcacctgccaccacacccagctaatttttgtatttttagtagagatggagtttcaccatgttgcccagagtggtctcaaactcctgtcctcaagtgatctacccaccttggcctcccaaagtgctgggattacaggcgtgagccactgcgcctggcctgtgccttggtttctcagatatttctgcccctgtagtgttctatgcactatgcagggaggtcctgactgctcagagcttaaattctgcattcctttattttaagtgtttggccaactgcagaggaaggtaccttgaaagatactccctctcctccctcactgctgggtcccctgtcataggagacctggcctgaggaggcttcttcctggtaacctgggttgtcactgggaccacatcttcccataagaataatgcttcaggttgtatgggagaagtgtctgacagcagtaacttcagcacaccctgagaatggcccttatggcagacacaccggacagcagtcactgaagaaatgagggttgccacatggaggttgctgggaggagggtgctaagtgaaggtgctgtataagctgcatgctttttacaagcagttgaagttctgctgtccagcccagagccactgggccaccctataaataagttcctccaaataaaccctgtgccttgtttgttagctctgggtctcttctttggcttcttcaacttggtgctgtccctgttgaagttaatacgggtttggcacaacacaggagtagacggttacctgtaccctgccagctgtccttgctacaaacatttgcccagagagtggcatttgtgccggttcttaaagtgtttcttgagctgcacattaataggccatgtcctctttcaacctgccctctggctaggtagaacaaacactcttcacctgggctctgagccagctgctcacctgcagcacccccctccttggagatagcttttcatgttgcatcttaccgagttgattgagtattcacttcgaagctccatgctgcacgcatgggcctgtaaatagctttttcgtgcacttgtgggtgtcatttcagatcgcttcatcggatttcagttacccaagtttttacttggttcaccgtaagtttgcaaaaaagactttttgttatcctgaacattgcaggtggaaacatgattaattttgaattatttttgtttaacttctaccctctttcctatttacagcctattttgtttattttaacttccgctgttaagacttctaaggccaggcatggtggctcacgcctgtaatcccagcactttgggaggccaaggcgggcggatcatgaggtcaggagatcaaggccatcctggctaacatggtgaaaccccgtctctactaaaaatagagaaaattagccaggcgtggtggcgggtgcctgtagtcccagctactcaggaggctgaggcaggagaatggcgagaacctgggaggtggaggttgcagtgacccgagatcgcgccccattacttaaaggaagtgggcttgtgttttgtggccttaaggatgtaatctgttggtaggagggaatgagggtgtcctggtaggggtgtctggctttagtgtcaccattcttttaggaattgccatgttgtggggtcacgtcttgtaggagaaacgttctgaagtcatgggattctctaccctcctctcctgctcttggtttccaccagcagcctgcttggtgtggttttgaaatggagcagagatggttttgatgagcctcactggaggtgctgctgagattaccgagaggccttgctgggcacctggagtcaatcatgccgggcactagcatccgtcatcttaggaggtagggattattatcctacctcctaagccatccctggagtggtggcttggagaagttttccagagaaaccgatcagttcataaagtttctgtaaaggattaacacagtgtagtccagaaatgtttgttcatgaagtcttggtttttgggtttaagaaagtgttctcctgtctgggcgtggtggctcacgcttgtaatcccagcactttgggaggctgaggtaggcggatcacgtggtcaggagatcgagaccatcctggctaacacggtgaaaccccgtctctactaaaaatacaaaaaattagctgggcatggcggcgggcgcctgtagtcccagctacttgggaggctgaagcaggagaatggcgtgaacgcaggaggtggagcttgcagggagccgagatggcaccactgcactccagcctgggcgacagagcgagactccatctcaaaaaaaaaaaagaaaagaaaagaaagtgttctcctaagtgctgctcaccctttttcccaaacaggacctaaccctgcgagggagggtgaattaggccatttgtttacagtttcatcagcaccaggcgtgcacggcgttagtcatggtccttgctctcaaggcactgtacttgtagcagcagtatggtgcaaatgtgcagctgaacagtgggcacaggttcctggttagcatttagtgccacaggaatgacagggaggtcttaattgtgatcggaccgtgggagctggattaccccagactgtagctcacttccctgtaagcttttggtagggagcttggaattagcaccattagtagaaacagatttcaaagggaatggtacctgttccgtatgaaacactttaaaactcccggtgtccacacgtctttaaaaaagaggcttaaagcagtttcatttcatcaaccccaaactggagaagctatgaatgaccacactgatgaatatgtcctaaaatatatgtatattatataaagtgtaaaaacagacaagcaggaacatactaccagtttctatcacagctacccttaaactatcattggagggcaattaagtgggtacaacctctagctatttggaaatatgtataaaaatgacaaatgcctggttgggtgctgtggctcacgcctgtaatcccaacactttgggaggcctaggcgggtggatcacctgaggtcaggagttcgagaccagcctggccaacatagtgaaaccccatctctactaaaaatacaaaattagccgggtgtggtggtgcatgcctgtaatcccagctactcgggaggctgaggcaggagaaccgcttgaacccaggaggcagaggttgcagtgagccaagatcgcgccattgcactccaggctgggcaaaaagagcaaaactctgtctcaaaaaaaaaaaattaaaattaaaattaaaaagtaaaataaaatgatgaatgcctgtactcttagacccagcactcccagttctgccagttcatgcagcagatacatatgcacacgtacagagaaggatgcaacagatacatatgcacacgcatacagagaaggatacgtatgcacacgcgcacagagaaggatacatatgcacacgcacacagagaaggatacgtatgcacacgggaacagagaaggatgcacaagaacatacattccctagttgacggagtcgcagattagaaacaacagaaaagcgtccattaaacaacagtttgaacctgtgttgagatatcagcatcccttctccttctctcccccactccctctgccctctgcaggttttattctcagcctgattttctccattggatgtcagccctaggctggcatttgcagagagagatggtggctcctgcagagcttacggcctgtattttattgggctgtgttgagttacccctgatgtgagcaggagaatgggatgttctgtaaattggcctctagcccatcgtgaattcatattttttttataatgtgtgagtcacactcccttctgtcttcatttccttttcacactcccagcagatcattctctctattctgattggcattttatacatgaggcagcagaggctgagacctactgtattttgagacactgtagctttatatggcataattaaatcatagtcatcaatcactcttaggaggtaaggattattattggcattttccagatgagaaaaatggaggatgagaaaggttaggcatcttgctgaagtcacagcagacttaagtgccggagttggagctgcattccggtatgcttgcatagactctcttctcatgctcactgcacgccagtcacctggtatgctgaggccctgcctccaggccttctgattcagctggtctgcagccctggcatttccagctcctcaggtgattggaatgaaagccagagctgggagccactggtctacaccaccagtaaatgatcgggttctcacttgatcatttaattaagaatcttggttttctgctttcagtctgagaactcttgttcatgctctcaggcatgtcttcacgcaggaaagtgatctttgaaattaataggtgcttggaaagcctttaagcagcaggcagtggagaaggccactcagtaggaagggccgagcatgaagcctagtgcacaggcttttcaagaccccacggagggtcttcagaaaaatgggtttcctttgtctccgtggcttccagtctttgttggccagcagttgtctgcttcaaatgagctggctctagaggggcctggagaacccagaaaaactttgtgacaacctgacaagtttgtgttaatcttctgggcattggctttctgcacttattgctcactgaatcactgaaccaggcaggtggggtactggagggcaggggatgggtaagaagggcagcctttggaaggaaaatcagcagagggcagggaccggggaagaaggagtaagaagggaaacccttttcttaggttcttataaatcagaagagcaataaagaaaaaatttaaatctaaaaaatacatgattaggatttaaatccagtatgcttcactacatataaacctttgacttaatattttctgtagtagatgaaaataggactttttttgtttcccttctcttcacatggtattgagtttttttgtgttctgaatacgtgttaagattaattatgaaaatcaaattaccagatacttgaaatataaaattagtaatattcaaagacgattaaatgcacgatttccttttctcataaaaaaagaagcagacggaacttgtattctgaaagcaaatatggaaatcacattaaacatcagaaaatcctcaccaccgccccccacccccatgtgcatttcatttctctttggtctgagttcaagggagagagaatatgaatgtgctgctagctcaggaagcttcagttctaactttctaaagagctgggaatgtgcttgagtctctgttatctcttgtttgcatttttcgctactttgcctccatttgatccagggaaaacttcatggtagggatgtgagatgtattttgagggctaaaagaaaggagtttgaacaaaagcaggacagtgttccgaatgtggaagcaaagagtccttccaaggggatgtgcggccaacgcctctgttcagcgatagtccagctgagaccaggacctgtgcctgatgcccaggccaccccacaggacggtcctccagcacctcatttctcctttcatcagacacctcttcactggcctactgggagaaaacggagatgagtgaaaatgtgcatacagaacatagggctcaaagggaccctagcaccagtggtgctcaagcctgtcccagcattagcgtcacctgggagctccaaaaacatattgttgccaagactcagtccaaagcaagtgacttccttggcctggagtgagatgtgggtggccagggtcaggaaccaccgagtgggtccacctctgcagactgggaaacagagtctgggaggctgcttgttccctcaaggacctgaagtgacatggggaggcaggactagccttggggctcctaattctgtcctggcctgtattccagtgtgccgtggggcacgtccaatttgaatctggccccagtacactctcaagccctgtgttgctctggtcccacagcttctgcccttgactttccatataacagcacattggtggccagggctttgcactaacctacctgcctccaacattgtttttgaataatggaagctaagcagatgcatattaatgcctgcattatggagaagactgtctcttcacaagtaatctgtagttgttagtcttgaaagtgggttaattcattgtctttctagagaaaatgattgcatggcctaatagtcttccagttagtctgtgtggcaaggtagaagccaggagtggattcttagctcctgttgagtgctgctgtcctgaatcagagatcttctctcccgggccactttgtcatgagcaggattttgaaccaagaccttttcttcacctgtctcgggggccctcaccgtgggctttgtgatcccctgacagctccaaaagcctttatcctcatccaatatctggtgaacagctgacacctcctgggaatctttaaaattgttctctaaagaaaccattctgctgcaagtacctatttttagactttataaagcccacgtcaggttgtcgctgcctttctctctgtctgctaagcctgctgtttgaaaggcagcaacaggatcttttgtctttaaaagttcagccccagctggtgcattccccacttgaactccatagccctggtgtgctctggggtacgtctcttccaaaacccaaaccacaggcagtgacctttacaccccaggagttgaaataatacacctggaggaagaaaataacttacaaacaatgagcctagagtataaatggctatgttttaaaaccctcgattttccttgggcgtatttaacctgtacagctagactgttgtgagttttgggctctctagggggctgtccaagttcagaacaagtgcatctgctggcagccagcttaaggagttagcagccctcaattccaataacgaacgtgtaaatcagaattcaggtgtgttgaagtggggccttgcacacatcctggtcagcccagggtgatttcctctctggccagtggttttggcttttttcttcacatgaactcgtctgttgtaactaatggtcactgagtgacttcagaggtagtgatagctcatagtgaagcccgtgacccacagcggtgggcacacctcgatcccttctccttttcctccatccccacctttctctccttacttcatcccttcctctttccacattgggtcatccagcagaagtcaagtatcttctatttcatatctttattgaataagagttttacgatccatgttattgaagtaggtaaatggaatctcttatgtggaattctctaaaaaagaatcaaaactccagtcaaaccaaaccaagtattccaaatcgtttttagggaaaaaagatataattagaaaagactggagagggtatgcaaactattaacattatgttagggtggtaggagtataagttatatttgctttttctgaatttctaaattttcttcaattaacatattgttcaaagtatcaaatacatagaaggaagagtgtgcatgcctgttatctagcaaacacacttcatgcaaagaaactctcctaaggaagtatgaagttatattttatccttatctatccaaagagagtgtgtgtgtgtcatatacctaaagaattagttattaagatgaagcattgcttataatgaaaaagttgaagcaccctaaattagcttaataatggtatatctttataatggaatagtataaagccattagaaatgatgttacagataagtatttaatgttatggaaacattttataacatagaatgaaaagtaaattgtagattggtttgtataatttgatctcatcttaggaaacacataatacagaaatatagatgaaggtctgaagggtattaatgccctaatgtattagtagcattacctcagagaagcaggctcatgagtgtttattttcttttcttctaactaagtatgtatatgtgtaagtgtgtctgtatacaggagatgtacatacacttttcttgtgaagaatctgtattgcatttactactggaagggtttattttagatttagatattaaagttacctctttgagtgagaacctatgatttatacttcttagcttaccttttacctccattatttaaatctgtctttttctgccatcaaatagaagatgtaacagtgataaaaaggctgggtatggtggcttacacctaaaatcccagcactttaggaggccaggggttcgagaccatcctgaacatagcgagtgacgtagtgagaccccatacctacagatttttaaaaggttagccagacgtggtggtgtgtgcctgtagccccagctactcaggaagctgaggtgggaggattgcttgagcccaggaggtcaaggctgcagtgagtcatgaatacaccactgcccttcattcagcctgggtggcagagtgagactctgtctctaaaagtataatattttaagaaagaaaaaacaaaaactagtgataaaaagaacttacaacaaactgatttttaagtggactgttgataattataagggctgagatttttaattgccatttgtatcaatgaataacccccctgtcaccacattttctggtgtgtttggtgtgtctggttcctataggagagacagtaatgctatttgacatgctttattgctgattagaagcctaatctctgtaatgggaagctcagtaatgaagcttgttcagaattgtgttacagtcggttaatgaagctctgagatcaagggcctggcttttgatggcccctatttcagaatccagaggtttgtttctatttatttgggttttgcaggtaagttccctggactgaggtgatctgaaggttagctctgctataataggtaaattgctaagaaaaacattggccttggtatgtacaacttaaaattttattggtgagatagtcttcttacaaaacaatcacgttaagctagaacttggtgtataaccagcatatatactcctgccaccctcagtgtgtagccaaagttctaaattgcatgcacagataacaggcatataattggtgatttcagaaaagttatacctggtgggcagtgagaggcgagccctgatctgggaaaccccagtgcttcaaggggaagcaatctgggaaactccaatgctgggattgggattcaatctgggaaaccccattgctgacaaggtacatggtacaagcttgataaaaacttgcttaatgtcacacttgtaatcccaacactttgggaggctgaggcagctggattacttgagttcaggagtttgagaccagtctgggtaacacggtgaaactccatctctacaaaaaatacaaaaattagcctggtgtggtggcatgcacctgtagtcccagctgctcgggaggctgaggtgggagaatagcttgaatacaagagttggaggttgcagtgagctgagattgcaccattgcactccagcctgagctacagaaaataataataatttaaaaaaacttaatgatgatagcatttgagttggcttttcaatcctggtttcctaaatatgtgagcctggaccattaaactgtgtgacaaggagctgtcatcttaacatacagacattaaatgcattgttcaagatcagaaatgatttcttggttctgaggcactattgactgtgtgtaaggtgccatcgttaatttggtaacaaggggagacagtggcagggaagttccttttgcctgtcttgtgataggcttcctattttctcaaaggttaagatattaaattgtcttaagcaaagaaggtatttaagggcatcatcagggttagttctcaggtctcctgactcctagcttctctagtttagtgattcacgttagcctttcaacagtttaccactcactttaatggtttttcctagctgtcttgacatgcttttcactgcttacatggttagtttcctacctagctgaatgcaggcatctgtgctgtctgctgggttcgctggtggtgatgcagcccacaggtacctgtctctttgaggggagttcagcaaccatctatttatgtcgaaaggcactgtactgggagatgaagaacacggagttctaggcctccaggaatttatcatcacttgctaatttgagctgagcctggcacttgaacataggccatagatttccagatgtgaaaaaaagaaagaaagaaagaaaaggatcctttaatgtatagacttgtctttctgcctgctttcttcacttctgatcattttaaacaattgatatcctagtttgatgtgatcatgttccaacacagcacaacagcatgtatggtttggggcatgcacctgtggcagttgcaaaggtttttacagtgaagtggctaagaggagagtaagaccagtgtatagggtgtggatgaggtcagatgcgagactatttcttgatttgagtcattttatttaggagctatttctttggaatactttatatatgagaatgtacatctgattggaagacagaaggtactgaaatttacctcttgatcaaattattctggtataaaattaaactaaataccaatcatatacttaatttcacagacttgcaaataatatactggggtaatggaagtaagagacaggaccttttatgtggtatgaagttctgtgataattcctatcttcctttgtacctaaaagaggcaccctctcctgtcatactgcaaacagatgccactactacgtgtagacacatttgccagctgtggcacagctggtcacccagccctcatcacagctgcctgtaaaacccagatttattctcttccccctgatcttttttagaaattactggtatcgttttagagagtatccaacttacacacaccacttaaataatgaattttccaatttcttctttttccacggccttcacgtcatctggtaaatattcccctcaggttggcatctgcttctgagaccctgctggacctagatatattcaccagagatgggtgaaggctttggaagagtgaagtggttaggaacatttcttccgatatctcctgctcattgtttttgacctctctgatttccagtatattctctgctccagccacacagctttcctgaacagctaagtcttgctcaccggtcagggaccagctcaaaggctgtccctttttaaatttatttcctgggtcttctcctggcctcttccctgcactcggtggagatgcctgccccatggttttcagtagcgttggctcttagctgttccgttctggggaaggattggttgttttccttttctccatgtgtgttgtgaatttcattctgtgtcaccgcatcacgcgaggtgggtagggaagagaacttttacgctccccgctgtcgttagtggcctgattacgagtctgtgggaaagaatgaaggttggaaagaagatctggtgggaaagaacaagggttgtccttgagcagccaaactaagctgtgagaatgttaatgtaataaagcaggaattctaatgggctgcctgctacagaggagatgggagatggtgtagggctcatgactgtaaaagcaggagccaccagcagatggtgatgcggcctcttggcccaggtgggactctgcatctccccctcccatggacattcacttgataagtgttgggccggtcacccatgccctggtcgttcttatcttatcgaagagtgctaatataagtaagctgtaaattcccattgtaagaaataattgccttttaaaagggagcattcaagaaaaagaccttttggctcaataaagcctttattttcctcaacactcttggctcttaaaaggggcctgttcttggccttgaagtgggaatttacacagaactttaaacagaagaaaccccctctgccttgggctgcaacttgttgtccctggcagggtttgggctgtggggtcatgggatctgtttgtttgaccgttgtatgcaaaaatgattttaaaattggcctccctaatctgttggagacattagttaaaaaaaaaatgagagtaaagaggaaaatattttgctattgggtatgcactggatccatttttaaactgagagaaggtgaaaggggtgactggttgatttcggataatacttttagagccacggggaactgtgaaagacaagaaaatgtaaaaaaagcacattgattgcaggaccggtggtccaaaagcagcacgtgaaagaggtttcaaggctgtttctacaaacaagaatgccaaaggtggcataggacaagaagcttgctggatgtcacgaagctagtggagatgggatccaaagctagttttggctgatgaaaatacaggctcatgccctgtatgtgaggacagtgggacagtaatttaaacagaagtatctagaggagtttccttattgccttgaatgtatttctttttaacattgctatggacatttaggaaaagatgccactgatattccaaaaggggcattccatacacctgagagggatccctgaggctccagggtcacctgggccaagccaggtatacacacgtctcatggcaagttggctgttatcataacttccctggtgttgttttgttgcaagggcagcattgtggggctgtggtttgaattgcttttttgtgtctcttgaatacacgaagttcctcctatagtcattggctctgctgcctctgatgaggcacttccgtgttccccacatttgaatttgctcccgattcgagagaggcaggcatccgcggcagcagcttccaacccagacaggcttaagccgcgcgagggtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctggtaagtgccaccgaaggttccgttccctttattactcgattagtgcccacagcatcaggagaaggttctcttaccgtgaatccattagctttaacccaaatgtgcaggattagggggattatttgaacttgcttgctttctttttaaaatgtccattagacattttttgcatgcttcaaaatcaaaaggcggcacagtgaaaacattttaattatttatgtatttaacctgtatcatcttgtttctaacctcttttcttcagggtggtgcagtcaaaaattacacagatattgctctggtgcctctccccccttttatgaataaattactgcatttgtcatcactgtgttcctgaaatgtcaaaaatagacactgtaaaggaatctgtcatgcagagttcagaaattttcaaatttctgagttcaaaacctcaggtgaagcgaggacagatcttttatttaaaatttgattctttgtaggcttcactgtgaaataagttcaatttagagcatagctaatgcaatcagccagctcgtgatgggacaacatacttctctattgttttacattcacctcctgggatacacacactttctcatttgttttataacctttacaggaaatacctggggatgagtcacatgacccctaacttgagtttttacatgtattcacccagattaaatgattttgctcttatatggataaacgtgcagttaggaactttaaaaaattgtaaatgaggtgcataatcattactcattgtcttttactgcattcttcagccctcaaacatacaaactgttattccctttaagagaaaataaaactggcacttatgttttcctttactctaagttaaagactacccatgttatgtgccattaaaaaagatgtagaaattaatctgtctttttctttgacctaatcttactagcagggatattggggctctacttttctgttctctctctctctttttttttttttttttttttttttttaacatcagccacaggtaatactctccggtaaacatataacttgaggaaaattgaattaggttaatgctggaatagaaaaccagggcagtgcctgctctttttggataattctgtataaacaatgagaaagtctcaggctgccttagacaaaggctgagacgggagctcctgatgatttttatgagggggaagaggagatggtgaggaggagggcaccgagcatgtgcagcaacttgaagcatgtcagaaagaacatttgccagaaatcttcaaaaccgtggcggtcggtaatgtgtgaaattgaacttctgaccctgtttgcttgatggcgacttctcgttgtgcttgagaattgtgtggcattgggtccctggatgtgggaggaacagcaaagtggtttagtgaatagagagggaagtgccttcctttttgggtgggacttgccatgatagagcctgggccgtcaccttaaaaggagatgtttctgttgagagatggaaaattggcaagacaaacgccataaaccttaacctgtttataattccttacctgtaagctgctttgcacgcaaggtgatggttctacctcataagggacaaggaagaacagcacataaacctgactgaatggagtgtggctgtgggtgggagcagctttacaagaaggaaacggggccccctcctgagacacccccgtttgcttctgctccttccttgccattgacgtgcccttctcctgaaactacccacacctgtgtttggcaacaagcggctgccccttgatccagatgcatttttcaacttgcgaactctcacctcttgccaagggacccaagtacctggttaatgatctttaatgtaaatgatcctttgccttgattaacattgagctgggttagtatgcacaggccgagctccgtggtcctcccatgtgatcccttccctgccagccacctgcccacctgtaggaactgggcatggccagttttctctttatgtgctctctttgccttggatggaatttgggctgagaccgatgaggtggaaccaaagctgttcagcagaagagagcaaccacagagcagcctgttgggtggagggcttgagggttcctaaaatccgaggactttctggtgagcctctcccctgagcctgcttgagggaaggcgctgccccacacactctccagtgggtgggggtgggggtggcagcggctgatcaaaggttctcacctgcaagtgataatagcctgggtctctttggcaccaacctgccttcttcacctttctgctcagacaccccttggcacccctacataaaggaaagagctgtctggatggcctagtaactgtaggataggtaaagttagccctttcttctgacctagatatgtgatggtggtatttctacatgtttatgtcgagaactttacaaagatgaaagaaaagctttcagagctgcagaaatgagaggtggcccttttttaaaatttattttaagaaacaacttttaaaaccactttttgaaaaattggatggcaccgtcctgcagcctatcagatttcccttgagaactggggattattggcttattccttgctacctccaatcccaaattaagcagagtgacatgtaagaagctggggacatcagcctaaagcgtttatcaggtatgtccttcccaactggatcttttctactccctggcccgaattttgttttagggaatggggcctattttaattgctggtggcaaaaggatccctgggcagtgtttccatggtcctctaaggtggagtgtcggggagctgggggacacacagtggtcatgggttatctgtcttggcctctttcccagaccaagttctgtctcatgcttattggtttggctgctagttatagaatctgatgtttaccttagaatcctaggatggaaagggttaagaatgatttctaatttgaattccttgtttctagggagttattaaacctatacattacatttattattttacaaagcactaattcataatagttgacaggaacaactattttttggcttctttgtttttttgtttgtttgtttgagatggagtttcactctgtcacccaggtctggagtgcagtggcgcaatctccgctcacagcaacctctacctcccaggttcaagcaattctcctgcctcagcctcccaagtagctgggattacaggtgctagctaatgtttgtatttttagtagagacggggttttgccatgttggccaggctggtctcgaactcctgacctcaggtgatccgcctgcctcggtctcccaaagtgctgggattacaggcatgagccaccacgtccggccttctttggttttcatattgattatattttctaagacaaatactcatttatatagtctaataaaaattgttaaatctaattaaacaactaataaaaatagttgtttaatccacgttgacatcttcttacattgcgatagaaattttgatatatttatccatatgatgaattgcttaaagccggtggttctcaaccagtggcagttttgccttctctcccacaagggacatttgacactatctggggacatttttcattgtcatattcaagggagtggggtgtgaagctggcaagcatctagtgtgtagaggcctgggtgctgctccactttctacattgcacaggatggcacctgacacacagcctaaagcgtcggtactggttgaccgtatacgaaatgctgtggaagaccaggcacggtggctcacgcttgtaatcccggcactttaggaggctggggcatgaggattgcttgagcccagcagtttgagaccatgtttaagtttaagttcatttaagttctctgaagtggtgattctgatgctatatagatgaaggttggtttgttgaagagctgactctggtatttcatccaacatctgcatttttctttagctaaggatgccttgagaaacattctagtctcttaggcctgaatttgttattagcttaatagctttcctctggttgaatttaaatggaaagaaaattgcatcttgcaacaggaaaaagaacattagggaaaaactgaggaaatggaaataaagtgtggaattttgttaataataaatcaaccttgatgcattaattgtgagacatgtcctgaaccaatgtagatcttaataataggggaaactggcttcagggtacgtggggactctatcttatctttataataattctctaagtctgaaacaaaaaagtttattaaaaaagcacaaacaaaattgctgccattttgttaacagatatagtagtcaatcttactgttttctttttctttgaaataggctgctgcaaaggtatgttctttgttatctcggctctctgctcagggtagccatgaaatggctcttttaaaaatgtgcccagataattttgaaccatttcaaaccatattatgtgattttaatttattttccattgcattcactaactcatttctgggtgatgtatttaaaagactagacagaatttacaggtttaaaaagttacattaacagaaaatgtaggtgccagttgaaatactgtcaactggaagtgctaccagcaatgtgctagctggacaatgggacttgtcccatttttttgctgggtgacagctatcactgcctcagggaggctggtgccatttaatgcctctgataatcagaataagtaattgtggcttctgggtctgtaaagccacaaaatacatatgcaggcctattttaattgacggtaagtcatgaaatacactattttcgtattaagataacgtggatatgttatggaacaaagttaaaaattagcatgaatttttaaagtactactggagattgttggctttaggttcgtgaaccccattcctgcccccacactcctgttagtggggctaccagaggggccagtatgaaaagcactggacttacagatgaaagaacttgagctggaatcaattcgagtcacttaccttcgctacaggtgggcagaggagtcatcctgcaattttgttgtgaaaacagaatgagataatataaaatgtatttgaatacagtgaggtctgtacagatgctgaatctattactttgcagtaggagtcaggtgtggccccacttccccaccttcttacctacttgtatcttagatcttatatatattgatattcacttttggtggactaaggttgtctttgttgcaaacctggactctcttgtattcttgctcagtgtgtgtatgttaatgttagataaagaagattaggctggtgcattggctcacgcctgtaatcccagcactttgggaggccaaggcgggcagatcacttgaggtcaggagttcgaggccaccctggccaacgtggtgaaaccccatctctactaaaaatacaaaaattagccaggcatggtggtgcctgcctgtaatcccagctacttgggaagctgaggcaggagaattgcttgaacccaggaagcagaggttgcagtgagccgagatcacgccactgtactccagcttgggtgacagagtgtgatcctgtctcaaaaaaaaaaagcagaagattatttggaaagctatttttaaattattcttcaaacatatactaaaatagagaagacaacatgagagccaacagcataatgaaaccccatcactcagcctcaaccgttgttaacagtttactatctttattgctactgaaggcagttaaatatttcttggcagtccttttttatttagcatataccatcagggatgacaatagaaacaggtttcaaagtcaggtgaaataatgtttctctatatgagttcaccactaacttgatacacagtttatgtttatgtttatgttcttattacgttcgtgtattaaggcaacctttcatccctgccccctaataggtaactgtctttatttgttctgggattatccctcctccattgccctttttggaaagagtatggatatatttgtattttctcttactcataaagcagcacatggtacatactgttctgagccctggttttctttttttcacttagcgttgtatactggaactcactcaatgtcagtatacagagaattcccttgtctttttataactctgtgctatacgctgacggaagttcattcagtcagtcccctattgatggacacttgagttattctcagacttgtccattgttttgcaaaaatagccctgggcatatgtcatttggtatttttgtcgaggcattccaataaaaataagtaaattcttcctctcttgccttgaagatgtgcagctcctcagtaaccttttattctctaaagctctgtcctcatctttaatccctgatttaagaggtgcagctcttcaggccataaacctttcttcctgcctcaagtttttaaagctacaaaggaacctaagagatcccttgtgttttacagctaaaggacctgagagcaggaaacaaagggagagccggaagcccaggtctcctgttccctgcctggcaggtgatattctttctgttaaactctctttccctctgcctattattggccaggctgtcctccaggacagtgcttgccaaagtgtggtccatgggcagcagcatccccggagctcatcagcaatgtaagatgtcaggccctgccccagaggggctgagatagaatctaccaattactggattccctgggtgactcatgcagtcaggttggagaagcgctggactggtggctttctccagaggagcatgcaacagcggtttgcaaacagggatgatgcagttccttttcaacacgtggatttgcacttcctcctggtgcgctcctccagcctgcctgtcctgttcacaccagcctccccctggaaggggttcagacttgatcctttgggtggtagggtctttcttggatagcgtagccatccattcctgctgcatacattcaacacagccttcatccttcgccatttgtctctgatacttcatactccttttgtttgacaagtgccctagctttatttattttctcatcattgttgttaagggcctattgtgcttgctagtatacacaccactatgtaagttactagttcaatttatttgttttactgctgctgtgaggtgtgtccatgtgtgcacatctacctgtgttaataactgataatattgggcctcagtacatactttttttttttaagagacaaggttttacttcgtcacccaggctgaaggactgagacacacttgtagctcactgcagccttgagctcctggacccaagtgatcctcccaccttaacctcctgagtagctgggactacaggcacacaccaccacaccaactaatttttttattttttgtagagacggattcttactgtgttgcccaggctggtctagaactcctggcttcaagccatcctaccacctcagccttccaaagtgctgggatgataggtgtaagccgccgcacctggccctcagtgcatacttagatatacttaaataaaaacttaattgcaaattacttcttaaattatccacaaactgacttggcagtaaaagtgactacaagtagtgaaaccactgtcataataaaaataaaataaaagtctttattgttagatttagtatttctaatctcttacatttcagttttggaaggtaaatttttgggaagtggtggtaataatctaagtatgtctagattcagtgatgagagctagtacactgtaggaaagagttgagcataacaatatggaatgttggtaaatgtataggggttttctttttaaagacagctttttatacaaagaaacagatgatctttttttttttttctaaactatgttagctatacccaaattagtaaatgttaaaataaccatgactggtaaaaacattttgcaattttttttttttttactttttatataattaaatgaaattctccatttggtagttgatctctcagacaaattaagtcttgccagactgtctgagaagactagtgaatcagaccctaaaaacttgtagcatttgaaaaataacaactgtgtactgcaatttataagggcataattagagaaagtttttcagtctgaagatttatactaatcttatcaccctggttttagagaacccagttcaatccaactgctgtgaaaaagccactgcttttagccacagaaaataaccagtttcatagaatgacttataataaaaaattcaaccattttgactccaaaaacctagctggccgggcgtggtggctgacgcctgtaatcccagcactttgtgaggccaaggcgggcagatcatttgtggccaggagtttgagacctgcctggccaacatggtgagacccccgtctctactaaaagtacaaaaattacccagacgtggtggtgtgcacctgtaatcccagttactcgggaggctgaagcaggagaattgcttgaacctgggaagcggaggttgcagtcagccaagattgcaccactgcactacagcctgggcaacagagtgagactccttctcaaaaaaaaaaatgcctagctgactttatcatagatctgtctgtaccttgtaggcacaaatatatttacaaaataattaatggtgatttacttattcacaataagcagttattttgcttttggtgtatatgtgacaaggtggttatgtggagtacataaaggagtaaagtaagtccgttgacttcaagatgcttacagtctaatagaaaccttgaaatttccactgggcaaggttttcttgggattgctccaaccaaatgaatgagcaggcgtctaagtaaatgaaaatcactctcatcactttccttcacattatgttaactggtgacaggtcatgacgcatgggaattgcttatgtttctgagctttagtcttataaaaataagtttagatagtccatcatgttcttcacattagacactcattacataaaaggttttatatgtattgtagatctttctgaaggtcatctatgtgaatgtttaaaaaagaagcaagaaggtgctataaaaagcactagaggtcaaatggtttgcgagacaaaatgaaactctccagctctgaaatccaacagagtatgatgaagaaagggaaaaaatagatcaaaaaatggcaggggaggaactcggcatcaaaccagtgataaagcagaatgtggatcagatccagacatccagtagtctgtgagcatctccatatgggatgtttgggttgagagttcaacccatcaaatacattttatccataaccataagatattctaagatcgaccaagtagagtaagcaatgtagaatcaaaggtatcatctttattatgtcctatttgtgtttcctgcttttgaggttcttagtccttttaattaactcctaatgaactaatatagttttgtggtcaccagcttctagctagcacaggcacagttgtgggttggtaggagaatgagcagtaaagccatgagctaacacaccaagtaatctgttgtgttcacaaatgtccaagagaataacaagagattaaagaaaggtaaatacagccacctggcaaaaatatttacccttttaaaaatgatggaagttatatatagaagaaatgtttttggtaaaaatatttgaaagtttgttttataatcataagtagcttgggctattttgactagaggggtgtgtgtgtatgtgtgtgtgtgtgtgtgtgtggttggcagggagagaaggagggaggcaggcagctggtagggactgtggagtgtgtcagttgggagagggaaatgagatgattaagttagtaagaatagaaaacatgtaggaaggcggatcttgaaatttcagggctattcattagtcattagttgaagatttcacagagaaatggtagaaaccaccagtaattaagaaatagcattattgtttaaaaaaaaaaaaactcccaaaccctttccctggcattctggtagaatatagttttggtctaacccaggtcccctctcatttcctttcacatccccttggttctagccacgctagactgtctgggttgtctgtatatgttctgatgtttgttttcctctgtgctgttcttctggcctcagaatcctagtgtccttgtgcctccttctgcatatgtctggactttgcttagctgatgagatccagttcagataccaccttctgtacaatggcttccttaattcctttaatttctcttaattgcaataaagctatttgcagaggaatgaaagatgctcccctttgcgctgggtacaggatgcactgaaactttcagcatggggcgcggtggctcatccctgtaatcccagcactttgggaggccgaggcaggcggatcacctgaggtcaggagttcgggaccagcctgaccaacgtggcgaaaccctgtctctactaaaaatacaaaaattagccaggcatggtggtatatgcctataattccagctacttgggaggctgaggaaggagaatctattgaacccaggagacagaggttgcagtgagctgagatcgcaccactgcactccagcctgggtgacatagcgagactccatctcaaaacaacaacaacagcaacaacaacaaaaacccaaactttcagcaggagagtagcttggttcagcccagcaacatcggtttgaagattatatcaagttttccagtcaaatgtaaccagtttatggatctgtgtttgcacggggtctgaacctcccctcctcaggtataagctcttggaggacagcctgctgcttaaggtacaggagaattcatctttgctggacatggtaacgtatgcatagagatctggcaacagaacttaagatatgtgggagaaataataggcaaaaactggaaagagcacaagtaagagaagagaaatccgcagaagtgagaagtaacagaattgctggctgaggttggaggcatttaagtgtgtgggtgtttgtgggaggcatggtggtctcctgttccttgacctcattgggcaaatattacagcacgaacatacaggtaggaatcaattgcatccccacctgggcaccttcatcggcagttggggtacaccacttgctacagtgtgatggaataagggacgatccaaaggcactcagttctcccacccatcctgtgcacaaggaaaagacctttgaattgtgtctcccctgttgtcctttgcattgtgaaagtgcatattagttctcccatccactcttttctctttaagctttagcatacggttgtttgccaagaatggaatcagatagaatattttcaccaggaagtgaaatttaaagtgcttgaaaaagatacaaggatatctggaagttccagccggcgccattttatattttaaccatgacaagtagctgtatatcacggaactttggaaaacagagattgttccatttatttttcacagatgaaaaccagagtgctgtgtggggatcaggaagagggaaatcaaccaaataccttattttagagatttttttttttttctgggaaattggaaacagcgcttgtttatagccaatgcagcgtccttgaaactctcctacttacagttctggagctgtagtttcctccctgaagaatgggttaaggcaggcagggtaatatgcatagatgggagtgagagtggatggcctacagggttgttaacctctaagtgcaacaggaatatatgaaggtacttgggctggtggtcctgtgcagaaccagccagtaggttctaagagacttgatagccgagggtccctgggccctgttccacctttttaaaatttctatgacttagtagcggcagtaccatgcccatcccccagtgatgtttggggtacagctgcacccttggccgtgcctctgcactcactcacgagtgtcatctgacatctggctcttgaccaggatctgaggttgcttaagcaggatccaggtcaggttttttgttcatggaaggtggaattttggacctttcccccaaaaagttgacataacttaaagagaagggaggtatattgagaccagcctggccaacatggtgaaaccctgcctctactaaaaatacaaaaatagctggcatggtggtgagtacctgtgtagtcccacctgctcaggaggctgaggcagagaatcagggggcggaggttgcagtgagccaaggtcatgccactgcactccagcctgagtgacagagtgagactctgtctcaacaacaacaacaacaacaacaaagagcagagtggtattatttcctcactggaacattaaatggttcctactaccaaagagttcctgttctaatgggggtttaatataatagtaacattttattcactgggattcactcgggggaaagtattcaggaacaaagtgacaaaattaaatataggacatatgaacattgtcattttggttctagttcttacaagggcttatggtagcaacccaaatagaagtatttgctctaactaacagataaattattagcacttcagttgtttacatatgagtcagagcatctaaaatttgttcccataagtaggttgagcctccttctcagcctgttgtcatagggtctaaaaatggaaacgtgagtccaaactctttccagatcataaaaataattctgaattagtagagcataaatgaatgtgattttattcgagtgtcattttcaagttccccaggccaggttgagaccttttaagtcatccttaattccctgtagggaggattaagaaaatagtagcagctttgcttctggccttagacagttttctaatgaggtcagagcctctcaccctgggagaagcagattcactttgccccttcagcattggtttttgagaattgctgtctgaagctattgcatagacaaggtcactttttaaaagggtacatttctgaacctggagaaggagtgggttctgaatgactggctcttctgattaacagagctgtatatcaagctgtgctgaaaatactcctcagatatattaggccacatttatgcatgagtgagctcactgtcgtgacatgggagtgaacctttgctgattcgagatcctggggtgccttcactttggaacactgattctagatatttaatagcagttttaaaattaggctaaatgtagtctgactgcaggattcattccagtgggaatttttttgtttgttggttagttttttaagcctgaatatgaacccaaacatgtttcccaaaatgtgaaatgaagagtgaaaacctaacaatgggataagaaagataatagataagagattatagttcaaactcggcctgcactcaggaaatggaagcaattcctccccctcatcctgcccccctcctcttcctccacctcctcctcctcccttacctcctcctccactacttcctcctcctccactacttcctcctcccccttcatcctccacctccacctcctcttccacctcctcctccccctcctcctccccccctccccctcctcctcctctccctcctcctgccccctcctcctcctcctccacctcctactgcccccctcctcttccacctcctcctcctccacctccccctcctttacctcctccttctctttctgcacaccccacccccgcccccactagggacagtttactcttccccctcctttcttagaatgccaacaactagcctgttagttccattacttacttgccttgtgactcataacgttttcatcttgggtatttttctttcttggtctttgtaaaaattctaagcatcatagagcatatcacctggagaaaagacctacgttcattatttaatgaaggtaaaaagtaaagaattgagtctgcatcctaagaaattagaaaaagatcaactaagtaaacaaaaaaatataaaaactaggagggaggaattaggagatgataagatttaaaagttatgtaaatccaatagctggttatttgaaatgaccaataaagtaaactctcattatcctaactcaggaacagaaagaaatcatcctaacttagaactagataataggaatgagaggccgggcatgatggctcacacctgtaattctagcactttgggaggccaaggcgggcggatcacctgaggtcgggagtttgagactagcctgaccaacatggagaaacccatccatactaaaaaaatacaaatttggccgggcatggtggcttatgcctgtaatctcagctactcaggaggtgaggcaggagaattgcccaaacctgggaggcagaggttgcggtgagccaagagcactccattgcactccagcctgggcaagaaaagcgacacttcgtctcaacatcaacaacaacaaaaaagaaagaaatagataataggaatgagaaaggagacacaggagatatcaatagactttataagaaaacattacatgcagccctgtggcaacacatttgaaaatatagggctgacttcttaggaaaatacaaattaccaaagttgatccaagaagcatggaaaagttgaatagaccaattactatagaagagataggaaagatgattaaaagttaccattgagaaaggcaccaggaatccatggatttccagctgaggttttgtttgtttgtttgtttttggagatggagtttcgctcttgttgcccaggctggagtgcaacggtgcgatctcggctcactgcaacctccgcctcccaggttcaggtgcttctcctgcctcagcctcccaagtagctgggattacaggcatgtgccatcatgcccggctaattttgtatttttagtagagacggggtttctccatgttggtcacactggcttgaaaaaatagaaaatttgagtgttatttttactcttccaggacatactaaaacatggaaaggttcccagttcattttataaaaccatcaaaattttaatttaaaaatctgatgaattaaaaaaataaaaataaagatcaatattatttatgaaagtaaatgtagaaatttaaaataatttattaacaaatagactcttgggtgcatcaaaacacgaatgcactataatcaatagttattttccagtaacaccagggtgattaactgttagaaactcatcactatcatcagttgttacacaatcatattgaaggagaggaatatatgaataagtcagtagaggctagaaacctatctgaaaaagtttagtagccattcctaatatagtacaatctgagaaagcgaactaggaataaaaataaattacttaaacataaaggccatatatgtgtacacaaacacacacacaccacagcaaatatttcctaaaagacaaaacactaaagccattcaattaaaattaggaatgagagaagaatcttacattttacaattagtatttaatattatcttagaggttcttgtgagtggagtaagacaatgaaatggtcatatgtctagaaatcgcaagagcatctagtaaaaaatctaaaatcaacagaaacaattgtcaaggaagctggataaaagataggtctctagaaattatcttttctgtgttttgaagataagcacctagaaatggaagttaagtatttctttcacaatagcagcagataacctaggaagacattgaactaatacctgtaaccttcttagtgaagaatgtgaaatataatctagagaaattaaaacatgtaatgcctgaatgtatcttattacaaaattaataagtaaatttcttgtgattccggttagaatttccaaagtggtgggttttctctttaattgaataaaataatcctgaagtctttatagaagaataaatacgtactacctgagaggagccaagacaaatatggaaaagaaaaccggtgagggcagatttggcttacaagtaatgacaacatgctaagaataagaagtcttcgtgatcaaagcaatgtggtattgatccagaattacataaatagttcagtggaacagactagagaatctaggactgtgtctcattaagagagtgaatgtataacaagatgatagttcagtactgttgaggttggtactggcataaccagttctttatctggagagggggttgggggaacagcacagacctctatctaatatcataatcagtaataagtcccggaatcttcaaacacttaaatgtaaacaagcaattcaacttttacaagaaaatataagaacctattttgtataatcttggagtgagggagaatggttaagcaaaatttgatacgcacaagctataaaaagagacacactttgaacatatattttatttttatttgtttattttttgagacggtctcactctgtcaggctggagtgcagtggcgcgatcagggctcactgcagccttgacctcccagactcaggtgattctcccacctcagcctcccatgtagctgagactacaggcaagactcactgtattagttctcatactgctaataaagacatacctgagacggggcaatttagaaaggaaagaggtttcacagtttcacatggctggggaggactcacgatcacgggtgaaggtgaatgaggagcaaagtcccatcttacatggtggcaggcaacagagtgtatgcaggggaactcccctttataaccatcagatcacatgagatgtaattcactatcatgagaacggcatgggaaaaacctgcatctgtgattcagttacctcccaccgggtccctcccgtgacacgtggggattattacagttcaaggtgagatttgcatggggacacagagctaaaccatatcagctaccatgcctagccaattttttgtggagacgaggtttcaccatattgctcaggctggtctagaactcctgttctcaagtgatctgcccacctcagcctcccaaagtgctgggattaacaggcatgatccaccatacctagcctgaatatatatttttaaacttttctgtggcaaaagatacgtgattaagtcatagatcaagaagggatatttgaaacagacatggggttactatctataacaaaaaacttacaaattgttaagaaaaccacagaggaaaaatggacaaagaatgttaatatagaatacacagataacaaatgcagacagctagctggcaaacctatgaaaaatagttcatttttgctagggaaatgcagattaaacaatgagacgttactttaaacccatcagattggtaaaaatagagaaaaataacactttttgatagcaaggctgtaatagaagtggcaagtggtattatttctcataatactgatggaaatgtgaattatgggcagttgggaaattgaaaagcagatgggcaatgtatattaaaataaaaaactatcatacctttcttctaagcaacctttgtcctcggttatttgtcttttagaaataaaaaatgtgtgcaaagtcatatgtataaggatatttattgtaccattatagtggcaaaatactgaaaatatgaaaacccatcagttgaaaaacggccaatttatggactgtttgtaccatgtaatattatgagagaactagagctgtatgagagttggctgtggaggaatttctatgagaacttgatgaatgagaagcaatgtgtagaaaaatgtataatatccagttctaaaagacgcattcctcctgtgcccatatgtgtaaatgtgtgagtgtggagaacaagatgaaaatgctcattctgtatgttaagcagggagtggggtggaggttaatgtggaatggtgggagagtggggtggcagggatttccaagtcactcaccagtgatgagtgttaaccacatccccatttttttcctatgaaggaagctgcaatgctgtggtttgaggttaaacatgctggctccttctcttaggtcttgatttggtttttgttgttgttgttttttttttaattctagtctgttcttgttttgctgtgctgatatcctcttagattttacgagcatattaattgtgagtatttaacattcttctttggtttattctgagaccccgtttgcctgccctttggcatcattggcagtttttggtggtctactggtcttcctgtttgtgcctctcgtttgcccctttttcactggaatgtgccaggttgaagcaatatgtagggcccggtgggatgggccaggaggtggcctttcagatgtggctcctgcatggccctgcttgctctcttgagctgcctgcacttcagtcttaggaccacattcctgctttggcctacatgaagtgcaaggtagcagtgggaaaagcagagaggaaatgaagcttcctgataaatcacctgatcgctgccccagggttagtcactctagcccccttggatctcttgactccatctcttgatttgtttcttttgaatttctggcatctggagaatacttgtacagcagcagtcccctggttttgtttttctttcaacccaagcccatcccatatctgttcatgtgatgatactgtgtcttattttcccaagattcttatgactgtgatatttagtctgaatcagagaaagagagagatagaaatgtacactcagagggccacttggatggaaacttctgttgatctctccaagccttagtgggatcatctgtagagcagggataataacagcgcctatctgttactgttagggttactgcaaagattaaaataggtggtgctcttaaaagacttagaacagtgctgtcatatagtaaggattccataaacattagctgctcggtttgtgtgtgtgtgtgtgtgtgtgtgtgtgtgtgtgtgttttgttgttgttgttgttttaaacgggatcatgctggaaatgatagattgcaacagagctttggggttttttctctaattaatagatctaggatgttttctgaggtgtgtcatgtttttaaaactctgtggtatttctgtttctttctttctttcatttttttttttttttttgttgttgttgttgagacagagtctcactgtgtcacccaggctggagtgcagcgatgccatctcagctcactgcaacctctgcctcccaggttcaagtgattctccttcctcagcctcccgagtagctgggactataggcatgcaccaccatgcctggctaatttttgtatttttagtagagacagggtttcaccatgttggccaggctggtcttgaactcctgacctcaagtgatccgtctgccttggcttcccaaagtgctaggattacaggcgtgagccaccatacccagcctggtgtttcgtgatatatctatgtgtgagggtttctgtagttaagttcccatagttgaattcctggttcaaaggacaagaacatttacaatgttcatagacgttgggaaattgccttctgtagtactgcactagtttccactggctgtagtggttgatgagagtaccagtttttccctagttcaatattaacccattttatcagtcttttcatcttcgacattatggaaggtaaaaacatctcattttatgtcttcagtcagtgatgccaagtatctcttcgtgtatttatatttccatttttatccagtgccaactcacatccttctgtcaatttttcctttgacctattaatttttcattgataagaattctttgtaaaatgggcagtttaactccccatctgtcatatgttttttctcatttgatttattgtatatcttgtatagcaccttttaattttaacattgtgtttttaagtgtcttttctttgttgacttggaaagctaacaactacttacagcataatttccttctgttaaaaacaagaaggaatttccccactctaattgtgaaaattatacatttttctaagtctgaaaaaaaatagaggaaaaaacagaaaaaacaacagaaagaacatcagtcactcttaatattttggcattttccttttagttgttttttaggagagaatgtatatttatacttcgcatcataacatagatatagtctattttggtgatttattccaatatgtaatatatgtttctgaatgtacaatatcctatttatcatatctgttaagtttgtttccagtttttcatttaagagagaaaggtactgggaatatctttgtgcaaaacaagaatttttttttttttttagtcagattctgttcctatgatacctccctggaaatgggattcctaaattaaagaatattaggatttaaatacttttggtatagattaccaatttgctttcctaacgtgtggtactagtttatgttgcaatcagcacaaagactcactgtgccatttatcatcagcagagaagagagcagccctgaagatttgggggaggagtgttcgtagagaggcacgtgaaagtgagtttgagaggtttgagaagtagccaggtcagtggggctggggaagggagagagttcatgggggagggctggagatgaaggtaaaggagccatggttctttagggctgtgtgggtgctggggaatttgcatttcctgcttaaggttgtagtaagtcagcctggagagttgcaagaaaggagtggcttggtgtgatttattgtagcaagtgagagtgacccagaggccagttaggaggctgttgcagaggcctgagtgagagaggatggtttaaacaccaaaatggtaacattcagaatggagaggaggagatggtgggagattaaatttggggatggagcccttaggatctgttgattgactggatgtgtaagagagaaagggaagagcagaactgaggaaatgtcctcttgaactggctgggggccactgagatgggacagatgcgctggggagcagtgcagaggtggaatcactgctccttttaggtctaaggcatcccttagatctccaagtggatgtgtgaagatggtggtagaggagaatggagctcaaaagaggggccagagtcatttccatttagatggtctttacagcctaaggaactggcagatttcactaaggttgaggtctttctttcctgtgaaaatgtgatcaggatcctaagtaacagccctaaaaattaaacattaggaatacaaggtttcataaattaggaactgtctgtagctgccagattctaaatgttttgaggatacaaatcttggggtcttttcaaatgctttgagcagaagaggtacatcgtattgtgtttactgaatggcatttaaagatgcaggagacctttcccccttcttgatgaaacaatttgcctttcagatgttttgttatagtgagttgattgtaggaccttatgaagcatgtaaaccacacatttgtaaggcattggaagaaaaagctaacgcgagttaggagggatttaagaccatgtgaggaaattcaagcctatgttgttatcaccaaaccttgcctgtgttatgtaaagatttttgcctgtgtcatgttatcttcgttgtgttcaatttattcctccccctccaagtgtcctagtttctcctctactgtagctggttttgaacaaaatagagaaacttgggtctcctctaccctcagcatctgaattcttctcatttggttactcactgtgttaaaataagtgatatagtacattcttagcagtttgtttatttttaattttattttttatggggctagggtctcgctctgtcacccacgagtgtggtgccatggtgtgattgcagctcactgcagcattataactcttgggctcaagtgatcctcctgtcttagccccacgagtagctggtattacaggtccatgccaccatacccagctaatcttagcaatttttaaataacttttttttccgactgtaacagatttagatattggaaaagataaaacataaagcattgatctacctgtagagccaaatagccacagggatataaattggttaccatttaattttatttccatctatatttggctatatttatatttatgtatatggaaatagtttatgaatttggaatcatactatgatattttttagaatgatgctttttaaactattttatggtaagcattttagtaaagctcgtaatgttatttttaaaaacgtacttttcgaaggctgcagagtatggataaattcatgatgactttttagaggaaaatatcaagatgatctcactaacaaatcctgagattaaaaacaaaagcaaacaaaatacaaaaactgaaccatctttggaatactatgaaattcagattttatgttcttaataaaatcctgttttgaatgaaatcagtcttcatgcttttcttattccttttggctatgttgcctacagttgaattaactgtttttatatacttcctttgctttgcattgaaacaagctgatccattgtgaccctttgtggtatttcataaaaccacaccctaaaaactgcccagtcttttaagtgtagtcaacagtattgagcaattttttgggtaatattgtcggaagtgttaggtgccaaccaacaatggcttattgcttacatttaagtgtaagcaatatacaattaaaggaatgtcatgactttttaacttcattttgaaatttgagtttagaaaaaattccaagggaaatgagcaagaatgaaagcatcctctcctactgccagacttctgggagacccacccctggtcttcccaggtgtctcttcagtgaccttgttggtcgttgagggctgtggaaagttctagggaggctgctcgtccctcctctccttttgcttattgcattctgcccagattataaaactgaagtatctgtcttaagacgccagcagctttttcttcatcaaatccagacacatcgaatcccccacaaccaagaattacccagccacaaaatgtcagtagtgccccggtaaaagaaagctggttttagacttagtctcagaacctggccatcttccatggattatcccgatatgtgcatccttgtctcttttcactatagcctggtgatcatggtggcagttttcattttgggacactggtgaggttagaatagcttcaggcttccctcagtgaatagtattgtgaaggcagtggtggtaacattgtgttggagctggtgtgagggttgaatccactctgtagcctctgtccctagatcatggcgctgctttgattgggccctaattttctcctctagacaaaaggaattgaactaagacttccagcattccctccaggcttaacattttttcatttggtgctgatggtcactgactattttccagttacattttaatgcaagtttggcagaagccgatttctctgggttagggaaaatgacataggtggcagggaggtggatgtacaccatttgtttgatcagtttgcctagaatggaggtggcagaattggagttggaaagatcaaatgtagcctttttttcccttccagaatgaggcttttctatgcatttttttgaggcatgagaacctcatgggacaaggcaaaagtgagcatactcaagtgaagtgtatggttatgggggaatggttattagaaatgtcaattgtctcaattttttagtattaattttcagagggaaacagtggtgtaattagtgttgtgattgtttgccagggcggtcgtaacaaagtagcacagactgggtggctcaactaccacaaatttgttttctcagggctctggatgtccggagcctgcgatgaagcaggattggcttcttctgcggcctctcttcttgacttgcagatgctcctctgggtcttcccaggtcatttgtgtacctgtgtccgtgtcctaatctcctgttcgtataagggcacagtcatattggattgggacccacctactaacctcattttaacttaattacctctttaaataccctctctctaaatacagtcaccatctgaagtattaaagacttcaacttaggaattttgggcaaatacaattaagcccatcacaatcaggtaacatttggtaggacgtgtagatgctttttatctttaagggaataggcaaatcgttaaaaataaataaataaaaacttgttcaacttgtttaggtacattttcttatagtgtattgtggttcttatttttttaaccttccagctagtgtgtaaattggaaacattgtagcttaatttgatagttttagacataatcaaagatgatggaaatcttgttcttaaatttagtctattcagcaacttgtgtatcctcaactgctgaagactgaaaacttgagatgttcctcttgttttaagaatttgactgaaaacgggctgggcacgatggctcatgcctgtaatcccagcactttgggaggccgagatgggtggatcacttgaggccaggagttccagaccagccttggcaacatggcaaaaccccaaaaatacaaaaattagtggagcgtggtggctcacacctgtggtcccagctattcaggaggctgaggcacaagaattgcttaaaccccagaggcagagactgtagtgagatcgtgccactgcactccagcctgggtgacagagtgagaccctatctcaaaaaaaaaaagactgagaatggttggcactgtccccctgtctccaggagggtgaatgtttctagctgaaccctggtgcccacttgctcctctaagccttcagcagtcctcccagcctcaaggggtgatccgttcatcttccccccacctctggaaatcccagcgtttgaacgctggggggaactgcaagtctagtttacagggtttctcagctgagatgccaggaacacttcgcgagtgagcatgccaccacatttgagtgcatatagaaagttagctgtttgctacaactggggacacttcctattagagccgcatctgctggggtggagggctgcatgggttggagagtagggtgtgacttcttccagcaagaggaaagagaagtagcatagtgcccatcgcaggcagagagcacatgtttgacttgctcttggaatttctgtagagtaagggtggtcaggttgccagactacccctcaaacgaggacatggtgctgctgggtcccagggtagagctctgctggcaccttcaaggccctgatttacacctaagggcacacaactgggatctgaaaactgggatgcacagtacagactgcagatttacagggcggggctgtctctcatctgactattgattcttttgggggctgtagtttgtatcatagttatttttgttcctgtttttttcccctcttcaagacaataagcttttggagggccaggaagttgtgttcccatctgccgagtgtggggcctcgagggccagaacctcagaatgtagaagctgagttagtttgtggcagggtgaagggctgacctctactgttggaaatgccaaaatctctgatctggctttaaataagcaaaacagccccgccagacatagagtcatccacaaaacctcatgacctctgttattgcccatcctgtgtggaagcccactgagaacttcacttgaagatgctgcaggaacaactgcagggaacctggagataaggccccgggtgatgatgtaagctaattgctgagctgggtggagctacttaaccttatggtaggaggtggagcttgacgcaacccccttttccaccaacaagcatttctttctacctgtcattgaagtgaatcatcagtataagtagcgagctgggcgcattccttctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtataggtaagaacaaagacaccactgtatgtttgctatatgaatgcataacatctgttcttggtgtgagtttgatgttggtttaatactgtttttatgtcagcggcatagttctagcatgtaccaagattttcaattttaaatgctttttggtgttcacagttagctataattggtcaattttaccctccttatgcataaaaagaatgataggcaaagaatgagccttgaaaagaattgggatcagaattctggtcccctgttctttgcttcttaactttcttgactgtttagaaaaatgtacagcttttcttccaaaaaccaaagcaataatacttttatttttgaaaataatggaaaacagagaccgctgaagttctatgaatgaggttttctgttttagaaatcacaggttgaggaggaaagaattgtgttttccttcctgttctgtttcgagtctcagtatttctgacttagaaacctcctggagaagagggagataccagctctcctttgtttcaagtaaaataccatcttaggtcataaaatagtttgcttggagaataattcatggcttatatctgaatttttggttggtagcaacagaaatctttctcttcctcggtatgagtaatttggcttacatgatttagactaaattttattatattttttgtttgagaaaacaaaagtcaaagcccagaacatattcaactgagtttttccctcaggttttctatcattttcccacccttcctactcatacatgtgaatatgctgaatgattaacatgtgatttttgtttctttactgtctcatttcatggtgattcataaactgttagttaactggttatagtgtatccatatgttggcaaagcttgaaataaatttgagtgcaggccacaccttcgtattaatgagccgggttactttcagtaaagtatttctgatgtcattaagtgttaagatggccggaattctaaagacaataaaaatgtatcaacaatatgaaatatcaaagcctacagtcaaatctgagttattctttagtacttatttcatagctattctttaatgtttattctttaatacttatttcacattgaaaagtactttacacatgtttgaatgagatattgccagtgaaagaaacaaaaggaagcaaataactctataagggaagtgggattttaaagtatgtttgtgctggccccaggctggtgagtgagtttcattagcaatgaccaggaagagaaagaatgccacagtggtgggtgctgaccttttttttttttttttaaaccttttttaatgtctgtaaggaatacaaggtgaactttaattcttgtgggaatctagtaagatggaagtcaagaagagaggaagaaatgctttttatttagttaagaggaagtaaacatctgtattagttacagatgttatgccttaacctttttcattcctattgtttttatgaaaatttgcctttttaagttaaatgaaggttttctggagtcctgtattgcaactaaatgttgatttaaaacgacacatttgggacattttcttggcactgtggaatataatgaaaagatataaaatgaaggcaggtatgaaattatatgaattctgctacttgagtgtagaagttttattccaaagtggtttgtttggtggatgtggtgatggtggggggctctatgtacttattaaggcaagtgatgggacaggagcttttgtggtcttgacggttctgttgggatgggagggttgtttgggatttttatgtttcattccaggcaatgtttattttttcagcctgtacttcttagggttttaccaagtcagttttcatgtgaagccattttcatatcgtttctttcaccttgatggaaatcttttccttcttatgtgctttgagttaaatatgatgtagtgtgctagtaacatagacggggctttcctttctacaggtgggcttgaagtgagcctgccactcgctcaccttgaatcacggaggtttcagaggccgttggccttcagggcaatggcagaagcacatgttctctgctgttttctgagtctatcttgactgcgttcccagtggcccagaattccccaagggtcactcgacacaccctcgtctacagtaaatatttgtgcttcctctgtgcctggccaggttttctcagtacccaggagcacaggtgggcagtgggatgtgggcaggcggtacccagattccctcccacaggggccacagggaggacttgggcgcttcctgccaagagccccctgcccttcagactaagtggaaatagagatccgggagtccagtggactcagtggagttccgtagaatacatggaaaacgcaccgctttcagtgatgtaagctgtcttgttcacttcacgattactcatctggcctgcagcaggcaagaggatcacatgcaattataaacagcctcctctgactaaggtcagtgactggaaaccctgtcacgttatcagaggtcatttggtcatagattcttgggcagaagccattgagagtcctgggggtgtgatctttgagcctttgccagtgctggggtttgactccttttagctcaattaactgggtccaggagtttattttggccgagatctgccatgctgagttgacaggcttgacactggaaggaagtctctaacttcattagaggaaatggcgtggcaggctttaaggcattttgatatactccactttttctctcttgccctgttttgttgaggttttcagggccataactgtacctgaggttaatcagtgagtgatctatctgaaaggaatttgttctctttgggcaccgtcctgtgtggtattatatttgtataactatttagcttaactcattcaaaaggctatttaagtcacttgtcctgttcattacttgaaaacaagttgtcttctctttattcttttagtcagttaccaaatatttcctaagtgtctcttgtgctagacattgaggggcactccttctccctttcacttgtctgtttttgttgagctacattttttccttaagtcagattgttcttttcctgttacttttgttttcacttgatttgtttatttatatttaaatatgtactttaacagtcttgaagcattggtctgaatgaggatggtgatcagattgggaaaatgccccttaattttggtttaaaaaaatttattttctttaaattatttgtttattgataggggccacccactccaggtgagtggtttctctgtgtgtatggcagaggaatgctctgtgtctggaaaaaaaagtcacttagcttgaaatattatgaaagctgaagagtacaaatgtcagagagaaaggggtattgggggggaagagaatgagaagacaagacacagtcagggccctgtcacccgtgtggaactgcaggtccctggagagatgatgcatttatccctttttagagatattgccattaaaagttgatcttgagcatgacacagaactgaaagctttgatgacaaagccagcatctcagtttagcaataaccaggttagggaaaaaaccccagaaactcaacagtgagattcagctcagcaatgtgggcggggaacccactgtcccgccttgggcagggagcagccccagccgcttcatctgcctgatgctgggttttatccgcttcacaattaaatttcctttttgttatgcttgcgcacatctatatttggctttgcttcttattttttaagaaaggggagaagtgtgggcaaggtaaaatacagcttgcaagctcccaaatggcaaatgcaccagttagagtctaagtggcctcccaaccttaaggtgaaattcatttattcagcaaatatgtaccaagcccatcagggaccactgctcgagataccagtgcaaatagaagaggccaagggcacattattaggtccggagccagtggcctgcacagccatctgtgaccacctacctctctgcttgcagggaacttcagcctggtggaggagacccataatagccaagtcaactgataatagaattagtagtagtgttgagggacataaagaaatcagggtaaggccatcacaattacatgggtggatgatcttttataaaacagcacagttttgttttcttctgccatggtatctcctaacattttccagtgtgtctacttgcagttaatatggaagttgcggctgacactaggttagtggttaaaagaaaacaagaaaaccaacctttagaaatctttagaaacatcattatcatagaaagctataaactcttatgtatagaagggtaagtggccattgatcttggagcagaatgaatggatatttcctggaaaaaaatatttccactcatcaaagatactcaagtctcttctcatctaatcaatattggaaactaggaatatccacgcctatggaatatcctcagagagaattaattattctgccctctaagaggtatagtagtttagacttagaagtaaaggcctgaacttgaggctgcaccattgaaggcaaaagtgccctttatctcccagctttgtcatttgccaaatgcaattgtgttaaattaagtgacctccaatagcagagctctatgttttctcccctgacccccaagtcaaaattgattatagtaatccatcaaaccaggcctggcaaatgatgttttgcaactaaaggataaatactgagggggagggacgaatgtgaacgcatatgcagagcaacacagtcatgagaccattctattacttcctaaatttcttaaagcttttctgtcttttctgagcttctcaagtgagcaggggcatgagttcctgtgttgtgcctggggacagggaaggctttgggacctactgtggtcttaagtctgagcagtgctaatagcctcggctcaccaagtgctgggcactgtgctagagggtgtacaaacctctcatctcatgaggcctcactgctacagctgacagagatgacatccagttgtttttagttgcacatggcagagctagaaaacaaaccagggtgtgtcagactccagagcgcatgccctctgtgatgccgctgtgttaccctagatcaaatcaaccaagccatccgttaaaaaaaaaaacctgatctttgtcaaatatgcaattgttatatttttgttagagtctgcctctccagtgaacgatattaatttccttcaagtggctactcacagatatcacaaaatcagaaagctgcctaccctgcagcctgtatctgcctccacgtccccacatcagtcctccttgctgtgcttcttgtctctttagtttttatcatcttctaacactgtgaactttagtaatttattctggattgtttgctacctgtctccccttggtaaaatgtaggctccgcagaggtagagcgttttgtctgttttcttcactggcatatctcaggtgcctaaaacaaccatgccagacatgtagtggtgccagtgacaacttgttgaatgaagaaatgggagaaaaaagcagaccccggagacttaggagggtctgtgtgagggagtctccaggcagtcttcctgggggtgtcctgaaggacctcctgatcgtgattttggtcagtgtggaggctgtggtttcttctgagctgtcagtatttggaggtgagttgtctgcaggtcacctcatcccacctttacacattagtaaaatggaattcgctgggtgattcttaggactgtgcggtcagtcgaattaccagacgtccctgcatgctctgtctaagggctggagtctgctttccttgcttctcttctagaaagaggtctgtccacaagggattagcctcgcgaagttcctactgttgttcattgacccagtgagtgttttacccactgtgggtttttcctacctaattgcccctctggttttcagtgttcaacatgctgcagttacgtgttctgctgtggttttacttagcttaatcctttattaattgcctcttgttcaaactccctaagagcagattatccttctctttcagcttctgctccattgctgttgaacttttttttggtcgtgacatcagaaaaataaccaagtgtgagtctgataatagcaagtaaggctattttatttctatccaatttaccccaaatttgagcagtattacaccttaaaataatagagctggctcttgcccagcatgtgaaaagtgtatgcttcacgatggacagatattttccagtatctacttaccataaatctcaagatttaccctaccccactccagccattacccccatgtcccatttgcctaacctaccctagggccatctcagtgccctgtaaagcaacctttgttgcagacccactgtgtgactggaatgtgatgcacacaagtgaccaaggcatggccctgttcgcaaggagcttccagaccaatagcagaaatggacacataagtaaacaactgcgctactgataggcttctgccaacaggagtggagcttgagggccaggaagccttcccagaggcactggagcttgttttaacgttacgtgcatgccaggtggggggcaggacatttctagcagaggagaaagcatgctgtgctctgagaactaaaagtcatagtcactccacttggtgacatgtataaggcacatggaatagggccagagctgggcagaccgtgtatgccacaatagttcgttgtaggttacaaagaaccagtgcagagtgggtgaggcataggctatttgattaataatttggctgcattgacaagatacggaaaaggcgaggttgggactttccgtgaattttctcctcaaggtgcttaatcagtgaggttgggatggccggagggggccctcatttgcttgcctggtgctcaagcctgaggtcctggcctttaatagtcagggaggtctgtgtggaggcagggtgtgagccccctccaaggaaagctgcagtgtgaaaagaggcccaggatgagcgttggggagtatccacatacaacttgatattcctaaagtctcagttctttatgggaaagcccatgcactcttccacacttggaattctttgcaaagtgagtggtatttgagcttctttagagtcttgctactcccaccagctgtactggcatcaccagggagcttgttagaaatgcagattctcgaggcgcggctcacaactacccaatcagactacattttaaccagatcccaggcaatccctgtgcacgtgaagtgctagaacactgctctgcggtaaaacgactttgctaaccatggaagagggtgatttttttcccttttcctttggtgttttttataggacctatttaccttttagaactttttcagaattatggactgcagaatatatacagtgtcaatgtcattagcaattcattagtgatatttggctagaatacatagttgtttccacacaaatgccatttcttacattgagatggcacatgtctggttaggacttgggctcatttgtaaggagccacgctgcaggtaggcatgctcccgggacattagttgctcaggtttcaaactgctgccccagcatagcagatggcacggtaacaaagtccctgtgcactctcacattgcctgcggtgatctatcacacattttgtcccctaataacctagctgggggggagctcatgtctctgtttgtgctaatgctcgctgtatccccaagtggcagtacttaatataattgtcattgctctttaatattatctcattccacgtcagctgcacaaaaatttgaggttaatcacaatgaatgttttctcaatccttgttattgagagctgtttaatagtttattttgtatgtgaagattcatatctagattgaggcttatacaacttcatttaaagacagctttttcggctgggcgcggtggctcatgcctgtaagcccaacactttgggaggccgaggcgggcggatcgtgaggtcaggagatcaagactatcctggccaatatggtgaaaccccgtctctactaaaaatacaaaaattagctgggcgtggtggcgggcacctgtagtcccagctactcggaggctgaggcaagagaatcccttgaacccaggaggcggaggttgcagtgagccgagatcgtgccactgcattccagcctgggcgacagagtgagactctgtctcaaaaaaacaaaacaaacaaacaaaaaaggaaagctttttcaggttggaaaaatatcaacagcagacatgaaaaagcatgaaaaatgacgctaagaatgtaagcaactggaaacaaaaattataatggtgcatagtgagctgaagatctatatttaaatgtgaactcccctttcagtttataagtgattactaacagcctcatcaggtttctggaattaaatgttttattatttcctcccaaagttagtcctcaaacattagtatttcttgtgttcttttgatttgaatatttgtttttaacacacaaggatatcaactctataagtcagttaatatgttcatgcttttagttaatcgaaagtggcttatgatttcagtttttggtatcaggtgatgttgcggaagtgaggttcactgtgaagcttcttctttttttttttttaatcattttgttgtttctttgagtgtatgtgagcttataactcaagacactatgtgaaatgaccctgtgtttcctacattatagaaaagaggaaaatgaagcaagttcaagaaaattagatttatgtggaaaataaattctgcatctagttattcattatcaggtatgagattacaggcatgagccactgtgcctggtgacctcatttgaactcgattacctctgtgaagaccctgtttccgaagaaggtcaacattctgaggtgccattgtcaggtatgaggtaaacacactgagaataccacattttggcaactcagacaagactattttccaaacatgtaaccctgggaagaaggtaacctatcatagtgtgtgttaagaagtcaagcaaccaagaaatgttaattgaaggcccgttttgtacaaggttgcatggaaaagacacactagcgtaagacatggacagtggccctgagtgacgtgcagccggtttaggcgaattaagatttacatacttgaaaagggacaaacaagtctggacgtggtgactcatacctgtaattccaacactgtgggaggtggaggcaggaggatcccttgaggccaggagtttgcaaccagcctgggcaacatgggaaaacccctgtctctacaaaaattaaaaaaaaattagccatgtgtggcagcatgcccatagtcccagctactcacaggggctgaggtgggagaattgcttgagcccaggagatccaggctgcagagattgtgccactgcagcctgggtggcagagcgagaccctatctcaaaaaaaaaaaaaaaaaaaaaaagaacagaaaaggaacaaacaacagacacaagattccatggaaaagggagtggtctaagtattcagactgtaggaattcagagagtggagaggctggttattatgggggtgcttcatcctggggagttgagggaaaggaggtgctggctgcctggagcctggaagaatcaaagatttccaaggccatggggggaaagcatgaaggatgagtgaatagacaccagggctgagcaccctgaaaactgtgaagatactagattgacctgtttggaaaaccaaacagatgtggctgttattgacaagtggttttgtttttgttttgagacagagtctcacttggtcgcccaggctggagtgctgtggcttgatcttggctccctgcaacctccgcctccaaggttcaagcagttctcctaccccagcctcccaagtagctgggattacaggcatgagccaccatgcccggctaattttttgtatttttagtagagatggggcttcaccatgttggccaggctggtctcgaactcctgagctcagatgatccacttgccttggcctcccaaggtgctgggatcacaggcatgagccactgtgcctggccaacaagtggtttaaattggattctccatttcccacctaatagaaagtcggaagcatagggcaaaagtaaaggaaggaccctgtgttctgctggttaaatataacagaggtctgactccatggctattataggagaggtgcattttgttctatgtaaattatcttgatgtgtcccctgtgcctttaccccatgattatttagcacttttttctccacggtcacagggacagggagaaacatacacccataaaacagtgtcatctagaggcaaaaacttgtaatgctcaagcatgtgctctgacgaggtggggcagggtgtgtaggaacaacactctactaattattacagagcttgctctgcactctctgtagaagtccttcaatatccagtctaacacacacagtaacttaagagaggattttaaaaaatcaaaatgccctcagatttgtattggatttaaccaggctgagatccctgagatccaaatataataatgtgtcctttttggatgaatcagacacaagcaaaaatctccagtgtgtgtccagctttagaggtgtagtaatggattccacagttcacgctggtgggccagccaagacttttaatgctgatgtgggcttcattctttctataaactccctttcttcttgatagtgcatgggcccaggggttccaaacatgggtacctgccgtaattgatctgtgtaaccggagaaaatacatatcctatggcacccttgtgtcgggatatagggggcatcaccgtaatgtggctctttttctgttgattatagttttttctttctgtgatcacacaattgttttatcctcgcttaaaaaatttcaagaagtgcagcactcagaataacagaaaagtcaggtgtctggtggtttgtttgcacatttaatagacttgaagataaactctctaaacatttattttgcaagttgtttttctgagagttgaggggaaacttttgccctttggtctccctgaggaattctaggatttcacaggtaggcgtgtgttttggactgcaggctgaacgtggttggcagggtggcatgaggagggcacatattttaagcgttcttagggcagatccacgatcctttacctgccatttctaagtccaaaaagccctgaaaaccaaagacatctttacaggtttgtaggaaattgatttgagagcaaaacctgatgtgaacagatttgagagtattctaggcatcttgtataacacttcattcaatgctttgtgcctcttgctgcacagatattaacattcacttatgggccctgccccatcccctactggggatgctatgcaataatcagaataatcaaactaataataataataataattggaataatcactgagtcattgtattagtccgttttcacgctgctggtaaagacatacccaagactgggtcatttataaagaaaaagaggtttaatgtactcagttccacatggccggggaggcctcacaatcatggtagaaggcaaaaggcacatcttacatggcggcagacaagagagaaatgaaagccaagggaaaggggaaaccctgtataaaatcatcagatctcttgagacttattcactatcacaagaatggggaaaactgtccccatgattcaattatctcccactgggtccctcccacaacatgtgggaattataggagctacaatttaagatgacgttgggtgggaacacagccaaaccatatcagttatctttctaaagtgagacaaaaagtcagaattctgtaacacattttttcccaagcgtttccaaaaaaggttggctttaatggagtattagtttgctaggcctgccatggcaaagcactatgaactaggtggctaacaacagaaatttattttctatcagtgttggagtccagaagtctgaaattaagagtcagcaggattctgctgtctctgagccctatgggaatatcctttctggctcttctagtttgtgatgtttgccagcagcgttctctgttccttggcctgtaaatgacaatcttctcgttgtatcttcacatcgtctttcctctgtgcctgtgcctgtttgtttctgtgtctacctttcccctgttcataagaacaccagtcatattggatcagggctcaacctaatgacctcatttctttccttttctttctttctttctttctttctttctttctttctttctttctttctttctttcttttcttttcttttcttttccttctttttttctttctttctctctctctttctttcttctttttctctctctttctttctttccttccttccccccttcctgcctccctccctcccttccttccttctttcttttaaaaatatttttcttttttttcccttccttcctccctcccttccccccttctccttccccttcctccctttcccccttcctccctccttctctccctccctccctccttccctccctcagggtcttgttctgtcatctaggctggagtacagtggcatgatcatggctcactgcagcctcagcctccctggcctaagcaatcctctcacctcagcctcttgagtagctgggaccatgggtgtttgccaccatgcctggctaagtttaaaaaaaaaaatcgtagagatagggtctcactatgttgcccaggctggctttgaactcctgagctcaagggatcctcctatctcagcctcccaaaggggcgagattacaggcatgagccactgtgcctggtgacctcatttgaacttgattacctctgtgaaaaccctgtttccagagaaggtcacattctgaaatactgggggaacatagttccccatcttataagatagagaatggatcaagacgagcagctccattctttgtttgtgtttaggccagtgccaagttcaagatcttgcctcagggctttcctggtacccctgggaatgtgtatcagcagcagctgtgtcactgaatgggtgtcacctggggggctgcctgttcagacattagaagctgccacatcccctgttaactccatgtgagggaggaatcccttccctccgacaatttcgcctgtgagaatcaagtcagattttgcagtgagaactgagctgagtgtagaataagttcccgaggtacttctggcaccgttgttactcccccaccgagaagcccagaatgttcccaggtgtgttcaaagattgtacgggaagggcttaggacggtgcttggctcatataaacactcagtggcaaagaggttgatgcttaagtacacaggaagtgtttaccagtacacataattgtataccagtgagctccaccattcaatttactgtctgtccggtacattgaccctgtgaggcccactctcggtgtggcactgctaacaggttttattgttgcttactcacttgaaaagtgtctcccttggctagacctttgtcctgagcactggacacacataggtgctcagcagcgtccctctctgcaatgcaaaagggataccgtgtgcctctgcatgtcagctctagtcctggcatcccaggagcatacggtgacagtggaagtgaagtgcaagccgagtcctgggaaccaatgtctgccagaattaattaaaagtaagcatctttttttccctggttagttaatccaggatgaattccctgagtagttcctgccgttagaacttgctctcttttttagttagacacagctcggtgttgcctccactttgacatcacgttcatagttcctgtgcttggccagaactgttttcagttgcaaggacatgggtgagactggtcaaggaattgactttcagggttccaagggaataattagttcagaagtctgtccccatacttgttttccagtacaatctgtgtctctgtgggtgttttcttttaaggctgtgtgctttataaactggagatagaaggagccagtttattataaaaaggataaaatataattaaacaattaaaagtatgtctttatagccgggtgtggtggctcacatctgtagtcccagctacttgggaggctgaggcaggagaatcgcttgaacctgggaggcggaggctgcagtgaactgagattgtgccactgcactccagcctgggcgagagagtgagactccatctcaaaaataaataaaaattaaaataaaaataaacataggtctttggccaagtgtagtggctcccgcctgtaatcccagcagtttgggaggcagaggcaggaagatcgcctgaagctaggagtttgagaccaacctgggcaacatagtaacctcgtctctacaaaaaatttttaaaaattagccaggcatggtggtgtgtgtctgtagtcccagctactcaggaggctgaggtgggaggatcgcttgagcccaggaggtcgaggctgcagtaagccatgatcttgccactgcactccagcctgggtgacagagcgagaccctgtctcaaaaaaaaaagaaaaaaaaatttatgaagtactggttgggttaacgtttcttcttctaaccatgagggaagtaggtgggctgttctggtgactcagtgtcctcccagactcactcatgagaggaagtattcacggactgtggtgatcttgtcttggaatttttttctttgcctcctggcctcacagccgttccttttcttttacacatccatgaaagggagactctaagatcttccttgccaaggttgttgtagggatgagcgatgatgtctctgaggcaccaggcacggtgctggcacccagaagctgcttaatgatcctggaagttatgaccattgctcatagtttttcctacgtttcagatcatccttaaataattgtcattggctgggcgctgcggctcacgcctgtaatcccagcactttgggaggccaaggtggttggatcacctgaggtagggagttcaagactagcccgaccaacatggagaaaccccatctctactaaaaatacaatattagcccggcatggtggcgcatgactgtaatcccagctactcgggaggctgaggcaggagaatagcttgaacctgggaggcagaggctgcggtgagccaagatcatgccattgcactccaacctggacaccaatagcgaaactccatctcaaataataataataataataataataacaacaataattgtcatttatcagcttcttcgagctcttaatatatatatcgccacctttcacaaaggcaaaatctgcattagaaacactgttgtctgattttggttcctctggaggaggggtagacagtctttttgtgggcagggtctgtgtctgtttacctctattccccgccccccactttggtgcccaccacagtcccttgtgtatggtggatgctccttgactatctgaggaataaaatcaattgtgaaacagtttccaaaaagggaacagtttttgtttccccgtttccttatagccttgtgagttgctatctctcttggctctattattaataacataaaagaaagagctgttttcttaacctctggtagttgcacatatatggggaaaaggcataagaaaatatgctggcaataaagacaagtcacagattgtcattttctttggtgactgaagggatatttcagtaatttataggtgaaatcttcctttttgtgacttccactgaacaacatttttactaccaaaagataagggaacaaaattttttaacaaactatttaagcttaaatatttaaacatttttattagtcaccacatattaataaaatatttttattagcacatattttattagtcaacacatgtgtacacagctctgatgatctctatgtagatgcctatataaatagctatatagatatcatcagagctgtgtatatatgtgttagagatagatgcacatacagttgccccctgtctcccaggggtctctgtgacccaaggttgggaccctcaagtgactagttatggatggcaaggggggctgcaaggccagagttggtcctggctagagatttcaagactcgagtggctgggaaggttttagaatgcaggtaaaccactagttgctccaaacaacaaaaccatcataatggaagcatccaaaagtgtgttcttcggcagcttcagagactatgcctaagcaataaagttttaatgtcttttttagctgcttaggtgaagaatgcatttgactgtaatctaacccattaatctcttatttttgctggaaaattgtacatatttaagagtagtggctcattgccagtattggtgatgagtgatatattttaaactatgcttcatacctttcagtaaatcttgggctgaaagatatgtacgttttgttttcaaaatttttcagtagtcatctatttaggtcaattttctgggcaaacaaaatatttgaagccctttagggtttgttattgagatgtaggctggccatgaaattacagggttcagtacctcattgaagtgtatatgtaactgttattagttttttgataacttttttatactcataaaagtagtacttgcttacagtagaaacttaataaaaaccataaatggaaaaataaaccattcgtaaacatcatatagagagaatgactattaacattttagcctaacatgattttaggggtttataatattctagtatatgattgtaccataatttatttaattgcttcccaattattggactggaagtttgcttctaattttttcttattatatatgatgctgtaatgagtaccttttaccagtaaatatttacctgcctctctgattacttctttgggattaatccttagaaataaatttgatgaatcaaagggcatcaaccctttgaatgcttctgatacttctgccatgttgtttcccagaaaagatataataattattccttccagtagtagagtattaaatgtctgcctctctttagaaagtattaccttttttcaatctttgacaatttgttagataaaaacttcagtttcaatattattgcatgtattcatggatatttttcttctcacacattctagattttttctatattgtttataaatgttttataagtgttattactttattgaggatagaaattattatgtaacacttgatggtaacagtaaaagtggaaaagaatgaggaaaccttcaacaaaacaagttgtcattaacaaaacgggttttgcaatgcaactttctgtgggttagctaaatctttagtgtgtcaggtagtcgaaagaaatttgctgtatagtgctgtgaaatatgctgcatccatgagccctctgctctttgcccatagggagcaaagacacaatctttttgcaagctgtcccagtgccatattgaccatcttccttttacagcaaaaagttattgcttcctttggttaaggttgggacacccctctggaggcacacttgaaaaatgaagacctttctcgttgttcttctgttatccaagtatcttggaagaacacctctatagcaggtagacaaggcagggtgtcattgcaatctggctgcagactgaatgtaatcccccttgacattttgccccttggaggcaactcctgccctcccctctccccttacgaccctgcccccttaaaatatgtggagctcagcaaagactatttattctgataaaaatgagcaaataataggtgtgaaagaacatggaacacttcagtgaatcaaatggagaggattaagcattaccccaataatgattggtcaggacgactgtccctgtggagtgtgtcccagaagggttgagcaatggagcaaacccagaaaatctcattctcaactctccctgacagatgacctcgtctgcgctgtcttttgcttcatggtgatgaaggtggaacaagacccttgaataagatttccatctctgaattctttaaacccatttgagatcagtgcaggcctgcagtctctctattagaactggagcagaggcccagaagagagaactgaattttcagcactggattctatgttgagaatgaaagagacaataattgaaaagcttttctcttggaaattttgcaaaatccgagtggatttttgaccaggatttcttggtgacctctcctgagagagcaggtgcctgaggatttcctgctgagtatcttggcatctgtcagactccttatgacttcattttagttcagggagtctgtttcctagccattgatttcatgcacaattcctggcatgtctcatatctctaaggtgatgtcacccttgtatttttttttcagatgtaatcttttatgtgacagtgaggtgtcttacttgtgagtgaacagctagaacctcccaagtggtttttcttttggattttgtttactcagtgaaaaatactgaggaacctgagatccttcagggtgcattttggtgtctgcccaaccttgacgtggatttggaggccaggctcaatgctcgaacttcttgttggagtggcactaaatcattaggatccctgaggacagacagttcaggccatcattatttggtaggcccttgcacacttacacacaaatgcatcattatgaacatggagcagaagattctagggccccgtgtgtaatggcacaatttgtcaagaggcctgagacctggagttggcatggattccctctcctcctgacccacctacctgctacattcagttggccaccctgttcttttgagtccacctttggatgagtagtcagtcctttctgatttttgccacctctgcattcagagctttcttattctttggcgcggaggccttccgttgggtcccactgcctgctgtcttatctccttctaatgaatatgatcatgatttttctgtatttagacaactccacgatgaggaggatgatggcggcagctaacatttatgtatgtatgtatgtatttagagacagattctctgtcacccaggtgcagtggtgcaatcttggctcactgcaacctccccctcctggattcaagtgattctcatgcctcagctccccgagtagctgggactacagatgcacaccaccacacccagctaatttttgtatttttagtagagacgagattttaccatgttgtccaggctggtccggaattcctgacctcaagtgatctgcccaccccggccttccaaagtgctgagattacaggcgcctgcctccacacccagccagcagctaacatttattaagtgctcactatactcctgccaagcactattataatttgtcttctaacaggctttttataagggaagtgctactattatacccattacatagatggtaaaactgaggcacagagaggctatgtaagtttcccaaagtcatgtactaattgatgaagacccagggtttgagctctgcaggaatggccgactccttgtggtttgagcctgggctccctctccatctgtcttttctccctgagccctcctgactgcagccatgccagactttttaatgttctgaaccccagctccagcctatcactggagctctgcctgtgatctttccacctcatgcctcccggttctatgtgtgccttcagactccatctggcagtggtatctggatggaccagtgcatagaaatcacatgagacactcaataaatgtagactcctagtgattctgactagcaggtctggggtggggccaggtacccagatttgcacgggaagtcagggaccactgctgctgactgcttttttcctgggtgcttggcacactctgtcacaatcatgttttcatttctctatgttccatttcaactggatagggacagtgtcttttgtttctggaacctgtctcttttcttggcatatagtaggcactcaggaaatagaaggttgcttgaatcctagtaccagtttactatctccttggaaagactgaaaggtagaatgtgatgtctaagcagcttcactaagcagagaaaacaaaaagtttgcaaaatagaatttgccttttaatctacatgttcttgcgtagcattgagcttcctagagagtcatattcatgctagccctgagttgtatcagcagcagccactagaacggtaacttgatgccaagagtgaattctgatgagcttcattgtgagtaagagtcccagtttgatcatctctacccagatcccgtgggacctccacactgtatgaataatgaggaggcgtggaatacgtagcatgctgcagttggccagcacccagtgtgtactgtgaggtaatcagtgtcaaatcagtcattgtagcaggagttgggagtcaaaaggagcaacagagaacctcacacgtctcctaagagaggaagcaaagaacagttaccttggctgtcatttatggggcatttgtattgtatgtttggaatggtgctgggtactagtattaatacatgattttctctggtctttgcaaaaactgcctgagttaggaattgtcattcccatttcattcatgagcaggctgaagttaagagtggttaagtaccagctgaaagggaggaggagcctgagagcaatctgggcacccgttctccccctcttcttatttatgaatgaatgaatgagacagggtctcactctgtccgggtctcactctgtcgcccatcctggagtgcagtggcacaatctcggttcgctgcagcctccacctcccaggctcaagcagtcctcccacctcaacctctgtggtggctgtgactacaggtgcatgccaccacacgcagctacattttttttgtatttttttgtagagatggggtttcgccatgttgcccaggctggtcttgaacccccgggctcaagcgatctgcctgcctcagcctcccaaatggttgggactacaggcgtgagccactgcgcctaaccctctcctcccctcgagcttacatcctactgtcctgtagccagctccaagatgttggcctttggttctctcttcaggctgaactctctttcagggagtttcctaatcgatcttccatagagttgatcataccttagtacctacctggatgagcactcaagatgttacatattcccacctgacttctttattactgctggaagatatggtgtcccacacctaagtatcccacccacagtccccagctgcatgtgtcgattattgtgagctattcaagggatacagactgaggtaaatgaaccaccagtggaagaatgtggatgttctattacaggaaatgcttagctctttattgcagttatataatagccggcaatcatgatagctgaggggcataaaaatgagagcaacagagtttatggtattctttataactgtggattctgtatgtgcgtgtgtgtgcacgtgtgttctgcatgcatctccacggcacattatctggaggtaacatgatcatcaggccttgagctcttttataagcaatagattgtggctggaaattgaaaatttagtttctgtagctagaaaatactcttttcaaatgccatctagaacagtagttctctgagtgtggttcctggatcaggagccttggtatcactgggaatgtgttaggaatgcagattcttgggttctaccccggattgaattcagatttgggagcggggcccagttatctgtgttttaatcaccccctcccccaggtgaatctgatatgctaaagcctgagcctcactcccctggaaagtgacgcctgattcatctgccagcccatgggcacccattaggaaggtgcttatgggagctttgacctgggctaggtgccggctcttgatccatctttttctaaggctgagggtgtccatagaaggagaagtaggtgcatccgcttagatgttatttaaccaaataaaggtttacagcttacagaaaagaggcaagattaactaataccttccaaaccataatgtaaaaaaaaaataaaaaatatttactcataatggagtataactgaacaaatcatgttgctaatttttttaggatatgttttgtagcttccattcagatacatcttatgggtaataaatacacacgtgaacacacatatgtgtactaacaatatttttcagacttttgattttttagatattgagtatagccttgttactaccaaacttttatcatacttccttgtgaaaggatttcatggcatatttattatttgaaatatcaaatagaaatcagtacagtctcagcattttaagatacttgatgtaatctttggaaatatcttagacattgcaaaataagggttaatagtcatagtatagccactaacgggcagttctgaaattacataaagttaatctgatgaactgatagcaatcagtttttggctatacataactagataagtgagaatttagagattgaatacatgagagccctttttatgattttcaggatctcaagtatgaagcaaaataaattcttctataccctaaattcttgcaaagtgatattttgattagatttgagctaccccagggctagcaatacttgaaagtgtgactagacttaacctcttagtagatagtccgcagtaatcctttgaaatatacatcttgctaaaagttcctttcccaaggaaataatgattaaagataatgtgatgtgtacaaggaattctgggacttgtagtcgagaaacctgaactttaatctagactactcaaatttataactttaggcaaatctctcttgactttctaggctttagttttctagggttttgttttgatttgtttttttatgtttttgtttttgtcttttttttggggggagggtgttgagacagagtcttgctctgtagcccaggctggagtgcagtagtgtgatcttggctcaccgcaacctctgtctctcaggttcaagcgattcttctgcctcagcctcctgagtagctgggattacaggcacctgccaccatgcccagctgatttttgtatttttagtagagacagggtttcaccaggttggccaggctggtcttgaactcctgacctcaggtgatccacctgcctctgcctctgaaagtgctgggattacaggtgtgagccacctcgcccagccttgatttggtttttaatctgtaaaatggtaggtgttgggtcacatgaacaatggctcttttacctccactaattacctagacgctagaaataagaatatggataagacctaaaccaaattttctagctaaattttgtaaagtctgaacaaaatctgtgtgcgttttaatctttcttgtaatcttttcagactctgtctttaaaattatatatatttttagcttctaagtaaacattattggcactggttttgataggaactttactccaagtgtattgacttagtagatatgttaaaaaggttattgcttagtttgtggaaataatacaagctgagactttaactgatatttgtattttcatttaggttccactgttttctcttttgaatgaaaagtataatcctattaaatctaaaatattttcttacagtgatccgtatgtgaaactttcattgtacgtagcggatgagaatagagaacttgctttggtccagacaaaaacaattaaaaaggtaggtgtcgatctttaaccaaatgtcatttaagtcataatttaatccaattatgcacagtcatgtgctgcttaacacctttttggtcaaggatggactacttacacagtgatagtcccgtgagattataatggagctgccatatacaagtgcatcactttttctcttttttttttttttttttttttttgagatggagtctcactctgtcgcccaggctggagtgcaatggcatgttctcagctcactgcaccctccgcctcctgggttcaagtgattctcctgcctcagcctcctgaatagcagggattacaggcacctgtcaccatgcctggctatttttttttttttttttttttttgtatttttagtagagacagggtttcaccatgttggccagactggccttgaactcctgacctcaggtgatccacctgtcgtggactcccaaagtgctgggattacaggtgtgagccaccgtgcccagcccactttttgtcttatatactgtattttcattttaagtgtctttcagtattaaatctagaagttttccaagacttttcagtactaacccaagatagtgattcaggtttttacttaaatgcctacaaaaacagtatcctgaaaatgtcataagttgtaacattttttcttgcacagaatacagcaaaaacaaggatttgtttttgtctttgtatgtttcacaaagaaacttaaagtaatttaaaatacatttaatgaaatggagctgtttgtggaattggtaggcacaccaggaatagtttaacttgaaacaactatttctaaaggaagcaaaatacttggttagctacatggaaatagagaaaatatattaataataaagctatacatgtatgtatatatcttattttcctaatttttatgtacatgatttcattaaaaatttgtttccataagtatgtcttttagttatttatttatttagtttgagatggagtgtcactctgtccacccaagctggagtgcagtggcataatctcagctcaccgcaacctttgcctcctgggttcaagtgattctcctgcctcagcttcctgagtagctgagattacaagtgtgcaccactatgcccagctaattattgtatttttagtagacgtgggattttgccatgttgaccaggctggtctggaactgctgacctcaggtgatccacccgccttagcctcccaaagtgctgggaatacagatgtgagccactgtgcctagccaataagtatgtcttaatttgcctatctccatgtatttatagacatatgtaatatatatatatgtaaatattttttaccctatgtttggaggctttattgaagatgcatgttctctattaaaaatacttggctgcatgtggtggctcatggctgtaattctagcactttggaggccgaggctggcagatcaattgagcccgggagattgaggttgcagtgagccataatgatgccactgcactccagcctgggtgacagaatgagaacctgtctcaaaaaaaacccaaaaaacaaaacaaacccctttcatctgtgctttagtatcatttatgggttactatgatttttttccttacctcctttagaggcgggtgcttagatagtctaacactttgctgaacattttctggacagcatgagtgctttaaaaaattgtaactgtcttgctgccatgcaggcacccaggatgcagccaggtccttttgtgtaaggaaccgtaactgcagcgtgtcctccacttggcattgggactggcattaaaaatctgttttgcaaacaggagccagtcttttgattagcagggaggatgcctgcgagggacggaggccattgttccctgtgttaggcgttgttgctggttcagtttctaggcgagtgggggctgtctagaaggctcaccaggaaggcagctgggaaacttggttgcctgctggatgtggagccaggaccaaagccggcgactggggctattgcaatggatttccttccaaagggaggtcctccttctccctccctttccacggtcgagggagtagctctgtagctgggtttgccctccttctcctgctgcccgcctcctggttcgtatgcctctgctgcgttcgggtgcgagaactgccgtcatcctcctctccttgccgtgttgtgactggttcttcgttcgttttgtgctctcctgtcttgttgctttcctcgcctgtcatttcccatgtgcatttccgtgaagctgccctccgggactgcagccagaggcaggccaggcctgctgctccactcccctcccctcgttcattaccatccttggcttcattcacatgggagaaaagtatgaaccccattatttaggattgaattcactgtggagttgtgggtggggaaagtgctgaatttttgaaaacgccggttcagtgttgtgtgagctctgtgtttcctatttttatgttgcactctgttgatttttttcatctccctgaactgatctattaaaggaaatagattgataaatatcattttgactaaaaatatctatcgctgttggtgaagtgatggtttttttttacatacaatttttaagagctgtctttaagaggcttatgcatgtgcagatgcatgaacacacatgtacagtcttccttcctagaacatgcttcctcttagttttgggggatatctggcagtcctttcttccatgctgaggacaaaggtatccttgccatctccttgtgagatgtacatttaagtagactgatagaaagatgaacagatggatgaatggagaggaagactgaaggataagtagacaagtattttttaacctggttatttttggagaaaaaaataattcacttttggcttacatttggtctttttttttcttgttataaaatctgatcctcagtatagctctctataaaatgttaagatttcaatatttatataaacaatgaacacattcaactttcccccacctgcttcgttactctgcaaaacagatttgtagcagggagagggaagtcaacaaagttcatttccttcttggtagaataatcatatcaatgctaatttcttgaagaaattttttatattttcacgatgactctttccaggcctttgatgtttttccttctggtgatagaagcagtttaaggtttcatacctatgaagcatctgtttcataaatacattccctccccctccagtttggtttgtacgctagtctcaaataatcgactaaatgcttctcttagctttttttaatcaaaaaaatgtttaagcaaatatgtagactgtattgtactagtaactgctaatgtttgaaagactaaaagatactacaagataatttctcttccagacactgaacccaaaatggaatgaagaattttatttcagggtaagtttttcattgtttggtaataattgttattgatacgtctaggtcgattatcacagtcaattcatcttgaggaaaagctcttaaatttttaatgagaaattccttttaggatgaaaaataggtagcctcctaatgtgtcccaaattttgaaagactagaagtagtggtcacagaatccggacttgtttcattggggagtgttttggagaagtcaaaagaaaattatccaaacaccatgtttcatcttttgaattcaaacctttctttaagaaataagataaaatatcatttatgagaatggtttaattctatgagacgggttatgaaatattttagagagagtaaaacagtagaggcaacatgattaaaaagaaacataaaaattaccagttatattctagttagggaggaaaattttggtaactgaaacacttgagtgcatatatatgtgtataatataaaattacttctggaatctaaatacaacagaattaggtaagatttcctcaaccttttatatttaatatttagaatagctatatgtcgaaatgactgaaatatgtgaattagcagagatttctgcttattgagcatttgtggttgttgctgtgttttactactgacattttggaactattagactgcttagctatttaattgaaagaaaggactttctcttcaaaacgaaggtatcttaattgtatagctgtgatattaaaaactgcttacctccagaaataatccaggtcttctgattagtgcagatttccaaaggccagtattgccatgaggcccattataattggtcctgatttcttcctctcaatcgcaatagtattttttgtgctccaaacttgggctactacatacagcatctgctttccattatgctcagagctgaaatatggcactgatactttcatacttggtgaaatcctatgtacagcctccaccagatgtatttgaaattaccctgtggaggactgaaaagctaataggagctgatagatgctgttggcctttagttaactctgaaatatagctttccacttgtgaacctccaaagtgtttagactcctttcagtggaacactggcacagttacataaatgttagtacatcccatacttttttcagctaatcttggcagtaggcacatttaagttctatttttgttagtttttctgaaggttttttttgtttgtttgttttgttttgttttgttttttgagatggagtctcactctgtcaccaggctggagtgcagtggcacaatcttagctcactgcaacctctgcctcccaggttcaagtgattctcctgcctcaacctcctgagtagctgggactataggcccgtaccaccacgcctggctaatttttgtatttttagtagagatgaggtttcaccatgttggccaggctggtctcactctcctgacctcgtgatctgcccgccttggcctcccaaagttctgggattacaggttcttaaggtctttatatttattcattttacaaatctttattgagtgcctattatgtgccagctcctgcctgtagcctgtggttgcattggtaagcagtgtgacccttcatagagcttctaaacagatagcaaaccccatctgcttgttctgtcgctaggctgcaggcagaccacggaccagaagcacaagctgagctctctgtgcttgtatggtcaagtgttatttcatgcattccccaccatgaagcagccagggcctaggtcacctctctgctttaccatttagagcctttgtgaccctggaaaggccacctgaggactctcaatctccctgggatccttatctctcacataggagagagaatccttacctgcaagggttgtttcaaggatttgcatgcgatgatgtaaatgagaacatgtagctctatgtcacacatgtggttggtgcttagtaaatgatacctgagtttggaagatgatatgggccattttggtgaggttttggtaaggaaaaggaagcaaaaagatatggaaagcccagtagctctgtcattgcctcacagttccaggtctctctcatggttcacagtctaggctctggagacaggcagcatagacctagtgcaggtcctggttgccctacacattagctgtgggctcttgggcaagttacttcactgaacctcagggtctcggctcctcatttataaaattgcgtgatagttatacatcataggattgctgtgaagattaaaggagatcatgggttgttgatatttaataacaagacagtgcctaaaaagtaagtgcacaggctgggcacagtggctcatgcctgtaatcccagcactttgagaggccaaggcatgcagatagcttgagcccaggagttcaaaaccagcctggggaacatggtgaaacctcatctctacaaaaaaatacaaaaattagccaggcatggtagtccaagctactcaggagagtgaggcaggaggatcaattgagcctgggaggttgaggctgcagtgagccatgatcatgccactgcagtccagcctgggcaacagaacaagaccgtctgtctctgtctgtctgtctgtgtgtttgtgtgtatgtgtgtgtgtgtgtctctctctacacacacacacacacagatacattcttaagctattacaatcttcttcattatttttatcattactattactgctatcaggactaagaaatatcctcaggcatagacattttttgatctacagtcatgagaatgccttgtacagaggttaggaacccgtcaaagctatttacaactatcctttcttattttagaaaaacagctaagagccttctcttcttttgctatgcctaaatttggggcagaataatatagaaatcagtaataggaaatttgatttagtacacatagaattcccagaacagcaggataattgttcatattatacaattgagttgggcgcattgtaaagcagtatgttattctttctgttccttacgtcgctgttcaaatgattcctgctcgtttaaaaaatactatttatgttccttataggtaaacccatctaatcacagactcctatttgaagtatttgacgaaaatagactggtaagtggatgcctgtatttgaattttgcttcatttttttattaactggattttcagagcagcgtctttaaaactctgtgtttatgttgtacttaggacagtatatgtgcccaaaaagaagactgtttttgtcccactacgagtttgatgttcaaaatcctaacaaatagttttatgttgctaggataaaaaatgtatttgtatgtgtgtgtatttttattgcagttaatgttaacgaaagccactggtgatagtaccagcccatatgctcatgctctaatgttgggaatacagaacggtaggcagatctctaaagaggccatcaggaatgtaaacaaactttgctcggtttttaaatgaaagccagaccatagtactgggatgcattcagtagcaaatctatggtaattctctcagggaaaataacaatctaattaacaacgtatagcaaaaagtgaatctacatttagcaggtaaagtcaagccgtattttaaaagtggttgccttcttaagagagaaccttagaaagtacctttaaagaaacaaagatatgcctgaggcatataacagatacaaactaacattttatatatagattgatgtatatataatatgtttatgaagatcgacacatacataactgaaataattatgatttcattttattgtttttaattttttttagagagagggtctccctctgtcacccaggttggagtgcagtggtgcagtcgtagctcactgtaacctcaaacccttgggctcaagcaggactccaggatagctaggactacaggcatgagccaccatgcctggccagatttcattttagaaatggaatttttgaagcacattttgctttcttaactatctaaaacgtgtacatcaagtagctgtgaaccaggtgttccaactatgaaaatgaacactatcatgttaagtccttaaggtaccttcagaagtgacactataattcagtgcagtcattctcaaatttaccctctctgaaacttgtatggtatgttgactggttaaaaggtgttcttaagaatcctttctgcagtattcaattgaaactccagatttttaatagctggacgttaatagaatatttgaattggaggagccttatacaataactcatttaactcctgttgttgtcgatgagaagaaccaggtctagagcctttacataaacacatcagtcagtggaggtgccagggtctgacctgctggcctcctaagtcccagcccagtgatagtttgggaatgtattgaatctcatatgattagtattattctccaaaagagaaaactaacagattttggcctaccatcctagtatcttttccattaaagtatgggatgttgggtgatgaacagtcgtacagtgtaactaaaccacttttgttgtatgcatcaaagtactttcttgtgaaattggatgagagattctgctgagggtgcagttcttgtctctccatctctcatccagtgaggaccaagtgagttaagcagtattgagtagtataacagtacgttcctggagacatgggtgtgtctgtagactaatccttattctccaattattgagtataatatctcttgtttaacatgaggaaagggtcaaatttgaggaaaaatggcctcttgtttgatgtgttttagttcattattctcttctattaagagaaattcactgttaaaaaattgtttcccatttccgtatctgaaataatgactgtagttgaggtgatcttgccctgggtctgaaatcatacttccaaaccaaaaaggactttgaatacaaaacttttaagaaatcttgtatgaatacaagctatatctgaaaaattgtgttttataatattgatgcctagttttgccccaggccatctgcagtgtggttactatgcaaagaatgctggtgttgctgtttttttttttttctttgttggctattaacccagcggagacaatatgtggctatggtagtacttggaagttctagcattacacagactagcttccatttctctcatagaggtcatttttggcatttaaaacacatacttttagaaaacagatttggatgtatgtaaacacagggttaatccaccacactctggatgctagagctgttgacaaagtcatgctttgcagattttaaaataaactttttgttactcttacagcttggtattttcccctcctattttttttacctcctctaaataaacctctttgttaaataattgatgtttctggatcatagaaaatagtaagtttaaaatacagaatatttccaagctaactacaaatctgatgacagttttttgagtgtgcacttttccttttatttcttaggtcctttttggtcctttgcaaacatagtaagattccatatttgtgtcccaactgtggtaatattgctgacttcttactggaaaacagtcagctctaggtagcatttcttctgtgtggtatttaagttaaattattaccaaaaaaaaaaaaaaaagcccacatgcactcccttcttcaattttccttttgttttttgttgtttgtttgttttttggttgatgttttctttcctacctgacatatggaagacaatgttttctccagctgggttcattttctctttgaaaaggagacactttggtgtctgccagtcatatgtgagctacacacacgtatacaccttttaaatgaaaaatgctgtgatagcaggagggctctgcttggctaactggttgtgtagcaagtcgggccccctcccctccacttagctattttgttacttgtagatcctgctctaattatttagcattaaacggacactaactctgtagggtgtgtaatcgtatttatagtactgttttattagtttgcattccatcctggtagtgtagtgatgtcataaataacagaaacatggtatccgatgcttgggaaggggtttacccggtggccaagccatattttacttgtcattattccgtgtggcggaaggtgggaaaataccgtgtgtgctgttaaacatgccaggtccctgcactggttagacagagtctcagtgctgtgctccgttgggaaagaagtgccctgcgaatgtgatgtggtttagatttatagcagcgtggcttgcagtgtgtttgctgccttagtcagctgtgagagcgccctgctggggccactcctttctgatggaaaagcagcagctgggaaggtgctgtttcaggctcttgctgtttaaaaaaaaaaaaaaagagcgagtaggggaaaactcctctaagtccagaagctggcattggagggggagagcgcggtcatgtggttctggccaccctaccctctgtcacagtgtggatgagagctttttgctcttatccaatcatgcctggaatgccgcttgccacttgggttatttctgctatctgtcgctcccggtgccgcagtgctaacagtttggcagatgggacactttttcttggaatttgtgtctttggtttgtgacttctggcagtgtcgggcctgttgttgccgcttgccctagccctcctggcccccctggtcaccatggcccatcggcttcggtttcattttggctctggtcgcagcaacacagcccccgaatcagacatcctagaccaggagagagaagacgacttcttcatggcattccacaccctaccgcggagaagcagcccgcaccccttcgcccagaacggaggggaggacggcggcggaggcctgcagggaggcgtgggtgcgcttaagcggagctcgtccatgttcatcccgcagctcttgaccagcatcgacgcccgccccacgtgcagctcctccgtgcagatctccctgcagcgcaaggccacggacggggccacggacgggtgcgggccgcccgagggcgccgacgatgggcctccatgcgcaacgcccgaccccagggaccaggcctccgccactgccaccacgagggcctcgccccagagtggctcccgggagccctcgccgagggacacccccgggagctcccctccgagggcagcccgggacccagggctccaggtcaacggcacgtgcggccgccgcgtgcggtgctccggccccgtggactgcgcggaggaggctgccccgggcctgcgcatccagcaccgcgcctccagcgccgacgtgcgccaggtgaggctgctgcccctgggccccgatggccagggcggcccggccgcggcagagcccaggcgctggtccctgcagcacgttccagatgcttctggaagctctgggaagcggtgttttgtcttccagttgcagcagccccaacaaggcgcttcggggccaggcagcgacctcaactttggcttcacgggcacaaagggggacaggttggtgaggtatcctcgcattcggctggagaggagcacctcgtaccccacgcagccccgaagcgagcgagggagccccacggaagatcggggagccctggaggcatcgcctcgagctggcaggatggctcctgaaatccgcaggacgaactccgcggagaggactccgcagggccaggggtgcacatttaagatcaggcaggatcagaacgcggggcagcagcattttagaattcttgtaacccgggggccggaagaagctccccagaatcccgaggagaaaagcgccaaaagccctgtttccacgggagctgacaccacggtaagttcacagcgtgtttacatgtgtttactgatttcaacttcgatgcttactctgcggcgtaaccaaaataaaacctcaccctctgttccgggagtttccctgcttcaggccagtggatctgaatgtttggccgagttctggcacgatgatttgtggtccagtgtttggtgcgcaaaacaccatttctgcaaatgtcttctgtaggtcctcaaagtcaaagaactttgtctgtttgggaaatccaagcagaataccttccccctgcttttatttttctgaatagaagaatttcgaataaaatttgttactttaatctgccaaaaaacaagtcagtgccccaacgtgctgatgttggaattgcatttaaaaagctgcttgcaagtatagcctgtgacaatactttaaaaataatcagttctcggaaaggggaggatattgcaaaggacctcagtttcgtctcttaatagttaaaataggtgaacgtaaagtttagtggaatttgattatctgtcatggcctgtttgctgcaggaggtcaggtcagtcgttgttatataatttgctttgttttttgtcccattaagtaatactgaacgagagtagtgtcgcttgtgggatagtgacattactatcccacaagtgacactgctaagatactaacagatgcgtttttaaagcacattgggttatggcccaaggctaggggaaactgatggggactcgttaatggtcagatggcgtggcgtgcaatttaacactgcacacttgagtgtccaagccgaggatgctgtatatagaatagtaagtaccctgtctccagctgtggagaaatagacgccttagaacagattctggccttcctgtttctctgttcctgatcgctccctttcagtgaaatggagtacagagagacagctgcacgctccatcgaccaggcatatgatgactctgcagctttcgtggtttagagtggaatgaaaagtttaatcagtttggtttcttttactagtaatcactagccagtgagtgctttctcctaaagaacaagctccttatattttgaattggatattttttctcctgaatttcatgtgactgccagtttgaggatatgattagtaaatgtctaggggacttttctttggatttcacttatgaattgtgattttgaaaagtgagcgtctgagtattactctagaattgtattgtcttttattgctttgtgttcagaaataagtttcgtctttcaagtaaactttatcactcctccatcattggttttcatcattttgaagatacaatcagatgcttaatgaaaatttatttttcttcttctctttccttccatgtatctcctttctttcattatctcaaactcttctattgggaaatggctaagtgctttgtcttggtctgaacctataccatgtattacacaatggtacaaattttgacagtgttttgatattatagtagcctttaacgcccacccccaacaaattaccatcatgacagttgtaggctttgttcggcaacacaattccatgctgaacttggaccacttaccgcatgaagattgacaaaaatatatttcctaaagtttgataactattcaattatattaccaaaaactgaaatcactttgcagttctgatgtggaagacaaagggattcatacaattaaactcaaaaaagttcaaactcatttggtttgaactttcaaatgtaattagaaaacaaatcgaataaactaaaacttatgtgtaccttgcttaaaagggctattctaacttgcaaggcctatgtagtgaaaaacaagtttctacacatttggagaatataaattctggaataaagagcttttcttggagagtaagttccaactagtgaacagtagtttgcattttcatatgtatgtatttttgtacacatacataaattagtacgtggttagtaagctggttttcttttaagcaaaacgatttttctttaaaaaacaaaaccaaaagtggtcacataacaaaaccgcctgctccattcagcaactttgtatgcatttcatatggacaggggtgttaagtttaggcagcagctgccaccgccttacttatcttgaaggaaaacattcacttgggcgtctacagtctggctgctaccaagcttttttggcgtttcaaatatccactgctttggtctaaaggacattacattattaagtttacatgaaaaattagctagaatctgttgcagtttggtggtggaatgatacggaaagtcttcctagatttgggaataccgctcgggattcatttgacaacgtgctcatatttcataagctatactttagaccttattacaagattaagttgttgagtacttttatctgtgcctcccaaacatcctgccatgactaaatctaaaatgtaacatgactccaaaaaatgttaaccaactaaattattagaaaaaatacaggggaaacccttgtgatgataagttttccacctggtttatcactgtcagtagacaagaattcattcgtatagtcatcaattataatcagttaaaaattttcagaattgttagaatttaccaattcagtctgtggcagtcattagtagtcatttagtgagtaatttagttattttcttataaattagcttttgggttattgggttctgagcctcttaactgcattagagttattctgaggaagttggaccaccatttaccagcatttgtgccccctttgtatgccattttgtgcataataactgtgaaactctgcattttacaagcttgaggagccagttttctaatctcattggtgttatgaagtactcaaggtctactgtgtatataacattacacccgttacttggaaagtttcagggactatctcagtgtcttgctgacacagtttgtaatgtaaacggagggaggagggcccacccggacaaaagcagtaattctaacacctactgcatatgctattggagaagagagcgttctttcagctcaagctctctggactttcctctgtgtcctctcagtggacatgtacttcacaggagtagtgtagtaatctcttgtgattaaaaattacttttattgaacaacaaaggaatatccaaattcttttcatttggggaaactttgagtctcttttacagaagatgtttttaatatacggccattttttgacattaatattagtcgatgtctgttttttaccctaaaaataactcgagtatccaatgtattaaccacccctttattttaaaacataacaacacaggaggcgaaggtgggaggattgcttgagcccagtagtttgagattactgtttctaccactgctctacagcctgggcagcagaacgagactttgtctcaaaaaaataaaaataaaacttaatattgtaatggagaagaaaaacaagtagcattcttttcattgacctggtttctgactggattcaatcaactttctttcttctctcatgtatagtaatgctctctcttaatgtggtcttagaataaaccaatatatatcttcaaatgtcacctgttttcagggatgttttgaaaagttggataggcagtgcacaaggttgacaccgatatgtttgtaaacagaaactgtacatggcttgcagcatagctcatgtttctgtagcacttcacaatttgaagaatgctttgtttatttcacttaatatgtatggctgtcccattgtggaggcattatctcacttgaccctcccatgtgaaatggtgttatttcactgtttcagatgaaaggatgtgataccgttgttaggtgtaataacattatgtgtatatcatagtgtatactatgataccactttgtgcacctataatgggaatgtgtatttatgtgtgtgtgtatatttgcacaattaaaaagtatatgttaagccaaaaagcagtttaatgcttcctgtgatgtgacagtttttttgaaaagtttagaggtggtaacttcatttggtgtcttgcagcactggcctgaaggtgagagaaggcttctttggggatccaaagagccgtcctctgcagttcactagcttttggtcctggagtacttagactccctctctaagcctattcctcatcagtaaatttgaggataaaaatgtccagctcgtaggttcatagttaggtttaaatgaaagtgtccatggaagtacctgattcgtgaaccaggtatctgtaatatacaagtctttcccctagcaggttaattaggttaattgtgaacaaccattttttgatcagtatggcatttaacacaaggacaacatgcatttatggcatacctggaaatgtttaataaatagctttgatgctctttctgttgtcatctcatctttcctaagtatttgtccctaacaccaaatacagtcttggaaaagaattgcttcctgaactatgcattatagaaaaggactcgtaagtatatttactgtgttgattttgaagccttataacattttggcttgcatttctagcatattttttaccatgtcattttgctgtaatatttccagtggttgagtctactgttactttggtatagactgaggcttttgagaaacaatatagtgttatatctacaaaatttccacattgtatgactttaaaatgagggagatatttgggaatatgtcttattttaagatactgtcttttagagagttttcataaatggtgcagctgcttctcttggctaagcctggtggcagaattcctagtcattgaaataaatctctaattttataatacatactgataagaaacttgctatcttttcataaaagttcacagtaccagaataaatttactttatgtaaaaactaccttaaaatgtaataaatgttggatagttgaatggtttctggatagttgatgaatatttctgtatagttgaggcgaatctaaatggtaatgctacttgtgcaactgtcaatgatctagcacattttttaataaaaataattacctgcatattactgtgggcgatacaggttagctatcctaaatacgtttttacctttttaactcttaattatattaagccatttgcaagaatgggaaaaagcaggaaattcataggtggtgttgaaattgctgattctacacaaaggtaccagaatgtctacatttcctctgtaaatgtcaaaggaaactttggaaacccacctcagagttggctggtgattattcggacaggttatcatcctgtctgcaaccttctagttctcttagttcataccaagcagcatgatattccatgtcctgcacaaaggagagcaccaaaacagccttcacctgctgcgtatgccccactctgaataaaaaattaagaaggccaaaggacggaatgtgttaaatattagcaaaagcaggtattgcagaatgtctatacatttctgggcaggtggagattattgaaagatttttagaaataatcttcgttcaccacattccagtgccaggccctggacttctgtctctatttgtgataaaatgtttttaagaaatgctggctgggcacggaggctcatgtctgtaatcccagcacttccagaggctgaggcaggtagatcccttgagcccaggacttcgagaccagcctgagcaacatggcgaagcctcatctctacaaaaaatacaaaagctagccaggcgtggtggcctctgtctgtagtcccagcttcttgagaggctgaggtgggaggatctcttgaacccgggaggcggaggttgcagtgagctgagatcgtgccactgcactccagcctgggcgacagagtgaaactctgtctcaggaaaaaaaaaaaaaaaaggaaaagaaataatcttctctcagtgagcatgttgaatgcataatgttctcactggagttctcctttggaatctcttgattattctgctgtggcttccttgggccaactaggatacagaggagaataaatgagtaactcagtgagacaggtggcctgatgtgagtgggcctgaaagttagcccctgatgtcctggctggtttcatgccatgtcctaaacgggcactttcctggtctctaggcatcaccatgttttgacaggaagcttagtttctttcaggatggaggatggaatcaattgtatttcaagaagcctgttttttatgccctgacaattttagaactgtggactgttctgacacttttgagtacagtgattaaatctctgtgaagggacaggtcatgaaatcaaataaaaggacggatcataattgagctggaagggggccctcctatctctgatttgactcgttgctacactttagtattcggaaactttgtattggttcccttaagtgcctgcacaacctccctatttctggaaaccattcagtgtttgttttaatgttaagcattatgccacgtatccagtaagcagagcagagtaaattcctccaggtagcaagagactggaatttcccccaggcagatcagcttttcacaggttcctagagtttacacagccttcttttgtgacttaatttttgtagatcacagtgagtcaagtgacttttacttccctgtataataactttgaggagcctacttgcaacccacatcatcactcattatcttgcttacttctttcttgggggttagatgggctggggttgttattaagcatgttaaatactttgaaattcaaatcgtttctgatagatttagtttctctttcttctattggtcattcgagagctggtagacttttaaaatacatttaatgactcacacatgtcataactcatccatttccttgacattttcaagcgtgataataaatcctacttcttaggcttttttttttttttttttctctctctcatgttcttttcaaatgcatggctaggtagttacctcatgaaggaaaacaactgttttggtccagattttaaaaattgagttgaatagaaaaggtggggtggaaccagcaatactgaaatgtaataatgtatattaagctccaaccaaacaatccagcacttcttcaaatccaggaggtcttctggctaggagttacattgcagaactaacatggactcttaaactttgtaaggaattagtcacagttgaacactggaaactatcagcatacctctgggcttcttttatatggtcttcctcatgagttaaaatgccttaagcatagtatctgttccataggaccttactgattatgcttttccacttgaataaaagagatattaagttgtaataaaactttaaatattttaatttagtttgaatatttaagttgaattaacctcttactacagtaattatcttttttgctaacttcttactacggtaattatctgcttttataaaatccagaaacgatgttatacacattagcacgcattattaggtgcccaaatgccaaggctaaggacacagcaatgctaaggacacagtgtgcctccggcctgcttgcaccctcggttgaaattatattagcaagagaagctcctgcattctgcagtatggcatttttctccagctaatgtatgcaggggtcatttttaaatgttagattcacagatttgcagagctgtgagttgccttggaaattatgctggccagttcctttaattttaaagatgaggaaagtgagaactttcctttttaaaaattgatacataatagttgtacctgtttatgggggtacatgtgatatcttgtacctgtttatgggggtacatgtgatatcttgttaacatgcatacagtgtgtaatgatcaaatcattacatactgaaatatttgaaatatctgtcactgcagacatttgtggcatctgtgtgttaagaacatcccaaatcttgtcttctggctgttttgaaatgtatagtaacttcttattaactgtcgtgctgaggacatggactactgtgctgttgaacactagaacttactccttcatctgaccgtattttcgtacccatttaccaaccctgagagctttacttttgcagtaatagagaatattctttttctctcttgagtatgaaataattatttttgaataatcactgcacgtgaagccctatccttcttgacgttggacatataaatacttagggagcttggtttatagagctttcagtttcacaaacagatgggacagctgaggtgaggcctgcctagcagaagaagccttactcctgatagcaggcactaagcaaggcattgggtgacagattgcttatgcacaggctgggagggacaggaactgtgtcatggaggggcaagactggaactagatgctgaaaagtgaccagatttgtctcagtgggccagtgggaggggcctcattgaaagactgaaggtagatgtgcctcccagggatgtggtggtcatattggctccaaattgccttgttcattattagcaggtttcagcaaattatttttcatgtgaaacgttgctgaagatttcttgggtgtggctgtcatcacaaacaattcctctcttttccatcaaatgtggagttggatgaattccttccttgctggcctgccttccacaaagctgctctctgaacacctgccaggccatgctgaggacaaggaaataccaaggcacagtttctgccatttaatggtggtagcagagacccaggaatgcaatggattattgtcactttcattataacatcatagtgtaggatcataactggaacagagaggatgaagctttcttttggggaattgagggagggagacagggtcttgctctgttgcccaggctggagtacggtggcgttaagatggctcactgccacctccacctcccaggctcaagtgatcctcccacctcagactcccaagtagctggaccacaggtacatgtcaacacacgcagctaattttttagtttttgtagagatgggggtcttactatgttgcccaggctggtctcaaacccctggcctcaagcagtcctcctgccttggcctcccaaagtgctgggtttacaggcatgagacactgtatccaactaagtaggctttatttatggagtttataaagaaactgtttatatatacaggggagaatttatcctgaagaaaaactaaagaaatgaatattttaaatacgtctctgcatttctttttgttggatatgacatttatgtaagaaaaatgctaatctgtatgatatgagacatgttaactacatatggtacatgtatttaaatatcatatgtatttagatttagcaacaaaaagggaaatataaaccatatttccaccatttgaacaaatcgtattcaattatatgtgcatataaccatttgaaaaaattataatgttgatcggatctgcaacctaaaccaagtgccaaattaaattcaggatagataatttcatataaaatgtttcacatcatagaaaaagcagtgaaaattgagtatcagatctgtgaaggatgatacatttctaaccttagaagcagaaaaggaaatcacagaagttggatagattcagccatataaaagtattaaatttctgaaccatgaaaaaaataactaaaatgagggaaacaccagatgtttttcttagtgattcatgtaagttctcatatgtatatcttttcagtgtctaattatgtgcatattttggccagtgggtttgtatctctgtagaaagttctagtaaatactggagaaatactgaggttcccccactccagctctttcactccattgcaaagtaggtcttgtaggtgaatcacacaaacggattaacaagaaagacagaaatgtccagctcccaggttcttcattatgctgttgtgttgtgccaatagaaaatacaatatatcaaattggagaacttgtggttgaaaataatatacgcagattgctggtggcagtattcatggatgtgactttggagtgatttttaaacacttaagtatttttaaatgataagaccaattataggtactaagagtcttgtgttttgaagtgttggagttaatccagataaagttacaaatctaagcagacaccttattaagagatcattattctctgcttttaaagtggacttgctttctatatagttatgaagaacagatagaaatgttttaagattactggctactattaaaataatctggtgactgcagttatatctgggtctaaggcattagactttttggaaaatggatgcttttaatctttccttccgtatatttgtcacccagaattttaaaatttggaaatttcattcattcagtccagatagagaattgatcaattggcaattttattatttttcgctcatgaaaaactctagggttacaagaatatgctcctgaagttaacatagttacttttaaaatgtctcaattctaatggttaggtattagtcctctgagttccggttgccccttaacttggatcttaatttacagtttacagaaaattgttcatatttcatattttaagatcatgtactctaaaaccctattatacttgaaatgaagacctgttatgttatactagaatctctcatgaaaatgtaacagttcccaaggaactttgtttctgtctccatggaccacactggctactgtactggatggagggcaaggcgggagctgagaggcctttgcagaagtgcatgtcgccttagtatgtggcagatcctggtccctggcctgtgctgtttccctccacaccctttgatttctccgaataccaggaaagatcatggattgtctcgggagttagtctcccccttagtacttagcctgtcattttcatgttgcaatgcctagaaaatgggaggtttttcttctccttaaggaagtgttatttcaagatgctttctgctgcctgtgtcatgccagggcgtgggtggatatatttttgcacttttgcaccagcgagtctgcttctgatttgcagattgcatttattataaggcgtattgtccattgatgaataatgtgtgggcattaaagcaaagctgatacatagcttttaaaatagctcatttatcctgcaagcttcacccccatagagaggcaggcccttcagaagcgttttccaggagcaaggtttctgcatgtttccctcagttttggaggtcgtcgttttttgcccctactgtgggggccaagggaaaattgctctgcgccttctgatggtcccctgaaaaatcaactgtcaaaagcccaattaataggagaaatgccatacaactttattaacgtgcatgcagattgattaccccaaccccccaatggggttcagaagcttctataccatcctgaggttataggaagaatggggctcagagcccgaccaaaaacagggtatggtggtcaatcaggttatggtggcaagaaagattcttggagggagagaagaggaggcctggctagcagaggtggccctgtcgtgtagatgaaacctcctaggtagcagccctcacagagaaggcagatgtttctttcagacctttaaagatgtcagactctcagtcaatcttccctagatctggacaagggagggccttagagaaagatggcctcccatcagtgcagtttcctccccaggtgcaaatctccccccacagacctgccctctgaacagccattcacagtgtatcaaagaggtatattttggggtgaaatatttttattcccttcacccctagtttatcatgtgtttccttgatgggctgagggcttgacagatgagcagatagacacaatcttagttcatggaaaaggcaagaatagagatgggtagcggagagtttttaagttgctgctgatgaaatagacactcctttgtctcagctactgaaaattttctttagaacgtggatttaaataaagaaagaaatagacatcatgctttgtaatgaagtcctttggtcatcgtaagtggtcacagccagtttatcctcaggcttctttaagctgaccagttaaggtttctgcagaggttctgtgtttgagggaggagaggaagtccttggggaggaggggagcgttctatgggagacagtgctcttgggagcattctttcaatctgatacccatgcaagggtgatgacaaggtatggccttcagtgactcagagcctcctcccttcccaagcctcaggcctgaaagtctggtgatcctccctggcagaaacctcactggggatcattttttccttttgaacaagtttcttactttgcctcatatgttccaatcttctgtcagtggccaggtgacatctgttggaatgctgatgtgtgttgccaagcaaaacagatgcaggaagacttgcccaaagtgggggaagagagggaggaaagggaggaaaagtgggaggtagagtgtgttagctggggagatgggatcgagcagtatttatctatagaacagatatcaaagattgggtaaatcatggcttaaaactctcagaaaagcattctaggttcttgcacatctttgcaaggctactgaatggctcatttttatttcccaccctgcattcagagtggtgtttaaatggctcaccgcagcaaaaaggattaggtattacccttgtgctcaacacaagtctgtggtcagcagatttttaactttatcctagtttattgatatttctgtcagtgaacaggtttaactcttaatggaatagaatctaccaagaataatgcagactggataaaaagaatttcactgattttgattatttagcacattaaaggggacccctggccagaagtagatgtattgcttgggagaggagggcatagtacccaggtggtacttcagggattctgattttcagtcagggttgagaaaaactgatttaagaagttaatgctactgacagcctaaatctgggtttccttgataacctttggtgtaaatactgatttaatgcatttttttttctcacccacttttccttcatcaccccaaatctatattgtgttcacatggttcctctttctagaggtgggagatgtccttttatggctcagaggtccacaaaataaacttgcattcaagcaaggttgtaaaatacctatgcattaagagcagtccagttgaatatttgcaaagcatatataaaagagcttctctcctaaaataactgaaatgaaaggattaattttctctcagtttcctactgcaagaagtaagtaaaagtggaattccaattctagccatggcaagaccggtctatcctgttatgtcttgtgtgccaataccacttttctccaggtaactaaagtatctccctgctgtaaatattaactgagtgcatttttgtggcttttgataactccacgtcttgaaagtgttggccagttgtcaaattttcatgaatttcagagaagtgggtaataggtggtttctctcacggtatttaaagcgaagtagtaaagaggaaaaagactgaaaaggtaacctgggtcaactcattttttagggcgcacagaagtgtggtagcggagcctggacatcaggtggcctgaagcccaaaccaccagctcccccagcacaggagagtgcaaactgtagctcagtcttggccatctggggtcttctgcaaatgaactgcccatagtctggccaataattcacactgttgtattgctgtctttcattctctcttaagtagagcgttctgaacatatctgaacaattttttgacacgctgttactctcctagccacaggttattttatgacctagtcattctttacataaataaacatttatcaacagtgctgtctgggcctagtaaggtatatagcctgctttgtttctgcattaaagttcttagaccgccatgatcttgagatgtttgctgcttattgtttctttctgatttctattgcttatcagttactactacttgtggctccaaggatagaggccgattccctcttctaatttgctgcctctcatctgcttgaagtttaggtgtttagtcaagctcactagcattgtttataaaggaagaataaataggttgagagtgaggacttagggtagttacctttttaataatgtatatgatctgtctttggtctttctccctcatatctctgctgattttactctcgtcctcctggaacgtctctggaatcagatagatttttgtaagatttggatgtaagaattcagtggaataatatatactagctgtttagcctagtgctcggcacatattaatgcttaataaatattagctcttattattattgtttttttccctgaaagagaaaatcttaattcctcacagatgtttaggaattggatatgtagcaaccctatccactgaattagtatcagcaaacacatttttagttcatcttgatttttatcttcattgggattatgcctttatccctttagggttaatgaatttcctactgtgctgttatggaagaaccctgaaaaaaaaatcaataaaatgtatccttaaaaaagattttatgattcacttgactaccaggtgtcagcaacttttatttttattactttaagttagaaggactttgaaggttttcgtggtttattctcttcttttttaaaggccaaaccaagatcactttttggtaatggctacctttcctctgaatgtatttctcaaaaagttctttctggtttttattaaacccaaacagttgttataatttaaaagttacccttttagagtgagattagctagaaaagaaattaaggattattttaagtaactcagcaagtaaccttttccaagaagcttagattataaattaacgaaaaccaaattataaaccaaggtgtatggttgattgtgggttaagaattttatcagcagttttgctgttgtatgtaccagtcgtatattttactactgagtagaagaaaagtctaaaaatcaagtgagtagtttttccttagctggttatcatgtttgtttgatcattatattaaagtgctccttttatttttcgttttgtatgttttcccaacttaataatgaatgtgcttctctctaatctaatctctgaatttcaggagtctattaataaagtatgtgtaaagaattagttgctaattttggatgtggctgaaatgagattgtcagcaaattacaacttcaagcctaggactgcagtgttatggattgcacctcatccttggttattgaagatatattcaaaatttatgaaaaatagaaaaaccttattacttctgaatttttccacgttagactttccttatacttttaagatagtgaaagtgttattatataagatcatggaaagtttgtctttccagacctattttatgttaggattttacaatattaaattcataagataatagtagagactagaaaacaaatccttactgataatgaatttcctaagtagtaaatacaaatgaatatttatttgtaaacctgggtgattaagtaatagctgttcagtgatattgatggaaggaaattaatattatttaatccaaaggccaggcgtagtgactcacacctgtaatcccagcgctttgagaggccgaggcagatagatcgtttaagctcaggaattcaagaccagtctgggcaacatggcaaaaccttgtctctccaaaaaaatgcacaaattggccggtatgtgcctgtagtcccagctattcgggaggtaggaggtaggaggatcacctgagcttggggaaactgaggctgctgtgagctgtgattacaccactatactccagcctgggtgacagagcgagaccctgtctcaaagaaaaaaaaaaaaaattaatcccgaccttcctccaaaaaagaataaattaagtccagaaagtttggtgattcacttgctgttgccgcctttataaacataaaagtcagtaaggctaagggacacttctgaattccttctgctgtccaggtactgtgccgagttctagagatgcaagtagtacataagacagatgtggcccctgcccttgtggagactgcagaccatggctctttttcatgaatggtagagacactcataagtcaaatacctacatattttcatgaatgtgccaaaggaggcaaacaggaagctgagacaggaaatcatggggaggcctacttgaagagaggtaaggaaacccccaactcaggagtggcctgtaagctgaggcctgggaaggacccctgtgggcatggccagtggaactgcagcggaagcagccgttcgcccaaaggtcctgcgctgggaagagagtcagagatgctggaggatcagaaagggatcatccaagtgagtggaggagacagtggtccaggatgagcttaggggaaaacaggggcccctggattgttcacgctgtagaacacagtcatgcatctgatatataaatagcatggagataccctcagtagatgcaaaactcaaatgagctcagctgctctgaagcctgggaaaagtcagcaatttgtaaaattatgacacatccacattttcacaggaaaaacaaagactagtatgtaacatctcctttggtatttacagaggatctctctctctctcgttgttactcttacaaatgataggaggccacttttgttttccaaattctgtgccagatatcttgcctttcctgagatatagacacggtagagtcaggagtgtgtgtgagggcttgcagacttctttttatgtctttagaatccttcttcacttttgaatcatttggtccaggagtttaaggccttttcatttggcttttgttgttcatttgttgaacataaataactgtgttcattatgcagacaccgtgtcattgttgacaatttggtgttgtagattaaggcaacgtgaccatgtaacaagttgggcaaatgcacttatccattcagtgagctctaacctacaaggtgttttgcttcagaccaaaatggtagactgcagaaccttcggcgcggattttaagtccatctttaaaaccataggtagagattgtatctgtgtgttcttctttaattaaaaatgggaaaatgatgcgacagagcaaagacggccatggatcctttttatccctctcccatccacacagagagtttatttcccctcccctggagtccaggctggccttggggttgccctgaagtgatgccgggccctttctacacgtagcctttcaaaggaccggcagcttccacttcctgccttttggaaaagcttgctttagggatccagctgccacctaaaggccctgaagtgagccacgtagagagaagttccagctttctagcccatctccaagtgtcaggcaggtgagtgaagccatcttggatgctccagcccatcaccatccaactatagtcacataagaggccactgatgggcccagtccgtctccacactcctgagagttagtaagtggctgtcgtgttgggctctgaagttgtagactagtttgttagtgacgtataaccaaaagagagagtgtacttaacatttagtcctgggaggttcgaactttgcctccgcctgtacgtgagctccctggagtgtgggatgaaggagtgcttggcccagttgttttcccggaagctggaggagggcagccatgcacaggttgtgtagaccaaacagttcagggatgcacttggcttagacagctgataaacagctgcagtgcccccaagggagttgaaagagtgggtattttgttgtcaggagtagaattattcaccttgaagaacagaagatttgtagtttaaggaaattcaccatattcttaaaagttgcagaaagagaagagttcttagcctaggcctgcaccaagatccagttcttttgaatctgatttaataggcagatgatgaaggacttattcccaataataaagaatagttcaataggaggttggtagtcttaattgtcttccttgtcaaatcctagtgaatttcacatcagatactgtgccctgtgaggctctatcaccttagcacttggtaatacgttttttatgtagtaggtgctcaataaatgggttgagtttctataataatttgatttctgtagcatctgatttaactaagtttgctataaaacgaaatctgctattgtattcaacatcacaataagcagtatcagttgtaaatcatacctacatacagttaacccttgaacaaagtggaggttggggtgtcagcatcttaacacatagttgaaaatcttttgactcccccacaatttaactagtaatagcctactgttgacagaagccttactgataacttaaacagttgattagcatatatattttatgttataaaaattaaatactgtgttctcataattaaactagagaaaacgttaaaaatcataagagaaaatatatttgctatttattaagtggaaatggatcattgtaaagtctacatcctcactgtcctcacattgagtaagctgaggaggaagaggaggggttggtcttgctgtcacaggtgacagaggtagaaaatccttgtataataagtgagctcatgcagctcaaacccatcttgttcaagggtcaactgtacttgaatggatttttttccctgtcataattaaccacccacacacatcttactagaccaaaaaagaaaacttgtcaagcaaataatctcccatttcttgggtcatttggagagataacacaggccaggttatatgtcctgaaagatgagaatgtgtgaagtccccagagagtctgatacgaggccttcttccagggagtagtggtctggccgctgcaccagcctgccccctgccatgccctgactcacctgcacatcatgggtgctgctgatgcccaggcttcatggctgagcatggcacccttagcacccctcacctgttacccaacggagatttgtgggtcggaggcatttcaattggagaaggatggaatggctgagggcaggaaaacttaacaagcaggaagtctgcaccctggctgcacatgagaatcccctatgggcattgaaagtagggggagcattgaaggtagggggagcattgaaggtagggagcagtcaggtcccatttcctaagcggctctgcaggcctctaagcttgtcagtcatctttttggtgctgtgtggactagtgccagcaggaacaactggatagttttaagtctttggcctcttctgacactttttaaaccaaacattttattaaattctcattcaagttaatagcaaaaaaatattactactggtttcatgtttaggtctcatttgcagtttttaaaacaacctaacggagtatagtaaatacataaagtactcgatttaatgtgcattttctttttcgttttttttttttttttttgggtggggaggggggtggttttctgagacggagtctcactctgttgcccaggctggagctatctcagctcactgcaagctctgcctcccaggttcaagtgattctcctgcctcagcctcctgagtagctgggaatacaggcacatgccaccacacctagctaatttttgtatttttggtagagatgagttttcgccatgttggccaggctggtcttgaactcctgacctcgggtaatctgcccacctcggcctttcaaagtgctggaattacaggcgtgagccaccgtgcccagccctagtgttcattttctgacaagttctatgaaacctggtgacttaacttttctgaatctgtttccctatttgtaaaatgacaatacttgcagtagagtttatgtaaggaattaatgagggtaactttaagatctttgtaaatgctaatgtgttttacaattgtggtcagctataataataataataatattattattattattattaataaaatgcttactaggcgaagttaatagctcccacccattcccaaactacttaaggaggattttaagctggaaacagttaaggaaagccgcatgatgccatgagcaaagccttccatctgcacttggcatattgcagggtctgtagttgctggaatgcctatgtccctggttacgagccttgatataattgtgctaaggcattttggtggagtggaccgtgtcctgctgttgatcaaacatttctgtgtggagagactttgtttttcccttggggagtatttattttttagtgccaggctccgggttggctgtgctacgcttggcttttcagtgccaggcatacaaccatgtcagaagggggactgcatggtaggtctcaggaagaagggccgaggaagaggagaaaagggacttggctgtggacggggaatcctgtgtatcttggcttctctgagccagctgtgcctcagaactttgatttgatctttgtaccccatgggtcctgccaggtgaggggcacaatggagaagagaaaaaaaaaaatgctctgctgaaaacataagcaacaaataaaatagaggatagtaatcctaggataatccccgaggcagcagagaaaggcaggctctggcttgcatgtcaggagctctcttcctgggggcaggagggagggtggtatagtcccagatgagtgcttggcaggttgtttagagcctggtagcagtgaaaagaaatgtctaccaggcatcttgtgcatgtggtagatcttgacttgtaattgtggcagtctcccctaggctcctcggcagctaggtgacagttgcctgctagttcatgggtcaccttctcaccctctggcttgcttctcagtgggtgtaaatggggtaattaaaacctgtggttttagactttgctccaaagactgtttctggggttctgcagacattgacctgaaatttatttttattatttttaacgtttaccacctgtgaagatactgtacatttaaagatataaaatgtatcatattaaaataaaatagcctgtatgttttacattttgagattctgtttatgctgtttttttaaaaagttagaaatgtattggcatgttctgatagcttatttttaactacttctccattgttgtaatatcataacaggttggactggctaggctatggtcagaaattgcttatcagtgttttatacatacccaagggattccaacacagggtgtccatggtcctctttgagaaaactttgtctaaaagatattgaatgatgcctcattaaaaactcctcagaaatattttctcctggcttgttttcgccttccgtgtcattgtttgagaaatatccaagattccttcttttttacaattaaaaaaaaaaattgaagcaagtccataatcccatgtagttctttgatagaattaaacttcagataggcataagaaattcagataggctttctctccactggaaatgcatgcctttcgcaatcaacagtgtatgatgtggtctgttctggagttggggtctgacccttcagcatggccagcgctatctgaagatcagaaaccctggaagccccttgtctctttttcatcttccacatctgtctggcgtccaggccctgcccctcctgcctcttcactgccactgctgtggccagcctcttattcagaggagtttcctacctggttagacacttaaccacctccagacggaccccttctaatccacgtcccacattatagctcaaaagtatggattttacagatcttatcctctcctgttctgccaaaaccccatacggtcctccattaccaatcaggtgaatcgacttgcatttcccagcgtgtccccacacccacaaacactccatgacactgggcccgtccctgcctttattccctgtggcccctgtgtgcaggagccttccctcccctttctatcagtccctcatgtacaggccttcagccccctcactctgccctgttcctacctccatcattgtgccatttatgtttgcatgtctgtcttctctgtcatatctatctcaaactaggttgaaaattttttgaagatggagattttcagaataaaattgttcacacagttatatatttgactgattatacttttatttttatttatttattttttttgggatagagtctcactctgtcacccaggctggagtgcagtggtgcagtctcagctcactgccacctctgcctcccaggttcaagtgattctcctgcctcagcctcccaagtagccgggattataggcatgtgccaccacatccagctaatttttttttttttattatagtagagatggggttttgctgtgttggccaggctggtctcaaacgcctggcctcaagtgatccgcccaccttggcctcccaaagtgctgggattacaggcatgatccaccatgcctggccgattatacttttttaatgtgttagttaagatgagagagtccaaagtgatacagcccctgcccccacagagcttccagtctagtgagagaggcaggtaccaaaaagataatgcacatgacagaatggactgaactaagtagtagtagaagttcaaacgaagaagaagacacaaatggataaaagctatggattctcaggattgaggatgctgaaaggctgcacaggatgaaaggtgcgaccaagggtcctgaaaaaggcataggatttatacttgcaaaggagggcatttccagcaagaaggcttggaaatgagaaaatctcgggagaataggcccatgttagaaattcggtacacgattgagaggaaaagaagtgccactggggaagtgtgttgaagcaggtatgtggatgttcttccctatgcagtggtgtcagtaggattttttgttggtgtgagatctgggatctgtttgtaagccgtctgagagctgggactttgcattgatcaactttttgttgcacatgctctgtgatgtaattggcactgcatgatttgacaagaatgtgttttatgctctaaatcaggagtgagcaaactttctgtaaaaggccagatagtaaatattgtggcctctatttagtccattctgaatgtacattagacacaagtttctaaagtacattcacaaataagcattatacacttagttgtaacatacacggatgttgagcagagaaaaagctctctgatttttgtggttcctgctctaagccaggctaagtggtgttgtcagggttccaaccccttccatccctgaagcacactcagcaaaccatctagtttataagccacagtgtgctagtaggtgctgtgtgtatttttttgcggggggaggaggtatttattttgtttttgagatggggtctcactgtgtttcccgggctggtctcaaactcctgggctcaagtgatccttctgcctcggcctcctgagcagccactgcacgtggctgcatcgcttttaaaggtagatgatgcctctggcctttctcattgcctctgggtgtgtggcccatgtcactgtccagcgcattccactgtccagcccattccactgtctggccccatgccactgtccagcccatgccactatctgtgtgttccgtgccactgtccatctgtgtagggaagagagcaccaggggctggcctggtcaggagagctttctgggcaggggttgagggaggcacatgtgagctggactttgaataaaaagaaaggaaagccaaggagcagaccgggcgaggctgggtgcgaagaccagatgtggcagggatttaggaggcagagcgagcacaagtctgtgcatattggtaggttctgtagacttgtcggttgtgcagtggattcatggagcctgtcgaggaagctacctgtgtgcttccactaggaaagcacagccacagagagaagatgaggggcagggaagcagtattgtggggaattcggagtgagggctgaatctgagaaatattattttaaaattatgttaaatacattattttttgctgtctccaaccatcattactatgttcactgtagaaaaattaagaaagtcagtatggcatatagtcccataaccaagaaattcattcattgtgacctatttgagggtcatttaaaaatgactgatgtaatttggtaaaagattaatcaacaaaatgacttatttcataattaattactttccactaatgtgacatttctcaaactctgcagtatttccttttcttcttttcttttctttttttgtttcctgagacaaatctcactctgttgcccaggctggagtgcagtggcatgcaatcatggctcactgcagccttgaactcctgggctcaagcgatcctcccgcctcagcctcctgagtagcttggactacaggcatgcaccaccatacccagctaatcttttatttttttgtagagaaggtgtctcactatgttgcccaagcagatcttgaactcctgagctcaagcaatcatcctgccctggcctcccaaactgctgggattacaagtgtaagctgctgtaagctgctgtgcccagcctatattttcaagtctctctccttttttttttttttaaactggaaaggatagctgtgatggaaatggaagacttccaacagaataccttagttagcataactgtgtagtacaagatgtaaaaacctgttgaagtgggtggccttttgttatcattctgtctttctgcccaccctgtggcacagttctcaccatattttctgtcaactgctaccacatggtccccttctttatgttataaagtctcttaattattaggtaattattcattgtcctagctctccatgcttaccaaacaatattaacaagagcacggtattacaaatgagtcaataacaacttccctaaccttatggcagctgttttggaggaaaaagaaaaaagaaaaaaaaactgcctttttttttcttaatgcgttacaattggttgatcagaacagttttaaaactataaaatgttggctgggcgcggtggctcacacctgtgatcccagcactttgggaagccgagacgggcggatcacgaggtcaggagatcgagaccgtcctggctaacattgtggaagcccatctctactaaaaatacaaaaaattggccgggcgtggtggcagtcacctgtagtcccagctactcgggaggctgaggcaggagaatggcatgaacccgggaggcggagcttgcagtgagccgagatcgcgccactgcactccagcctgggcgacagagtgagactccgtctcacaaaaaaaaaaagcaaacaaaataactataaaatgtttaataaacatattttaaattaaaaggtaaggttgtatctagttatttatacagctatttttaaaagtcaggttggcaaaggtctctctgagtttcacaaaatatccgcgtgagtggtgcatagtttgtgctggcttatttccatttgttcgttgtgtttatggtaaccagtagcattttctaatttggttaaaatgctgtcattagctggtaaatgcagtcctgtcacctcagaggaggaccaagaaggagctctttctagaaagggagggatcgaattactcctcatcctcatatctacttatctatctgattttaagacaccactgaaatttatactgcgagcaatttaaatgaatgcagtaattgattgcaaaacatgtttgtaatatcagtgactgaaattaaataaaagataagtcagtactttttggatcaatccagttgatctaaaaataaaaagtagacatccactgaatggttgggtaaatgaacgaatgaattttggcttatgtcagtgaattggcctgactgggccttgatctacatagcttctcttgacattttgttgcccaaattgagtttgagtgtttttagtaggcagggtaaattagcggtatggatgggtataacattctacatttagttttgctactgtatatgagctcatgaaatggacttcccttccctaataatatagaaaaaagaaaaacctaaggaaatatagagaacacattcaatttgggaaattcccgtctgtatcagtcaaggataggctagatcatgttgatcatgctgcgtaacaaaccacatctcagtgaattaacccacaaagggggattttcttgctcacaatacacaatctgtgtcagcaggagagcagaattatctgtcgtcaccaagagtccccaggatgatgacggctaatcccattgtgccttcaccatcactgccataggtgaaaggaacgtgataaattgcacactgccttatttatttatttatttatttatttatttatttatttatttagagactgtgtctcgctctgtcgcccaggctggagcgcagtggtgcgatctcagctcactgcaacctccacttcccgggttcaagcgattctcctgccttagcctcctgagtagctgggattacaggtgcacgccaccacacctggctaatttctgtatttttagtagagacggggtttcaccatgttggtcaggctggtctcaaactcctgacctcaggtgatccacccgcctcggcctcccaaagtgctgggattacaggcgtgagccaccatgcccagcccatacactgcccttttaaagcctgtgttcgaaagtggcacacatcactgccgctcatattttactggccaaagcaagtcacgtggccatgccatttcagattgggaagtacatttttaccattgcccagaggaggagagagatatgcaatatttgagaatagccctaaagactacaatactatcccttagtccacctaaatgatcctgaggctttggggcaattaaaaaatccttactcttaaaaaatgtcaggcagtaagtcttgaagccagctgctggtgctacacaacatacccttgtcttgtgaggaatcccttttgaaaaggtaacttacctcgtcacttcattattgctcattgctacaggttgaattgtgtccccccaaaaagatatgaaatcctatcagtacctctttgaaaatagggtcttatttgaaaatagggtctttgcagaccctcttgcagatggagtcaagttaagatgaggccatgaatgtggaccctaatctgactggtagccttataaaaaagggaaaatttaggctcagaaacagacatgcacactgggagaatgccatggaaagatgaaggcagagatcaggtgatgcttctacaaggcagggaactccaaagattgctagcaagcctccagaaagcaggggagaccatggaatctccctcagccttcagaaggaaccaccctgcccatatcttgatcttggacttccagcctccagaacttttaaaccatcaatttccattgtttaagctactcaagtttgtggtactttgttacagcagttttagcaaactaatatgctaatcaatatatatttttatcatcttctttggacctagcaaggagaaccacttgggaaattgaaacaaggaccctctcgggaaagtttggtgaaatcctggccaacatgatgtctaatgctgattgcagtgaaattgagtactgttgttgatttttttttcctcaaagtagcttttggaagtgaagagtaaaatgtgttagtgggaactcagtattagcaagaagagaaataagggactatgctagcaaaatgaataatctgtctttattatactgtcacaggtggttatcaagatacagtttttgtgagacaaaaagctttgtggggctggagttgcttttgatggtggtggcagagggagagttatacgaatagaagtaacttctggtagtgtcttcgttgcatgtgggtacacccagtcttatgggcaagctgattttatataatcttgttcttttcagtaaattttgtatatcaaatatttaatcttacttctttgaaaaactttttagataagtgatgtttgcaaattgaagcatattgaaccatatatctggatattttgtttgattataaacccatttttacaccatggccatagagaatggtgccgtgggcactatcaggagtgatgtcattaaccccacagggctatgtggaaagcgtgtggctgggactgctgtgtggttgggacaaggcagtggtgcacatgggccagctcctgtaactttcctgtttgtggctctcatggggcactcctgctcctgctctccccgtcctcatccatgatacatactctctctcatctacgtgctcataaatttcagcagcaagaactgcatgatttttaaaattctgagtagatgcttccagcaaaggatttcctaactgatcactgccagagaagaagaggtgctaaatagttgccaagttacatgctttttttcccaaatgaagtacttcccctgctactgcttgtaaagccctgattgtgtgtgtgcgcagaacccacatctggtgctggaagcctaaggactagtgagtggtcatgtggtttatggcccctataaaaggacccattctaaaagtctccaagaagctaactccacaatgagatgatgtgtgtgtgggtgtgtgtgtgtgtgtgtttgagatagggtcttgctctgtcacccaggctggagtgcagtggtgtgatctcggctcactgcaacctccacctcccaggttcaagcaattttcctgccttagcctccccagtagcttggattacaggcatgtgctaccatacagaattcagattcctctcctacccctagcctgatgccctttcattagctatacaaaggtggttgagtttcaggttaggcttattatcgtttaaactataaactaaatattcaccaaagctagcccagcctaagcccaggaataatcaaggcagcttgaaacctaaaagcaagaggaggctgggttagatcagctcactgtataatttttgcaaaggcggttttattgaaacctgttcttttttgaaagctggctctttctaacattcaaatgcttttgatcaacctattttatggaagcagaatattgaaattaaagtaaatattagatgaactttatagccagttgttttcctcattcttcaactctttaccctacaaatcttatttaaacaacatgttcagcaagctgttatcttgcttacgcaatgaatagaacattatgttctaaggtacagtttgctcacctatgaaaagaatttaacctcttttctaagtagctatacacaattgtcataccttaagttcttatttagatgcatttcagaatattagagcattttgcaagtagatgcacgttcttacccagtgtcagtgtttatagacagacactcaccatgggtatatttaagtctagggtggtaaagaatataaatgtcatttattaaaacctgaacatagccaactatgaattatttgtgttaatgtaaacgtcgaatgagcactgcaaacatttgatgtttgaatatttgcctgtagaagtgcagtactatgttctatagaatataagtagatgccaccccagtcctcaaggtttcagtgaggtcatcattgtatcaataaaggtgccaatttaagatgctaactggacattggaaaaaatttgttgtcctattctgaaggatgagtcttatataaagtgtttttaaaatactttattgaaactgccatgttcttttcaattttggtagctcccctgcatttaatttagtcataagcgtctgtattaatgggtgtgttcaatatgaaggcatcctgtgaagacaataaattatattatacttatctagtctgcactctttatcatgttgataaaatggcccttaccagtaaaaaaactgtttcagaatgtgtaagagtaagtctgtctcagctgactgagggcttcatcatgttcatgataatcccagcagcttgaaatgtcaaactggtagctgatccatagcacacagtagtgctaattgagataggttggtgtggataattgaatttaattgaatattaaacaccagtaagtgctatgctagatgttgggaccacagtgatgaagatgacattatcctgacccgggaggcgctccttatgtgcataaactgcatttggaaattttcatgatttgagagtcatctatggttgccagtagagattttcccagaaggccaaggatatatggggacatttgactgttctttgaccataattatataactttttatttgcccagaatgaacaactgcagggtaacatttatacaaaaggaatttagtgtgcttagagtgctgataatacttgagaaactaggagagctgttttaaagcacttctttttcttttttttttttttgtttttttctgggctgttagaatttgacattgttcaactttaactttgtcctcattgaactttatcctgctaaggagctaaaaggtccatatgatcaaaaaggcagctctcaacccagcacgaaattccaggctcattcatttctgtttacctactgccaaataagtcagacaactgcatacttgctttacagacgaatagaggacagcatgttgttcaataattgtagtttaaaaagtatatgtaagatacatccacaagaagaaagatagagggagcataccgtttgtcttctagtataggctccctgcccatggagatcacagagtagaattatgatgggtgccttagagaccagcctccctcaggatcatgagttcacctcggcaccacagctctgggcaacgtggaattagacaaattaaagtagttaagttctgacttcatagaacagaatctaaacttttgttcatactgcttttgtgttcttgggccatctgaaaaccttttctgtgtaaatattcctgcaatatgcggtcttacagaggtcttatcacgcatatttccctttgcttccttatgtatcgtattttttcaagaagaagacattcaactttagagacaatggaatcattgtgttgtggctttaattcaggtcattgtccttttgtgagttgcacgtgtgcgcgagcctgtgtgttttgcttggaggaatagtgaataagcaaggagcagagtccatttgctttttctaacagagggtggggcagattctctcacaaccattaaagaaaaaaataagataccagcaataatgataatcagtcatgcatatgtaatcgtgtgtagttcatacttcagattcatatacagctgagcatgatcttgaatgttacaggaagcaagcttgaaagtcaagttacagtagaactttgctaattcatgcctgactaatttgcccacccagtagttcctactgaaatcttgccattcctctaccaactttcagaaaaatttgatagcaggctgtggagaaggctcatgttacttcttatgtcaaggtgtaaacaaaaaagagagcacaaaatacatccatcagaccacatgaagtgaagagagagaaaacatctgctgaaagccggattctctgtttttttcctgctttttaaatgtaatctgtctttgtttatgcatgccctagaaacatgcataagtaaccctgagtagtctcttagtttaagaaaacctactataaaatttcttgttgtaaaataaaattctaaaaggaataagttgtggacatataagtatcagacagtttatgtaagactttacataggatgcaaggtaggctgtaatatgatttggtaattgttttatgggggaattttgttttgtatagcgaaaaagaacagtgagtgatttaactgaattttatagtttaatattgttgttgttttaactaaaatctttggtttgctattgcaaaatgaaagagaaaggaaattttggttaatgttaactttatttccaaaaccatgtgatggatgctgaccaaatgtgtctcaatagtgccattgaggtctgttgcctttttttttctttgaggtgctaagtgaaatgtgttttgaaccttgaatgttcactatgcgacgttctttgcattacaggtagatactgcaaacttgcttcaaaaaaactaaaaagttcaaataactaatggttcatatttgttccagttagtaaatatcacgacaaggtatcatcgtcatcccatgttctcagtatagattcagcttcatttcttacaccacacacccagaggcataaatggaagtacacagacaaaaggaaaggcctgagtttaaatgtagttatcatgttcagtgttcgacattttattctgagaatttaagtgtttctactgcagtaccacaaagtcaatctgcatattactttaactagatcacttgtaaaaataaatgaataaatgaccagtgatggttcagtgacaagagtgccagatgagtcatgaatgttttcacaagtaaatttgatagtaaactgctaagtttactgtatacgctgtgtacaaattagctcagattcaagatttttgctctaacaactgaacgctcagttgcatctttaaactttttgttgcgtgagaggggctgaggggcaggtgggaggaagtcagcctgcaggtgggaggtttctgtctcaggattgctgatacccctgcatgctgctgggttgcagccttggagtatatggcctatgagacatggcatgtctgatttgatggaaaaagcagcggagaaccagtgaaccaagctattccgtgtattgactttttaatacgtttactacaagaatctgccttttaaagtacttttaaataaggttataaacataagtgtgttttggacacagcctgcagcaagcatgcctctcgaggtgtaagatgagtcagctacacatgctcaggggcccgttccaccagccacagtagctgcagagggtgagagcaactgaagcaagagaagctcttagtaattaggggaaggaagcctccacttgacaccgcatcaccaccaagtatttattgagtgtctttggtgtgcaaggcaggagaatatcttctatggattctacatatttcagggttaccagagttataaaatcccttgaaatctatatgcacaaattgtaaatacgtatgcagctttttataagtgttcaaattctgccttaattgtgctcaaggatcagggtctcaccccagcattgtataccattgatagtcatgatttccttagtgaaattaagtaaattgactttcagagactttatttcatattcatcatgtccccatgtagccatgaaaaaatgatatgtttaatattcatctatttgtatgattaaaacaaaatatccgcaactactgacgattcaatgatcagatattttactgtaaattaatatcatcataaactcctagacattagacttcagacattcagagcccactcgatgcttggcacaaagcaggcaccaaatacatatttatagaatgaatgaacaaatgaaggaagaaacaaagaaatgactaatgcaccaaccatttatcaggaagtttaacagggaaattcaacaaccagatttgttttgctaatcttattaaagtgcaacatgtttgttgtaaaaatagatccacattcgtcattgaactggacagtctaaaatagatccaaacccattgtttgattatacttcacaaatgtaaggtaaaatagatgatactatctgtcatttgcttgatgctattggcaaatgtgaagcagttaccagcataaaagcttggaggttactccgaatgtatataaacaacagtggctaggctcacaagtgggagagagtctaaaaataggtaggcgatcccttatctcgttgcattgaaaattgtgtttatatgaagtgatattattagaaatgatgtgtgagaaaagaatttctgcaatgtctcctacaaattagagtgagaaaatgtatctttatgcagctttgaacaaaggattattattgctggactgtggaccaaaattttagtcaagttttttttttttaatgaaaagaaactgttcatttatgcagacatacaactttgtgtcctatagagacttgtcatctgctcttaaagttagcaccctatttttcctctggatgtccactgagaaacccactggtgtgatggtcattgaaaaagagagttgtgtcagaatgccctaaaatcttagtggcttaacacattcccaagtttatttctcattcacactacccgtcaacataggttggcaggcattcggatccacagggtcacacagagaaccaggccgaccgacccacatggtcacacagagagagaaccaggccgaccgacccacatggtcacacagagaaccaggccgaccggcccacatggtcacacagagaaccaggccgaccgacccacgtggtcacacagagaaccaggccgaccagcccacatggtcacacagagaaccaggccgaccaacccacatggtcacacagagaaccaggccgaccgacccacatggtcacacagaaaaccgggctgactgaagtttgcactggagcttttcacagcccccactcagaggtgagataggtcaccttttctcattagccaaaactggtaagatggccttccctgaccacaaggatgctggaaagtgtagtcatcttttctctgtgcctggagaggagagagaagtgaaaattggtaagcaatatttctattttaaaagtggttagagtgtagtgcaatgaatctagcaccattggttcagttttaaatggactgattccatttgtctaattctgtgtcagttggctgttttctgacccctgagaataatttagtctggctgattcccccattgtaccaattgcctggcatatgacaaatgcatttttgcctgtaagacaatctttgcctaggaaagacagccctaatttttatgtcttgtattttccagtaagctaatctggagtatcagtttttaagactgatacacaattagatgaaactaattaaggacaaaacatttgccacttttaactgttgataagtgaaactgagatttccccccaccccatggatacagtgaacatttgtcagcagctggtaatggctagtataaagatgtattcagttttcccttcccttcctctccctccagccttccagccacccccttcccaaacatttatgctcatttagagaaaagcaaccccagttctcttacctgggatatcaccagtataaaaagcacattcgtataaattatctggcctttaattacctgtaaccctgtaggaaaccccctgggaaaagtaccacaaaagaacgcagctctgggggtctgtgagaggcacccagttcacacccctaaaggacagagcgagcactcaaacgcacagctttgggtgccctctgaggcgtgcactggctggtagcagtgggtatcaaccatggaagttcacggaagattaaaccgcaagttcccacgcaaggccaagtggctgccaggacttggaggcactgaccctgagtggtccttccacctcagcgtatactgtcactgctgcctctgtggcttcccctttccctccaagtagagatagatgtctcgaggtgctccccaccccagccaggttgtcctctcctgggtggcattttcctttctactctctggggctttcaccaccccactgggcataactctccacaggctcccctgggaggggtgcccccacctcacccgccacctcacttctcagcccctcttcccatccaagggctccctgggctgcccccaccctagtcatgatctcgctcctctactctctcgtagtactttatttttaccttgctcctggctcacattacatgcttatcttgtatttatagatggttctatatatgtctccttttgcatccttttctcaaagctcctgtgaggccagggatggttttatgccttttctcatccccttatgttctagtataatgctttacacatgattaaattctcatcagatgttgaatgaatgagcttattatgcattacttcttagtacaaagaaatatttggaacgtaagctctgaaatgttgatattctgtggatgcttggattacatacaatgtcctaaataaacacttgcctgttaagtagaagtcagtctggaaagtgatacctttagatccataaaatgtttataaggcacatgaatggacaaccacgttgttttttgctcttttatatgtttaggttactgacagcccaaaatacattagcttgtctttgggctaggaggtacctaaagttgtatttttctctcatgtcattttcctgggtttttatcatatccaacttcgtaatgtccaggaatttgagattaattcctcaaacttgtcgaataatacaagaggaaacttgtataatacagagcaaacttggttggtgagtagctgctagagcaaacttggttggtgagtagctgctacagcccatacatggatttgtttcttcaggtggggggataattgtatccatggactcttcttcattaactgacggatcaaattattttatgaagctatgatgagaaatggcttgtgctcttgggaaaatcaatgccaatgtaggtaatgcaccagtctagctggtttttaatttaaagaacaaattatcttctggaatagtaataaatccccctttggaacagcaagaagacatcagctgttggatatgggataattaccatatgtttcaatgtcgtaaaaaggcacagcaattttaataacccaggttgtgtacaagaaagctcttgcttctgaagaatccatcaaccatgcgctatgatcatgtaataataaactgctgtttacttaatgctgtttttatttaaagttttaattaacataacctagtctttgcaaaacatctgattacctttgactcatatgttttctggtatataataatgggttctcatgagttgtttattttataagatctcctgtttactcagagtaaggaaaattttttttgaggtaaggtcttgctcaggctggaatgagtggtgcagtctcaactcactgcagcctctacctcctgggctcaagcaatcctcccacctcagcttcccaagtagctgggaccacaggcacatgccaccatgcctgactaattattgtattttttgtagagatggattctcactctgttgcccaggctgatctcgaactcctgggctcaagtgatccttccaccttggcttcccaaagttctgggattacagtcatgaaccaccatgtccaaccaggaaattttggtattaggaagtttcccacataccatttgtctttggtgccatgaacacctattttgtctaatttttataccaacctttcactttggcacatgggaaatctgataaggaatcgatatcacggaaatacacatcacactttctgcttgccgctttcttccaaaataaacccaaggattccccttttccaccaccaccttaatttagataaccaagataaatgagaaggttttcgcacttgatggtgggatttcttatcaaggctattgaatttggtttggcactgactaattttggtatccatgtgtttttagagtaagttgtagctagggtggtggggtgatggggagactctcactgaatggctctaaattcagtattttattctttaaccaagcagctgttcacacacatttcttaggaagtggctaaataaaaatatggcagccctggaatgaacagaaactgttgctctttcaaaaaccagcagctacaaatagtgatttttcttccacaaatacttgtttttctgtgacattctcattggttttattcagttaaactcccagaccatgttgatttttttttgccttttattttttgagctcataggtaaaaggagttgaagtgattttattttctgtttttgtcttttttttttaagtttttgtagagacaggggtcttgctatgttgcccaggctggtcttgaactcccgggcctcaggcaatcctcctgcctcagcctcccaaagtgtacccagtctcaagtttttttcacattatatatttgtgttctttctgtttttaactaatggtctccattatttaggctatattaaaataacaataaaaacagagcagatacaacagaattcatttggttggccattggagctgtttttcctttttctttttaaactgactttatttttttggagcagttttaggttcagagcataattgagaggaaggcacagaaatttcccatgtatttcccccacacaggcacagcctccctcatcatcagcatcccccaccagagtggtatgtttgttacagttgatgagccgacattgacacatcatcacctaaagtccatagtttacactagggttctctcttggtgttgtacatgctgtgggtttggacaaatgtataatgacatgtattcactattatggtgtcatacagaataatttcactgccctaaaaatcctctgtgcttcatctgttcatccctaccatgcccctaaaccctggcaaccactcatccttttactgatttttacagttctgcctcttctgggatatcatgaagctggtggaataatgcagtgtgtagccttttcatagtggcttcttttacttagtaatatgcatttaaggttcctccgtgcctcttcatggcctgatagctcatttctttttagtgctgggataatattccactgtctggaaatgccaccgcttagttagtcattcatctactgaaggacagctgggttttggcaattatgaataaagctgctatgagctttttaaaaaatagtttaaatgacatatcaatactttaatatttaaaatatctcagtgatcatatagcctcagaaagcacagttttctgagctgggtgtcatgttgagtggtgttagagtgccgtgctgcgtgctcaggtgctatgctgtgaggaaggatgataggagcagattctgtataagcagatgcacaaccacccacagctgcactttggcacccagggcagacaaataaaaagggggcaagatttttttaggggagattcctggcagatagagattttcttcagaatgtacagatttatttttggggggtggttaggggcgacagttgttttaagcagagttttgaaggagtttggtttggtgagtgaaacagtatttcatttttgattgcctttgtttttccagcaagaaagctactcctggtctgtgggcacacaccaaaaggctttgggcaagacagagggagcttgtgtgtgcccccagaccggagtcataccacagttgtcagatcactttgcggcagaccttccgacagtctcctcatctctcttgtggaatttgagtttgacccacaggtagcattttttattttggtggtaccctgatgtttataaggaacctcaggacactattagttaggaaggagattgtcccatgcaattcagccttgcaagagcttcctggttgatctagggacaaggtgtctatcactcagccctccaggtcttttcttcctaaagcaggctttggagcaaagcctgaccggtctttgcctatgactgagtttcccagggctgctgtaccaaactactaccagttcaacttaaaacagcagacatttatcctctcacagttttggaggccgcttcaaagtaggtgtcactgaactgaagtcaggatgtccgcagggctgcgctccctccagagcctctaggaacacatctgccccttgcttcctccagcttctgggggctgccagcgggctccagcctctgccgctggggctgccttgcctcctctgctgtgtcagatctccttctgcatctctcttacaaggacacttgtgggccgggcgcggtggctcacgcctgtaatcccaacactttgggaggctgaggcaggtggatcacctgaggtcaggagtttgagaccagcctggccaacatggtgaaaccctgtctctactaaaaatacaaaaattagccgggcgtggtggtacgcacctataattccagctattcgggaggctgaggcaggagaactgcttgaacctgggaggtggaggttgcggtgagctgagatcgtgccactgcactccagcctgggcaatagggcaagactctgtctcaaaaaaagaaaaaaagttaaacgagtgtcttggcactcccctgtaatcccagctacttgggaggctgaggcacgagaattgcttgaacccaggaggtggaggttgcagtgagccgagatcacgccactgcactccaccctatgcaatagagtgagagtctgtctcaaaataaataaataaataaaaataaacaaggacacttgtgactgcatttagggcccagaacaatcccccatctgaggacctttcatttaatcacatctgcaaaggcattttcatgtaaggtaacattgaaaagtttcaggggtcaggacctaataaattttgtgggccagtattcagcctactgtcccctagttacaacaaggatggggcagcttatggacgagagtgtcaaaaaattcagattctgtcctacagggatcatcttaccctgcagctgagttgagtgattattgagaacatactacgtgttgatgctgttgcttagcactgtgggagatacagagatacataaaactctgcttgccctgaggttgcttgtggttttgttggaagagaagacgtgtgtgtaaaattagtcataagaaaaaggtcgtgtttgatcctgagagccagatagtggtacccagcagtgagcatccaagcccttatctcccaaataggagactttgtaggctgaaaactggcccacagatttattaggtcctgacccctggaacttgtcaatgttgccttacatgaaaatgcccctgcagatgtgattaaatgaagggtcccggtatggggggttgtcctggatgagctgagtgggccctaaacgcagtcacaagtgtccttttaagcccctgctgtgcctgttctcttggtaaatatctctgtgtgctggaacatttgaccagagagagatttcggtgatcatatccatatttgactgtttcctattccataatttgtcgctgtctccgagtcttttcccgggagccccctattacaagtgcacctttctgtgtttattcttccctgttgtgcttcgatgatcccttttttctattcttcagtggctttttctccagtaaaatagcagtttaaattcttgaagggaaacaattaaaaaataatgtctctgggttaacaagtatgattaccgtcatctaaatcagtgatactacatgagaataaaatcaaggagacttacatttacagtagatgaatctatgataatatgccctaccgttttgggtaatttaaatttatgctagttcactctgtctacatgcatgtcatatcttagtgtaaattatagaaatatccctataaaagaaaaaataatttttttctgtatatgttttaagggaacctgaatttctttgggttgtaatgcatgatacagatagtattctgggaatacctgatgttcagcttatccctggaaccctggttatcttagtaaaatatgcagcaacaatatagaagacaatcctgaattttccactgcacaattagggcttgattcaccgtatgacttgggcaaattacttaactttttgaaaccacacttttctgattttcaaagtatgactaataatggtttctgccttaggattattaagatgattaaatgaaataatgcatgtgcaacgtttagaacattgctttaaagtttgtcttttccttctctctccccttttttcctttaaaataaacaaacatgtttgagggctgggtgagttgatgggctccctttagtgcagcacttctaagtaatcactgttccctctggttcattccattgagcacatgatgacaaacatttctggggatatcatgtcaccttggatatagaacagtctcctaaattacattttatatgacaatgtctcactgtatttttgtcctcttgaattgcagcatagcatattatttcttccagcaaaaagcaaaattaaataaataagtgattaagttgctggctgtagctgatactgattcatgacatgactgaggattacttagccatcacattgaattgatgacagttgccttctaaatattatctttagtcacatccctcgaatgtttgcagtgactttcactcctcaactagaatatgcacgtttacatacacatgcgataaggctgaagaaggcttgtggctcagcacaatttggtcttgtatgcacagtaatcattctgaagtgtatgattctgttttattagaaattctcacttgaatttcaagagaataaaggaggattcctcctacacaaagctgctaattgtttgcacactgtgtgcatcccgcatgataagcgatttgagaaggtgccacatcagtgcctttatccaagtgtcacctcctgtctacagttcccttagcagggtgaagggagaaagatgcaaagactgagcttggctgaaacaaatgtatttttgtccccttgacttcttgaattgcagcagagcatatgaataacattgatatatttcttggctgctagacaacaacgtatttctttgacagattgacgcctgaaaagaaaaatacagtatgtactaatgaatcaaaacattttttagtacctttgtgtatactaaatgtattttagtttctatctggagctagttgccatttactgtgggtttgaaatgccctaagttatcttctatggatgggtagaatcaatttacccacacattgacagcttttacagataggtcctgtaacagatataattaagttaaatttcataaatagataggcagtctcctccccagtcctggtccctttgggagatgaattggggtgggggtaatggagagtttcaaaaaggctttccggtgtctttttttaaaaataaggttttaagagtttcatggtcagctgttctcagtttttctcaagatggtatccaaagtaaggctcaaatttatgatttatcttccaaatgcttaaatggtccatttatgatctgccagatgttacaatgactagctccccaaggaacgatcaagaatgtgccaatgtctgggcaagatttttatccagcaaaaagaaaaaaaccataagaattggaggttttactttgaaaagtaaaatcagccacatccatgacttaagagactgtacatattgtcatgggtaaggatttagatcttggctccactgcttactcacagtgtaccctggacgagttactaggcctttctgtgttttactatgctcttttgtaacacagggagagatagcatctatcttctaaggttgttgtgaggattaagtgaactaacttgtgcaaagctcttagaatagtgctgggcacagagtggtgagtgccttgtatatgctaatagttgttgatttatagcttaaaattaattgtgtgatgcaaataggagggttaccaccccaagcttaaatggaagttttgcagcactttgcactcttgaggatgtatctgggtttaatagtaccttccatctagtgcacaagtcttctcccaggctcatcctcccaaacacctctcagtgttatccccactttgcaaatgcagtagtagctgggctcacagaagttaaataactacaccaagtcaccatccaaaaaggttcagggccaggaatagagcgaaagacagaatacggagccatgctctttttgctgtctttctcagtgctcagttctcagaattactcaggaatgagagcagagaaactctgtataggccatgcctggagttttttgcacatggcagtcagagagtcccagctcagttcagtgcagtattaccgaattccagtatatgctgggctctgttaggtgcaaggggttccaggatgaatgagtctgtggcccagtggacaaggtttgcccctgtgtgcagctctgtctgctttactagatttgctcctcagattctaaattggaagtatgtgcatattgcttgatttacagattattagagaatttttttcagttaaactttgtccaaaatagacactaagggcaaaggaaactggtattattacagcagggtgtatctcataagctctgagaattgtacatgtataaagaatctttgaatcgccgagtcttagccccacgttttatacagcacagaaatacagcacagaaagtttaggtgatttcccttgggttccatagtgtgttagtcaccaggttcctttaactctctcagtactctttcctttaaactatggaagagctcaaatgattaaatcaataaaagaatgacaacttatagagctcatttacgtgtctgaatatatcagtttagcccagagtatctgaactcctgggccattgctattcactgaccccttctcctcctcgtgttctagtaaaattcagcccatgaatatagtcattagaagttgaattttaatgaaattgggcgctttgatcaatgggaaggttgaaagttatgtgggaatcatctatatagtttatagctgtgactatgtaggccagctcctaagtgccccctgcaatgtgtcactctctctggttttctttccagggaggtaccctgtagaataacagtctaatttacctctcagacatctgctgtctttcagaccttatgctagttttgtgcatatcttcatgattcctctaataatgcattggattataaactattatctccacttgagagacgctcagagaggctagggagcttactcagggtcagagggagtgcagctgaacagttctgccagggtccctgtgattgttggagcagcctgtgttttttcaagctgttgtctgtgaatcgtacggtagaaacatggtgcgtatttctgcagccttagttctagccattgaaatatcatggagttgaatgcagaatacccattaatgtttaggatgaccaagaaactgtgcccaggccccaagcccagctctgtcatcagaggtgagttaccactggtgccatgccctttgattccctacaggcgccctatggaggtgcccaccagtgtgcacttggaagtgtgatggaacgcatcacatccccttgttgcccctgccccggtgatagggggattcactaagaacttcagcatagtgagagaatgtaactgaagctcctgggttagtgctgcttggtatcccagttactttgtagatttcggaatcttttgtcgtctagcctgaggattactgttgatgacacaattttctttgggattataggcttcatgtttcatacaaccagcatatacgtaaatggcctcttcagtgtatcatgtatacacattggtgaatagcttcccactagataatgttttaaaggggaaaaaaagaagtcatttctaaaatcccaagagagtgtccccgttttgaggttagagcacgttttttagccttatttagtcttgcatcttgctccttatgctacctttcattgctttatgaaattattttttaagggatactttctaacattccatcccactttttttaaagctcgttcatatactttgtcctcacagaatagaacagggtttctcaaattgcacacactgaactctgcaacacaacagttccttcattggagaccagatgaattgaaccactggctttctgaaaataactgtatgctttccagttggccagccttggcagggacccactactactcctatttctcaacagtcaatttaaaatattgacagtagcttaataacattcaatagtaacttgcagcagcctttcatataccctgacatctgagatatgtaccagtttatgaaatagaacacgcagatggtcttagccccattttccagatgaggacccttgtccagggaaggattggtgcccatttagctagctctttcccagcaagcaacagtacccaaggctccatgccccaggcctgggaggacccctcccacggcgtacttcagatctccacctgtgactttgaacacatgcttcgaggtgatgtacttcttggagatagtgctttcctcatctcttctaccttgtagtcgtcagtagagggcatgcagtgcaacagaagtggatttcaggactgagactagggtgaggcaagagaggcatcagaatgcaaaagtgaagtagacacctgccgtcagcactgggcagccctgctcctggggccttacttgactcatcctggtgggttttccaaatggcagaggtgcacaaccacttcttgcaagcatgggcacttgaattgtagcccatgtacacagtgattcttggaaaaagtcatgagtaatgaatggaacttttctctcccaggttgatcttgtgttttgagacataaagagtcaaaggttggtgcctaggatgctcattcttattgtttttggtagtttgattgttgaaggcttttgacacgacattgaagtgaatatttggggcattttgctcctctgggcttttctctaaagcaccctcacatttcctctctcatgttcctgggctttcctggctttgatgctagccccactgtgtgttcccattaatagccctatgtagcctggctccttattctggaaactgtgtaacttttgctcttgatcttaaacacaactcagtcttgcaaggagctccgcctttggtctcagcttcttggggatttccctggcagccacatagtgaactatgtcacactctctgttttacccgttaataaggaaatactctggtacatggagctttgcttgctgatctttttctaagtactctgggggcaaaaggaaaagcagctagaggataaggatgtaactttcttcaaattaagccatcctgacccgtggtagagattagccactaagaaatagtggaaacaaataactgtttcactcttgagtgttagcatggaagagattctggttgaaatcctagtcctgccactttctggttacagaaacttacattacttttcttttgatgtttcaaggagataggagttaaagaaaaatgaacaccagattactagaacattcttatagagttgcccaaagatggaatggacaccttccagagtggaggggagggagtaggattggacagtagtcctcaactgggagcacttcttccccctgaccccacacctgcctcccagggacgtttgacagttttggattgcacaaaactgaggggtgagagttgctgctatatctagtgagcagaagccagagatgcttccaaataccttacgaagcataggacagccctcacggaaagaattatctagctccaaatgttaatgatgctgactttgagataccctagtcagaagtaacatttattggccaggggcagtggctcatacctgtaatctcagcactttgggaagccgaggtgggaggatcacttaagcccaggactttgagaccacctggacaagaccctgtctctacaaaaaaaaaaaaaaaaaattagcctgatgtggtagtacatgcctgtagtcttagctactcaggaggctgaagtgggaggattgcttggacccaggagtttgaggctacagtgagctatgtttgtgacactgcacttcagcctgggcaacataacaagactctgtctcaattaaaaaagaaagaaagaacatttgttgaatctaattttcccatgtaatatcaatgactgtgcaagataaagtggtttttatcctcactttggatgagattggcctttggtgattgagaaaccttcctttggttgttcagctacttctagatagacatgggattttaaactagccatctatatgtccaaaacccatccgctttccacaaacccattatgtagttagctccccatcactgatgatgttcaaagctaagcagggtgagcaaccacttgaaagaggggatggatgaggatacaagcctaagatgtatgttgcactaaatgacttttgaggtccctcctaaagatcacattctctggttctattttgaaatgggatttgtctttttagccccagtgttagagtggcagccagatatcccttggctatgaccagtgaaatccctgtgctttgtgcacctgtgaatcttactcctattaatatcccagccctatcaggccagagggctagggttccaaacaggggcagccagaaatgcaccatcttctgcatcccatctgcattccgggcccaggcagttatttttacctccatatgtaaatgggcccagcgatttctcatttaggagaacagcagaggcacaagtgaggagagctggagaaggaggggaacctatcatatactctgagattgcaatttagtatcagtttgctgatcagtgtcactccactagtttaataagtaattatagtttctcttttgtgaacaaggaaaacgggtagcttcacccagtggttgtcagccctggccaaaaattagaataagatagagggcttttaaatcacacctacaactgagcccctccaccagaaatttaattttctgaggtgaggcctgggtacagtgatttgagaactttgcagggattccagtgtctaagcagcctgggcacctctggttaatggcacacctcagtgctgcgcattctgctccagtacctgctggtgttactctgtcataaagagactagaaaaagagtgagttgggccctgtttctcagtgtgtcttcagtggattgtagggagaaggaggcccatactctctgcctaaacgagcacctgctagactccgaaatctagttaatggaagtttctcctcatccttggacatccttgttttatatggtatacgttcaaaatacatataatctttggtttaatttgttttacaaagttttgaagttttcctctccacacttttctcatcaagctggtgtgtggaaagaaggaatttttcttttccattgctgtcatctaaaattgttgtgtcgggtggggaggggagggagccgggagacttagctttaactacttagaagttttcagggaaatgtttttataacaacctagttaatagtttgactttatgatagattctgttccttcattattttgtcctccagtggcttttatacccagcaaagtggaccatggtgtatgattcaagaagggtgaggagtatgtctttctttggaaaggcagggatggagggttgtgatttagaaagggtaagcaggaaaggagagccacagaaggcaagcactgttctcatgccagatcggtttcaaggaagaggacatatggaaggatctagaaaatgatttctctagaattgtccatgtccaagtcccctggaatgtctttgtatatccccagagctgtgcatgctccagtttgaagagctctgctttaaaagatatcaggggtgggggagatgaggggggtgaagtaaaagaataaaaactattcaattccatttgttttctctttcaagctcatacgttactcatttcatttttatattaaaatatagatgaggaaggaagggcacatggcaagatttggcaagcataatccatgaggggatatggagttggggatggcagcatagcatactaggatttttgaggagggattcggggagcctgttcatgttttccttacaactctggtacatgaagtacaggttctgcatcatgatggaagactgcctgggttcatgtttgggccactacctactagctctatgactttgggcaagtttctttcttcttttttttttttgaaatggaattttgctcttgtcacccaggctggagtgcaatggtgcaatctcagctcactgtaacctctgccttttgggttcaagcaattctcctgcctcagcctcccaagtagctgagattacaggcaaccgccaccacgcccggctaatttttgtatttttagtactttagtacagaccgggtttcaccatgttggccaggctgttctcgaactcctgacctcaggtgattcacccacctcagcttcccaaagtgctgggattacaggcgtgagccaccatgcccaggcaagtttcttaacctccttatagcagtgtttggcacatgatagatgagctacaggttggcttgttattccttgcaatcctgagtttctccccagagtaaagctggagcttttcccccagccaactttggtggagtccactgggcagagatgtgatttcagccaaaatatggctaaaggaggaaaggatctgagacagccaggtggaaatggctccccgggagagcctctgaccgacccgcacactgggaggagtgcgcactggggtggagccttgggaagttggagccatttgcagcagggaggagcctggcccctcgtcttcttggatggtacctaggattcagtctgcgaggcaggaagcacactagcaggactccagcttggtggagagttcctgctttcctttttttcctttttgtccaataaatcccatttttctcaccctttaaattgtgagcctaatttttcgtagtcatgtgacaaggacccctcttaagctgaactaaggaaaagtcctgcagcagatctaactagaatgccaatgcctacattgaggctgtttaatggagagtttatgaaaagttagctagtgtccttgtgtaaacctgtatgactctagttcagagtcttcagtaattgcaattcaagaataaaaccacacggcacttccattcccgtgtaatttgttgttgctggcttgtgacattctacatatcccaactatgagacagccaggcagtgggatggactgtgaggttcagatgcccggagatatgtgaggaagagcttttagcaataaatatgaaaatgaaatcaaagtaaaaactggcattgaacccctggtgtacttaggcttacttttacccaaatccaaatcatttcttgacactgcatggttaccaagagtgtctgtcattcaatatttcagattaagatctgttctttggtagctaagttcagagaaaaaaatataggatctagaagtatcattgctattttttccttgatacatttagtctggtattaaaattgcttgcagaagatttgattttaaaaaagtagaaaagagacacttatcctggtaaaattatcctgaaatcttaagaaattaagacaaattgcaccataaaaccagaagcacaaaattaaacaatattatattaagagaacccagtgacacattttccttctaaattaactttaaaattaacttttaaattaagttcaatctcatatcagtttgctttgtaagaaatagaatatatgtacatgtttgccttatttttagcatgttatattcattaaaatgttttagtttattcagcagatacatttagcatttctttcacaagaaagacagtgaaggaacaattaataacaggaccccagtaatacctggggggtttctacatctgcattttttgcaaaaatagaatagccttctaagaagctgtcagtggcatttgtgcagctggacagctttgcagcagatgtaacagtaactgtgatgccaggctgtgccccagaacctgtaagcatgacaagctctggcttcttccctcctctgaaaaggtacaacattgaagaggcagtcgtttcccctagatctgtaaccaagcacatctgggtgaaaggggaagacatctcttcacagagaggagaataaaggcggtgaccatcagggtgacaggcagcatggactgttgccacctgtgctgcaggcagcttcagtgcctggatggtgggacagctggtcctgcactcagcacgagtctcaggcagtggtctggccgcgcctcccttgggctgcttcttcctccaccgtcctccacttttgctttgtgtctgcgtcaagtcagtaacgttggtctgcagctcccatccctcctgatgggcactgcactgaggccttagtgggcattacctgatgccctcatcacccagtgtacaaacacctgctgacaagaagcgtccctgagcggaacccttctgctgggacaccgcaccttccgtgtcctgagtgggctgcaccctcgtggtgctcaactgggtgacttcacgctgtcctcagcgctgtcctcggcgctctctctccagtcagctctcctgctcaggcacctttttgggacacagtccttgccagttattccctgtttaatgtcctcatgtgtcttcacttgccctgggagactgtcgtcttgagagagcaagccatatgggaccctgaggcctggcctcagtttccctcccccccactgccccacggggccacgcctcatcagtggcatggaccttttagtcagcgagccctcagccggatgctcccgtgctggccactcctgtcatccctgctctgtcctccctgcaaactcctccctcaggaccctgcttgaagttacgtcctgcacagtcatccctggccttccctcagcagaatctgtcactccctcaaggtgtccctgcagtattctgctcatgcccctgctacgtggcagaactctgttgtcctatcctgtccagagctccaaagcccccagaccctgtggctgctgagcacttgaaccatggacagtccaggtgaggatgtgcggggagagatgcctcctgcctgtggctgagccctgcctgaaggagctgatgaggaaaagctcctaagcacaacagtgctgctcacctgggcatctagttggcagagtcctatcccagtgttcgcacccccagtttcctgggtcttaagttcagattatcaagtgctcctcctgcaaaaaaaaaaaaaatggtgattcttgtggcccttagttgaccccgcacctgggatatgcttatatttggtgtggggcagagaactgagtgttcttgaaccacttccacccaaccagagggaggtggggacatcaggtacacctcatcccctgatgtcacagccaagtacctggagccaccaggactccctctgagcccacaaaggagtgtcttctcaccaccccgattatactggtctagttatgctttggagttaaagccaggctgctattgcagggctgctgcaatccttgcaagcacagttgttctttgcttgcgcttgctctcgctctcgctctcactctcactcttgctcgctctctttctctctctctgacttcagtttaactttttaaacttcagtaataagtgttcctcaaaatagatggtcttcctggttgtaggtacagccagcagggttgagttctgctgccttccagcatggttttcctggggcctgtaaaagtcctgcaaatttgctctgacactctgttgacatggaggtcctgtttgttgttataaataaggaccagtgtctctaggacacaccttactgtgtataactgaatggcagattttgtcccttacttcttaaaaattaaatggcagaggagctggccatgtaaaagccctgtgtgtgtttaccaaaaagtacttgaattttgtttgggttttgtgttctggtgcatatgaagtgaattttggtaggagtatgtgcattcagagaatatgtcatcacacttttttctttatttgagtgccacttggctcttatttgattaaggtaatttcagtgacatattttgaagcaattcaccttgaaaggcagaggcaccacccaggtgcagaaaccttccttgggttatgcaacgcccagcgtgggtggaaccgcactcacactttacctcttcctgaaccacagccctgctctgattgcatgatggaagctgaggtgcctgacaagtggaaggaggaaaaggaacattctgccttccttttctctgtaatgccaaagctggcgtcatgcattactgagggcctctgtcagcactggggccggccagtggcacagctgatggggtagctgcactcgctagtcctctgggaaagcccaggttgtttttctggcttagtgttagaggcagctgtgatgtttacctcgatctgtaacatacaaagatctgatcatatgctgtctttgcttacattctattattgtctgacttatgttctaaattctctacaattcccttccatttgtcttaagaaactctaaacctttttttttttggaaatcactacttaatgattttgaggatggaaccccagacagttggtaatagtggatggttttccttttctgtagttgagtggctttctaattcttttgatggcacacaaaaagaaattaaccttagatcacaacttagtacacacatttatgtatgcatgtaactgagatgagttcctcaaaatagcacatacctgtgttttatgtgaggcactgatattttctgttctatattatgcttaactttaaaaaatacttcctgtgtaccatttgtgggactgtaactcacaacttaaaaaatattaccttgatacatagctccagaaatacacatgggtcattttaccaagaatcaccagtgcttttgctctgttaccccggctggagtttggtggcacgatcatagctccttgcaccctcaaccccctgggctcccagctgggggtctttaggaccccagcgtgacctgtgggtagcccttacttcctttaatacttttcttctgcacagtcaggtgctctccctttgagcttccgtgtgaagttcactgtgcacccagctctgctaccaccgcctctgtcttgaaaggaatagggtggggtggtcattggtgtatagtaagattcgaatcacatccttcaagtacagttctaccctaaagataagagtccctgtggtttttgttgttgttgttgttgttgttgtttgaatggatgtgttctttgagaaattgagtcttgagtattttgtgaggacatctaagcctggcgtccacgtcagtgctgacagatttgacctagtgtgcactcccatctggggaaatgcccataggctataatctctttcactggagcgattataatagcccccgggcttcaggtcccagtggcatccacccttggtggcagcatacccctctgcatgaacagggcgcccacttgtcccctccttcttacttagtagtgatttttaaatgggagggtggcagtcctgaatgtagttcatcagtatttaccgcacaagctctaaaggacacagtgttttatttgtgtatttatttaacttttccaatatcggaatatgaatttttgtttcacctgataggacacgtttcaggggctccattctacattgtcatttcacaggaaaaatatttgatggctcattagaagggaacatctattattttgttactgaaaggcacattttcaaccttgagaattggatggcaggtaatggcatggaaattgacagcattttaccacttaaaaataaccacaagaaataccaatgttcaccgaatgagttgaagttaatttggttttgtaggctattgtagttaacttgatgcttgatggaaataattttgtattggaaatcattaaaaattgatttgattaatgcttttataatgttggtatgaggtgttgcactgtggtggtgatgacctaagggtgctgtgatggcctcaaacgttgtccctccggggcccacaggcaggatcccacacactagcacacctcccagttcctcttaccatcaaacagaggtgttccttcaacatgcctgctcctccctgtggcataaaggcaccaggaggttctctgatcccctgttagatctcctctgcagggttgaagacattttttgtttgtttgtttgtttgtttttgagatggagtcttgccctgtctcccagactggagtgcaagtgacatgatctcaactcactgcaacctccgcctcccgggttcaagcgattctcctgcctcaacctcccaagtagctgggactacaggcatgagccaccaagcccagctaattttgtgtttttagtagagatgggatttcgccatattggccggggtgatctcgaactcctgacctcaagtgatctgcccgcctcagccttccaaagtgcttagattacaggcgtgagccaccgtacctggccatttttgtttttaatcggtgtagtgtccctaacctaaatatttcacatggcctgaactttctgtagttttagcagcaatgggatgctttgaaacctagatctctcaccaactacatcttccattgactggtgaaacactagtttaagccaattcattttgaccatgtgcatttttgtgcttgatccctattttatttcaaaaataatttccatctctattcatgtaaactaataagagccttccgtttcctttaatggcaaattgtctcatcttttactgttttaaaacatttttttaacatcatgagaaaacgtgataaaaggtataagtgtagtttcctggcttttgcagtacctcagggaattcggtaaactgtattccatttgaggaaaggaacggttggagtaggaggtagtgtaaagataacatagcaaataagcattttaccagaaccctctgaagtctcatcagactgtgccatcatcagaatccctcccttctcatctacaccgtttaaagccagcatccagtcagaagcccagagctggtaccgccttgctttcctgccagttgctgacatatggcacacagtgtcagttaagggcacaggctgatgggcagcttggccacatacctctctggcttcctatctgtaaaatgggcacaatcattgtacctgcctctgaaggttgttgcgagaactagacgcagccttggcacagagcccacagagagtgagcactgtgtaaagactggctgccagccattagtactgggtgcctgtcttttggtgtctgggcaaagctttaacctgttttatcagtttagaactcagatgtctccctggcaaaacaacacgggcatatagatattttgtgaagttttgttgaagtgcacttaggttaatgattcatgggcagcctttcaaagctatcaggctgtgaaacagctttgaataagattgtcttgtccttctgctgattgtcttttccttcccacattagcagccatagcaggaggaggagaggtggcaagtggccacactactctgctcacattaagcagacaatttatggtcaatattcagtgaatttcttttttttatagtacagttaactgatatttatattagctttaaaattatagcaaaatcaggccaggcatggtgactcacacctgtaatcctagcactttgggaggtcgaggagggcagatcgttggaggtcagatgttcgagaccagcctggccaacgtggtgaaaccccatctctgctaaaaatacaaaaattagctgggcgtggtggtgtgtgcctgtagtcccaattactcagtaggctgaggcaggagaatcgctttaacccaggaggcggaggttgcagtgagctgagattgcaccactgtactccagcctgggcgacagagcaagagactctgtctcaaaaaaaaaaaaaaatagtgaaatcagccaaatagagaactaacaggcacactgcctaattccttgtgtaactgtcattggtgtgagtcactggggcagcgtgattaggtctgtgagctggatagcaaggctgtcattattctcaaggccttctgctgactgctgctcttggtaagacatacagaatctgtgggcacctcctcttaccgctctatgctagatgaggcgtctccacgttgagttgtagtagatacagctaagaaagtaaaagaaatgaaaatctcatcaaaaggattggggctagtctcattcttcatgcatacccaaaccgtggtaactttgatttttttattatccagaatggattgtttagaggagacagatggctttccagttcatcaaattttttcaattatctaaaaggaattcctacgcttggagcaagtcatttcaataaatctcattcatatttacctgctgcttccttttaaatggaagaagagaatgtttttcaagtacacttgaaaaatagcatatgtgaattagaaacttcctctgtaaactagcagagtagaaataagaggccaggattcagcaccaggtaggctggattccttcttaggtggctcaagctggctatggggctggtctcatcatatctaaagaactgcccagcttttacgcattttgaatgtggtggaaccagctgcatctttttatatgagagcggcaaatagtcattgtgttccagtttgcttctcgggtcatctaaacatcagaggccatgccacaagcaccgtaactgagggatatagtgtgactgtggtccaggccagtgacctctggagctgaatcatgacttcccagatgactcccagagcctgagaggggactggtgcgtggctccaaatgattttcacctgggcctctttgaagtcgggagagatacgtgcagtatggtagatgtggagagggagaggcatggtgtgtccaaaaattagcaggacctgatccatatacgtggactctgaagcagtgcacttactagattaaaaaaaaaacaatgtacttactggatttaaaaagtgtgtatttttttgtgagatgcagtttgtaagatgcattggtaactaggccatatactttttccattggctctcagctctcaagaagctctttagtttttagcattggatcagtaaacacttattaaaatgttcccagcatttgtttgccatcttctctttcagctgggcccagctgtgccctcaaaccctgcctgtctcttccctgactgatcatgttctcccagcttctacagaggcttccatagcattgtgcttggtagcagacaccagacagaatctcagccagctcagtccaggcgcacgggctcctggtctcccggggtgtggttactcgtgtctcctcggggccttccgccctccacattccagtgccaggccctggacctttgtctctattcatgataaaacatttttaggaaatgctgacgctcagtgaagaaatggaaacactaactctttgttctcttcctaacagacacgagacgacttcctgggccaggtggacgtgccccttagtcaccttccggtaaggacagtctcatgtttgatgcttcgtgctgggggcgggggtttctaattgtttgtagtcagtgtattttcagagtggcatttcttcaccacggtgaagaaggctgaaatgaagcacgtgtgctgtggccttagtcctttctggaaagtggtcctttcaaggggatggaggagaagctggctgtaagagtagtcaagggtgcctgagtcgtgcgcttgcgttcccatccaccagctccctctcttttctgcacttcagctgctccacctttgtgtatcacatcttacaaaacagacacctccttcactcaggcctcccttcttgtcacttactgtctctgcttcctaatgcatcctccgggtcccatcagatgtttgcactctttgtctggaaccgcacatgccatttctcttggattcctgtacacaaactataatagcatttcccagattttggtgtctggctttctcagtcagcatggtgacaaaagaagagcctgttcattctgagtgaacttgtcagctgggaacacccaccctcgctggaacacgcactgagttagcatgtgtggtgctgccatttctctctgctcaaagtagcggagcagtcgaggctgttgactagtgacgggcattagggctgacacccgaaacaggaggcagggcagacagaatgtgtaggtaggacctggaggccttgagaaaggtggatccccatctcctattccagcttcagttttccggcttgtcccagccttcctcctggccttcttccctgggcagcacaacgacgtgatagaagtagcagctgagagaggaaaggcgaatgtttctgccttacaagggcattgtgttatttttttaaatgctttgtgtgagcaaatagcataaatagtctataaagtaaagtgactttactttatttactttatttaaagctatttaaagctagcataagcttcctgctgtgtggaaattatggctgtttccatatgttaaataccaagtaagctttgaagatgtgttgtgaaggaaggtgatagcaagtaatttactcttactcactcaggggagctgttaaggaagaaagtcgcaaggttccaaaggactggaagtgaaagtgatattcttaaaatatcttgtttgtttctttttaaaactctgaagctccagggtgccacgggaggggcctgcccagggcttctgcgtgagaactactccatgagccatcagaaacctgactgctcttctcaggtcacgttgggaggatgtgactatttcaccttttgtgagcaaagacctcgcatccttctacgttgggaggtcttctgtgtatgttcttcagactgaagctgcgatcctctcacacttttagacagtgttggttgatgggccagctcttttatggacgtctccagccaccctttccctaatgtaaaaaccacatcttggccaggggaaattattttctgagaggcaaatattctaatatttggtaagaggcaaaagtgacatgtttaaaaaccttgctctgacaagctcttttttgagtgagtgagcagcacctggtcttgaaaggttgagtagggctcccagaaaatagaaaaaggttcctcctccgaggccaagtcagtataaagaatagtttagctttggattctgagtggaggcagggtcagtgagccttcaaagaaggaagcggtgcagaggcacagggcaggaatagaagccagccgattgcagagggtagagccgtgaacgcccagagaggaccgagtgcccctagttactcgtgtgcccagagggtaacttgcagtggcgtgcttcacctccatacttcaaactgactagctgttcacagccaactatagtcagagagatggaccacaaagaaaacaaaaggagaggcgtgaaggtatattctttattcatgtggcagtagaacccaagttgcgtgttctgaatgcacgtggcttttgaatccaggatttcaggtgctttcgtgtgtatgtttggtcgtgtgtataggatgctcatggggaaattacagtggcattctgtttgtgtgatagcacacaggtatgagtgtggagagggcgggagcatatgcgtgtattttgtggatcgaattatggatgctgtgttcttgattagtatatgaccattgtcaaggtggattattaacagtctgtagattcaaaatttgtcaaaaccaccaagctttagataaaaggaaatagaccaggcacagtggctcatgcctgtaaccccagcacttttggaggccgaggcaggaggatcgcttgagtccaggagttaaagaccagccttggcaacatggcaagaccctgtctctatagagaaacttaaagattaacccagcatggtggcacatgcctgttgcctcaactgtttagaaggctgaggtgggaggatcgcttgagcatgggaggtcattactacgctgagccgtggttgtaccactgcgctccagccttggagacagagcaagctctccttttgcttttacattcagagaccaagagcaaacttagctgtaactgtaccatcattgacttttcaactgccgttttcacatttgtctgttaaattcagtgcatcgttgtctaaaaattcatatgatatttgataacttgaatctattaattatttagcgataaagagaactctgagatctgtattaacagagtgagatttctggcaggtgtctgcctgttgcaccttcctcttgacttgtcagctctgtctccccttcccctggagccctcagtaacccacctttgcccagccacaaaatctcttcgtccctgggaaaggcagtggggcagagagagctattttaaaacattaagttttcctaaatcccagtcatgtgccacttaagacaaccatggctgactctggaatttaaattttcctagatgaggcattttcagggtggtggtattatttgatgccctgcctgtacttggaggtagctcagctgaccaacatccttttaccccttttgtgtttatggctgatggctggtagcaggtagcaggctgatggttccctctcatgagtgcagaattcaaaatcatggagtttggagggacttcagagacactgattcactcccagtattttccaggtgaaaaagcctgggcccagagagggaggggacttgcccagcaataagcaggtcattggtggtgctggatctgaccctggctctccagcatcattgtgagcctgtgatgtggtcaagggtgtgggcatggggtggattcgcccaaggcttaggtgcttgcagtggttgcatacaagtttcgagtctagggacccagcagggccctctccttccatttgcctgcagaatcctttatctcactctattccatagtgaatgcacctaggctgaaagcaactactctctttcaagatgaaagtactgagtatccagattttcttctgaatgcttttaccctggaacgggggcagcattgtggctattgtggctaatagcactgtttgcagcagtgtgtttaagatggctttccaccaggagcaccctcaaagccatcctgggaggctccactcagctctgctccagggaacaggatcagattggaacctggatgaatgccaagaagaatcttgtagttatctataagatcatcttctaattcaggctagagaatttcaatgaacgtgaactttgattttaatgccctacctgttactgcttggcattgagttggcagtactgacaaatgatatgaacgtgtagaattggccaatgaacatggctagtgtttgttgagtgtgccaggtgcccttgagaactttatagaaaccaactcagttgattggtttgatcctcacaacagccctgtaagttatggttactgccccattttatagatgaggacactgaggccaagagagataaggaacttgcccttagccacttggctctgtaagtaacaaagccaggatgcaaacctaggagatctgccttttgacctgtgtgatatcagtcatttaagctgcatagggtatggacagactcaggttcagagtccctctaagctccgtggttttccctcttcactctcttgcatgttctctgctgctcctagattgctcatgcccactggtgatcctgtaggctttgtcatactgtttgatttcctatgtttaaactgtcctttctccctgttctctacctctcaaagccttcccatcaccctgtattgtattgaactccacatccaaaaccattttgatttccaagtcagagtccgtctgttccctgtaccccaagtctcacagaatgtaacctctctgtgtcagtgaatttgttctgccttagcttctagtggattgttgacatgatggctcttcccttgtaattgtaaccataaggactgctataccatgttgtatccacatgtcgttgacataatattgctctcaaattatttgttggttggcagggcatggtggcttatacctgtaatcccagcactttgggaggccaaggcaggaggacgtcttgagctcaggagtttgagaccagcctgggcaacataggaagacccccatgtctataaaaaataaaaatattagccaggcatagtggcacacacctgtggtcccagctacttgggaggctgaggtgggaggatcacttgagcccaggaagttgaggctgcagtgagctatgattgtgcccctatactccagcctggacagcagaagaccctgtctctaaattaaataaataaatgttggtttaataaatgaaaaaaggaaggaaaaccagcaatagttttcttaataaattatccatttatttccttatatatatttacaaaccttttggtagaaaatattttcaaaatgtatgtttattactgcctcataagaacagtctagaaaatataatttacttcattcaatgatagtgaattttgagagcctccatagtttactacagatcagatgaattgagtgcttacgtgagtacctacttggtgccaggcaatgttcttggcaccggtgatccaatggtgagcaaattcaagtctctgttctcatgggcttacattctggaagtgatggataataaactagtatgtcaacaaatgaacaggtactttcagaaagtgatatgaggaagatacagcaggacgataggatggggggtgataagggtggctgatggtgggaactctaaaggatgagacctgggatctcacacttggatggcaaagtggaaacagccatgccatccagagtcagctgtccagcagagggacctgcctgtgcatgggccctactgcagtacatataatctgcatccatggcagatgaggacaggatggttgggagtacaaggaaggaagagagagactggttcccaatgaggttaaagttgattcaaggccagattatagttggtcttctaagtcataggaaagaattttcagtttattatgagaggagtaggaacccattgagagtttaaagcagagaatgacataaacagataacatttcaaatagcagtgcatacgtacatacatgtgtgtgcatgcacgcgcacacaaacctgatacagtaaatcactggactggtttatctcttgctataaaagtatttgaaattgtgtttaattgaagggtctaggtatttgaggttttactgaatatatagtatttaaagattaatgaaatagtcacacttatttatccaatttcctgctttggtaggaacttcacaatgaacttcacacaatcaaatgaacactgatttctttaaaaatgaacaaatactccacttgtactcatagcttcatgaactgaacctcagcagaaggttgatcggtgctgcttcctggggtgatctctgtgcaggagatagtctttcaattctcttaggctgatgttgtgagattttaatacaaaaaacaaagtttccctcaaagattaaatcttgtatattcttctgtttactccacccatatgtgtctcgagtcacaggcatatagcaaggcactggtgaccgctggttctccgaagtgaatcagctctgtgagactgaggccacaccctgcagttagaaattttacttggcaatgacagctgtaattttgtcatttgtctgtggctggggctggctcctaaaacccggtgtggatagtgacatctagtggatctctagtagatcagttccgtggactgtcaggtaccaagtgaagaaacacattcagcggtgccacattctaaaattcaaaatatattctctgtaatccagttgcctgtatctaaaacatgaaattattaggaatattaaaatttaatttactgttttttccccacagacagaagatccaaccatggagcgaccctatacatttaaggactttctcctcagaccaagaaggtgaggcttgtgggtatgggtgggtggggatgcctgccctgcatgctgtaggtataggtggggatgcctgccctgcgtgctgtggatatgggtgggtggggatgtctgccttgcttgctgtggtgtgggtgggtggggatgcctgccctgcatgctgtggggatgcctgccctgcgtgctgtgggtataggtggggatgcctgccttgcgtgctgtggatatgggtgggtggggatgcctgccttgcatgctgtgggtgtaggtggggatgcctgccttgcgtgctgtggatatgggtgggtggggaggcctgccttgcatgctgtgggtataggtggggatgcctgccttgcgtgctgtggatatgggtgggtggggatgcctgccctgcgtgccgtgggtgtgggtgggtggggatgcctgccctgcatgctgtgggtatgggtgggtggggatgcctgccctgcgtgccgtgggtgtgggtgggtggggatgcctgccctgcgtgctgtgggtataggtggggatgcctgccctgtgtgctgtgggtatgggtgggtggggatgcctgccctgtgtgctgtgggtatgggtgggtggggatgcctgccctgtgtgctgtgggtatgggtgggtggggatgcctgccctgcgtgctgtggtggttggcttttgctgaagacgattttaagtgtcctttgaagtcacaacccttctaaccaattttcttccattatgtgtgcagtcataagtctcgagttaagggatttttgcgattgaaaatggcctatatgccaaaaaatggaggtcaagatgaagaaaacagtgaccagagggatgacatggaggtacgtggagggcgtcaggcctctctccttgccttgagatcatattcatgttttgctttcaaactttataattgaaggaaataaaagtttagaaagcttaaatataaaaaaaagtacatatgtccgcaaattggtcattgatagtctaccagtgcagttatttgttttggttaaagatgaactttttatgttacaacaccaatcctcggagagatttctctttagacaatgccatgcctattccccaattttagccccacagctctgtgaaagtctcctcacacattgaatcctattattgctatggacttgcaactctttgtaaattctttttagccattgaggtcgcttcaaagtgggtggaggaatttagaaaatcacttttttttcaagtttcttactcatttggccacaggtgacagcctgcagtagaaaaaccctcctctagaaatgccattctgcaacgagctgaccagaggaatgtcccttttttccttcctgacagagccgcctgtatttaccttgtcacagactgatgctgtgggtcctatcgtaccttttcagcacacacctcggccagtgctgttttgttaggcaaattctcatattctcaaagtgtccattaaacgagacctctctagggcttattctcacatctgtttgcagctgttgcatatatgtgatatgtgaataatgtgtgtggagaagttacccgaacactcctccgcctgagagatcatatttccaggcattatttcatttacaagccttcatctctctatatacatgaagaggaataatgtgggtgatagaaatttatgaatgttaacatttcataagcatgtcaacagattttcatctcaaatccaaggaattttttacactcttcttgccttccaaccgcagtaaccagtgaattacttaattttccagtgattttagcagaggatgttaggaagggaatacgtaatgcctaaaatacgtgctgtaaaaatggaactcgaattttggtaccatgaaacccgttggtgtggacacagccagtgtagagggcctgagtagaaggcagcagcttccagactcctggctcctgcggttgtttgggatgcaaagaggaggcttctctctcaaagcccacctccctggggagcaacaggactctgggcctctggtcccctgtgccatgagttctgttagaacacaggtgcagcgcagctcatcttccctgctccctttacctcatagaggtgttgaaaagatggcagctgtactgtgacgcacatcattggcagggctttgtacagccttggaggccctccagtcaaaataacaaacatgacgtatggaaagagtatgatgtgacttaagtagtgtcaccgactgtgcagatccaaattgtgttgtcctgcaatgtagtcatcttagagggcagcacaattaattggccattactcagaagatttttgaggcctttctagaattgatatatatatatttttttggccttcatttgggaatttactcaaatgtggccccgaagccatggctagagccagagagccccagagcaaggagaagggcatgcagggcatgctgtgatgacctcttactcacagccgaagaaccaacctcataatcgtccctttaactttattccgcagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatgtgagtaccgtgtgatggtcaggaacacgtgcacgtgcactgcacagctagggacaaatatggcggccctttgggacaaggctgggaaataaatcatatgtctataagagcagatggtggtgtggtacgagattcctctccatttacgtaaagcatgcaagagcagtcagaacttgtatattgtaagcgattgcctttgagtcacatgctgctgttttcaatatgagctgatttattttctatgtcttcttttatgtcgattcctgaaatacaaagcagaggttgtttttcttagacttattttacatttgttgattatattgttttcttcttcacctttctctcccaactgacccagaacagaaccggcaagcaaattggctttgcaattttctgttttctctaagtttttggatgtttactctcttcaatgcattgatttggaaacctcaaaaatttttttttctttaaggaaatttgagccccttaatataatcagaaacacatgggagagttgcaaaatcagaattagtaattactgtgtattttaatccctcaccagcctcagggatgcagtaaaccaattcctgttttgttccctcagcaatttgtggtttgattgatagcaaataaacactggttaaaactcatggactttaaaaatggttttgtagcagcttgtttttaaatcattttatacagcaagatctaagtctattgataatacatcgaagggcaaaaagaaagtcttaaggaaaaggaattttatcctagaaattatgagctgcctagcagccaagacaaggaggaaattatcaatgaactatacaactttcagtatgtaataaaagcaagtctactgggtagtataattttcttgtctactcgaactctgaaagaaagtggctaatgatacattttagacaacaagcagtatgaggtatcatgttcttaaaaaccttttatctttagaaattgtaaagatactccacatatgactgtgggtggggagggtggccaagttttctggtctaggttttgtttaatttagagataaagcttgcagaatctggaacaacgaatagcctgtcttctctgagcccccaggtgggttctcgtgaatgtcagctgttcgtgatcagctttagactacccagcacgggcattagctcaggacagcaaaatggtctcaggacagcaaaaatatcagatcagctgggtaatgctgaactatcttttgttaaagttttttcccatggaaatagcttggttgattctttttgttttttatattattgcttactatttccttttgattaatgcccatagctattagaattattgtaatccattgtagctatttgtagtaaaaatgaatttggacccaccttgggcttggttacatgtagtgactagaagaatcttggtagcaatatcctaagcaaagcaccattacctacctttgctcaacagcatgagaaaggagtactgaaaaggtagatcctcatgcgacctctgcagaaaagtggccaggagcaactcacaaaggaaaaaatcctgatagctaatatgtatatggaaaaatattcaacttcataaataaggatcatgcagattagagtttgtattttggggacaaatagggataattgctactttctctgcctcacagagttgtgaaactaacgagggaattcttgagaaaacacttcatacattttaaaatatatactatttttttgatggctccacaggtgtagacatgtccccacactcatcaagaggtgtacgttaaacatgaacagctttttaatgtgttgattagacctcaataaagtgatttaaaagagaaaccatctttggtggcagtgtcccagaaactaaaacaaaaggtataacttgctggctcttcactagtctagagcaacaagggaaaaatgcagttctttttctgttgttgtttgagacagagtctcactctgtcacccacagtggcaccatctcggctcactgcaacctccgcctcccaggttcaagcgattctcctgccttggcctcctgagtagctgggattacaggcgcccgccgccatgcccagctaatgtttgtatttttgtgaagatggggtttcactggcttggtcaagctggtttcaaactcctgacctcaggtgatccgcccacctcagcctcccaaagtgctaggattacaggtatgacccaccacgcccggctgaaaaatgcagttcttaatccaagttcgggctcacatgtagttttgggagaaggcagaggcataactgccccatcaaggaggcagcaatgccaaagggagaggctgagccaggaaggacacagcagaacttggcagaacctgaggagcgcctccttccaatgggcataacttctagaaggcaagaggaaagttagttaaggaaaaagagtttccaccacaacctctgctagcaggccctttattgggatacagtataagttcatttcagaatgtgtgagaaaactttaaaatttgtgttttagaaagagtctataatgagtgttcttgataagtactatatttcagttagtctgaaatgacgatttcaacttttgagatactgacttgtgacataatttttgttaatgggatatgttatcttattgaaagtatctgtgagagttttccctgaaaaaatttttggcatttaaacttgtacactaaaagcctctgactagtatttcccccaaagtatgattgcctataatttactgcaaaaaaaaaagttttcttttttctttttttttttgttttgttttgttttgagatggagtctcactctgctgccctggctagagtacagtgacatgatctctcagctcactgcaacctctgcctcctgggctcaagtgattctcctgcctcagcctcctgagtagctgggactacaggcacgcatcaccacactcggctaatttttgtgtttttagtagaggcggggttttgccatgttggccaggtacgtcttgagctcctgacctcaagtgatccgcccgccttggcctcccaaagtgctgggattacaggcatgagccaccatgcccagcccaaaaaagtcttccaaattgaatcaaaacttttagatcctgaattgagaacatcacatgacaaaaaatagggtatgatgttttggtgttcttcagaccccggctgacttgagaggttatctcctgatgttattaggatttttaaagtagggtaaaggaggtaaatgcagtgtcacgattttgagattctgttaaaatgagctagaaagcagctgaaaaaaattcatgttggatcaggtgtactttcctccagatgacagctttgaatttgtcccttttgtagtctttggtcaaattgctggtgaccagaagtagctgccttgtcattgctggacttctagaaggattgggactgcccagctgctgtgtgaacttgcctgtcacctctgcttccagaggtctgacttgtcactgtggcaaatgggcagaggactttgatttctgttttttattaaacactgaggtatattttgaaatgtatgcctgaaagatgctcaaaatggtgtgactaatgcattttaaaactgcatttatttgattgaaatgaaccttaacctatactttagccgtaatatggtgggagaattctcacattggatgaccagctagttgtcagtgtttgacgctgacactttagtggccatctggccctccgtgagcattgaactgtcatgaagggcccgatctcaaccacttctcttcttctctttccccctttcctgcatgctcagggacgtgtcctcggagtcggacaataacatcagacagatcaaccaggaggcagcacaccggcgcttccgctcccgcaggcacatcagcgaagacttggagcccgagccctcggagggcggggatgtccccgaggtacgatgtccccagaatggtgcaaagcccggcagctccttcttcccatgttctccagcttgattttatatcataatttcttctgtcagtaaacattgttgagaatgtaaagattacagtgacgcagggaattaattaccatctgaatattaatttgaaagtgcctataaaagccgtatttgacaagtataggtggctctatattatagaaatgggaataacattatttttatttttattttttttgaagacagtgtcttgctctgtcgcccaggctagagtgcagtggtgcagtcttggctcactgcaacctccgcctcctgggttcgagcaattctcctgcctcagcctcctgagtagctgggattacaggcacgcatcaccacacccggccagtttttgtatttttagtagaaatggggtttcaccatgttggctaggatggtctcaatctcctgacctcgagatccgcctgctgcctcagcctcctaaagtgctggggttataggtgcatgccatcacaatggctaattttttttttttttttttttcctagtagagacgggtttcaccatgttggccaggctggtcttgaactcttgacctcatgatccacctgccttggcctcccaaagtgcttagattacaggcgtgagccactgtgtccagcccacattatttttcagtatgaaaatcttaagatatttttagtttgtaatttatttttcacaggggtctaaccatgtctcattaaatgacagcttgtttttatcatagttgagctgttgaatgagccctgtaacttgtttgggtatcatatgcatatttttattgagtcgctttgacacttggaagagatttattaccatgaaaatataaatttaggtgaacagaaatgtgtaattttccctttaaatagttatggtatgttacttaaaacgttatgaattaaacaacaaattagccataatcttccatgctatcttaccagctctgtttatgtactaaaaatccattcttcttagacattgtgttaggaagatcatttagaatgcggcgattcaacttggaaaagcaaaagtaatgattccataacacattcactctaagttattttataccattgtttaattacagcgtatagcttctatgctgctcccacggtgaatcctcagtggttaaaagtaaaagaaaatccatgacaattgtttataaactccagagaagtgtgtgtgtgtgtttgtttttttgcccacacatatagtaacaagtgctggaaatcagtcactgttcagagaggcattgttataaagtggttaagagcacagcctctgtctggaaccaggcctctttgattcacatcatggccctaccacttgctagatgttaccttgggcaggttattttctgtgcctcagtttcctcatctgttaattgggggagttatcttcctcgtgattattgtgaaggttgtgtgcctcatgagaggcacttagtaggtgttaattatagttatcaccggggctattgttgttacatggtttcattggggagctgggtggatccctacttctttctagtgtttaccccagtgtctccttctctgaaagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattgtaagtagtggccttgtttgaaagaaaagctgagcaatgttttattgttttttgttgcttaaggagaatctcttacgtaaatagtgaccaagggtcttccagctcccagctaactctgacattttccaaagttcctccttccctaggagaagcaggactgtactaaaattagcccaagcaggtgagaatctttcttgatttggaaggcagctttgctcacccttataccactaacactttcttggtttataaagaactcaaagaagtaaaactccatgatgtctgtaattattagctttaaccttgtagaattcctttcccagccaaaaggctcatgaaaatagtacctttatcacaaaggtagtatttcacagtaacaattaaaagccatcaggcctaatcagtcctcttaagtcatattctgcaggatttatcattctcatttcgctgataagggcacaatgcttaagtggctcatccaagacaaggtttgagtgggagatagaagacgtctcctaagtcccagagtatgaacccttgagaaatgttgtgaaattgtgacactgtcatcaaggtagcattttaacttgggctctcaaccatcagaaacatactttctagaagcttcagatgggcccaatgcctgagcccaatggaatcagtcacaaagacttccatgtttgacaatacaaaactgtgcagaaataacccatagaaaatccctgcttgtgcatagaattaagagcaaatgaagtctcagtgtttctcaagaaactgaacttaaaaatgtacaatagtaaatgatgatagtcactccactgaaaatggcatcctaaaaaaaaatagtcattactatgaccataacaaacataaatgatagcactgcatacaatgtaaaagcaagtaagtactcacaaaattgttactttttggttatggtgtttttattttaaaagacagtatacgcctctattacatgagttgcatttatcattcagttaatgtgatttcactttgaaattctgtgactttttcaaaaagagatgtgtcgccaagatgaaaatgtagtactaaatggacaggataaaagaaattgcatatatatgggatatttgaactgataaaactgttgttatagaaacaacataaacaatgaagccttgtatttaaaacctataaaagcaaggaggtaccacagaatccatggcagtaacacacctttagtaaaccaagtaaacactgtaatttttttcagcaataatcataagttagcaattctaattatttaaatgaggagctcctgaatttaattattctagatctgtgaaatatcattaagacccaaatacaatgttgtattatttcacatcgtgttcactgttaaatgagagtcaaatcggatatttgctcattgggattaccctgtattcaaggggaagaacatgagctttggctgggcacggtggctaatgcttataatcccagcactttgagaggctgaagcaggcggatcacctgaggtcaggagttcaagaccagcctggccaacatggtgaaaccccgtctctactaaaaatgcaaaacttagccgggtgtggtggggtgcacctgtagttccagttactcaggaggccaaggcccaaaaatttcttgaacccaggaggcagaggttgcagtgagccacgattgcgccactgcactccagcctgagcaacagagtgacacttttattaaagactgattctttcacagtaaccaatgtgggaagatgtgaattgtcccccatccctaccacagagtcttcttgtaccatttacttatcacaaaatattaaaaatgagtaaatactagaaactgatactatggatgaacttgccgataaggagactctggcttctgtgtgtgacctgctgctaatcttcattcatatcaattaggcttcatttaaccacatagactaatacaaacaagttagaggaatattaagacactacacagtagatctttttttttagcttgatctcactatttttaatcattcctgtctttactacttgaagtccacttagaagctaaaattggctgagcatggaggctcacacctgtaatcccagtactttgggaggccgaggtgggtgaatcatctgaggtcaggaggtcgagaccagcctgaccaatatggtgaaaccccatctctactaaaaatacaaaaaattagccaagtgtggtggggggggcttgtagtcccagctactcaggaggctgagacaggagaatcactggaacctgggaggcagaggttgcagtgaactgagatcatgccactgcactccagcctgagcaatagaacaagactctatatttaaaaaaaaaaaaaaaaagcagctaaaattataaataccagatctttcagaagtaggccaagatgatgtctgagctcctctgaatataggatgcaactgactctttttcaattgtagtaatcaataaatgttgggtagccacatatcactatttcttccgtctattcacatcacattaaaatttaccctgagggtgcatcttagagcaaactacaagactgctagcttctttctgtttgtaaagcagcattagagtgttgcagagtcctgttgagtctcctttctgaaagttttggtctcctcttacttttgccactaattctaaggaccaatcaaaattccagtctgcttaactgaaaattaaagtgaaagataactttttcaaggatgactgtccttgctctgaaaagatgtttcatttaattaccttctaatatcgaagagcggtgaatatggttgagtgatatgtttgttaaaccaatgaaagttgcttttaagaatatatttcttgatgcttcctgtcttttcctctccttccagcaaagagaaccctcctcaaggttgaggtcatgcagtgtcaccgacgcagttgcagaacagggccatctaccaccggtaacccatgctaatttccagtcatcagttgactttttgggctttcatttacaatcatctgggctgctgcaaaaagagtttttcctgtgtaaatttatttacaatataaatgagatgtttttaaatttcctggccaattgccctaggaaagtggatttccaatacagagaattgttactgccacccatctctaaaatgctggaacctccattgctttagtttttcacccaaatttataccaattttgatttgctcacttaaacctcttggtacattagttagtaattccttttaccttattgagttactatagttatgctccagtgatctgtactttgaaaacacattgagtccctttaaccaggaagaactcttctgggcgaccgtccacatgttcctttcccttcctaatgacctgaagtctgaactctacagagcctctgtaccttctctttaaaggcagctctgctcaccaggaattggctataattctttccaactctctcatcattttaatagctatcagcaaatgtagaggtgtaggggattttgtaacatctgatgtatgtaaaaagaaatattcaagttggaaggcagactagaactgccctgagagatgtttgatgtacacattaaaaataagaaattttacataaatttgtttcttcttttggaggtgaaaatatgtggttttaatgtgttcaatttgatattttaccttgacagtttttgtctgttgctacaaaaccttgatcatttttaagactaataatgtattacgtatgaatttgaagggggaaaagtgcatttaaggtttttgaaatcacagtgtcttccctctcatgtatgttttttcttgacttcaaaggatattttggcctaggttttaattttttatgtttgagaaaaaattaatgagtatactagtcaaggaagcagtcaaaataatagagtcatttgtgacttacactggagagacttaataataagcttgataagagcgtcttttctgggatggtttcagtacagggctcccaaaaacaaaataatcaactgagatggactggtaggatccttctcaacctcatgatctgtgattttccttgaacgaatggcactttctctccttttcaaaatcaatgtcaattttatttcccaaagaactcactttcctggaaactggtgattcctccctctttctttgtactttctgatgctgtaaactcactgatcaccagtggcctcttgagttttgagtgtggggagatttcagaatctgctaattatttgacaatggcaggcaaaaccagaccagctttccatttttctctaaggcagctcactcttttgaggttgtcattgtttacccaggtcaaggatgagccaccttggggggcataggggtcacgcttcctttgtgctactggtcatcagcgactgctggctttgtctggatagggtgggtttcagggattctgatctcacgtcacctgccttacagcgctgccacagcagtgggccctgattcagacagcagggggtcatcccctaagtgcatttcactgatgtaaattatcattcacagcccagtgccccagctgggagagcgcgttcatcaactgtcacgggtggtgaggaaccaacggtaatgatccactttatcagacatcaatagcaagaggccgtgaggcagttttaatatttcgtgtagtggtgaatatacgctgtttttaaaaataagattagctcctttgtgctacagagctgcacacgtttcttattttaagcttctcatttggggattgtttaaaggtactgggtaaaatagaatgatttttttagtcccacataattttattaggaatactatcaggctttggttaagtgcatttaacttgaccatttagaagatatttttgacttttagtgtttgtactcctgataagtttttccatttcattagaatgcttggttaaagtaatttggttggaagatcatcaaagaagccacaggaattgcatgagactgtgtgtgtgattcctggatgtgcccagggcccttctcttttctgtatctcccctaccacatttttcacagggggttagacttttcttgtccccagaatgcaccatgaccctttctctgccaccaggggctctcctcacacaatgaacaagtttccgtaattccaagggaacataattaggatatataagtgatctagaaaaatttatgtttctctaagccaaccattcttattcattattttaaagaatgtatggtattcctgtctgtgggtgacttagatttgtattttaattgcctgttttctacttgatccctaaagttaggctagcttatagtttatgcttcgcactgcaatagctgtttaaagaatttcctggccgggcacggtggctcacgcctgtaatcccagcaccttgggaggctgaggcaggtggatcatgaggtcaggagatcgagaccatcctggctaacacagtgaaaccccgtctctactaaaagtacaaaaaattagccgggcgtggtggtgagcacctgtagtcccagctactcgggaggctgaggcaggagaatggcgtgaacccgggaggcagaggttgtggtgagctgagatcgcaccactgctctccaccctgggcgacagagcgagactccatctcaaaaaaaaaaaaagaatttccttattgtttcacctgtgttgtattttgctataactgctcattacttgtggataactttacgtatacaattgctgattttctaaagatgttgatgacttcaatttaatgctcagcattgtacagaggaaaatcaaactggcaacagtcagccccagaacactcagctcaggttaagatattgagctacagtggtttacatgagtcatgtgttgagtgaggcagcctccagtagaattcaagaaattctacatgaactattacccaccgtgcacttgtaatttctgtgggagtagtggagctttgagggggacaagatcgttttgtgagataattttagttgaattcagtgctgatgaacatcatctgtatatcacctatttttgtattttgttggccttgcaacctgcgtgtagctttggagtgttgtggtagctgatgtagtaaatgaagtaggaatggaatcattgcagtaccaggctccatggcaagggtcacctggcaggacaaggtgacccctctgaatgagatcccgggtggcacgttagactgccattttcttgccttcttgcctgcactctcccctccccgtcactgagtttcagcatgggttgggtgttttctttccacaggcttggcaatattcattcctaagtgtttcatctactttggtagatgtagatagatctccctacctacttaggtttgaaaggatcacatccatttctcttctgctgtatcctgcatgtttctcttccacatcctttgtcgtgaatgcccttgacttcctgtcttgcaattctgtctcttcaccccgtgtttccctctttggcatcccctctgttcctctgcacatcactcacactgaagtgtattgtcctgggctggagccatcatggtattatatcatctcactgcccctgtgctctcacagacatacggctgtgtacacataggtacacattgtgccactttattttattttttttaaatgggatgtcatgtatacattacttagcaacttggtttttttttaacttatgttcattcttctgggacatgttaataattacataatattcactgacgtaaaggcactacagtgttaatttcccgacattcaaggactttctgctccccctaccctgccctttcaactccatacgctgtgctgaagtaaccgtcctgatatagctttctttctatgatagtgctttcattcctgtagtctaataaacaggccctgattctcagccaagaaaccacagccctttgatttatggcaaataaacgcacagtggtgtcactttctggcagactaagccagggccctccccatgagataaaaggagagggatagcacagtcctttcagtctttgttgtatatattctaaaaatacacgagccaccattactgggttggtgcaagtcttggcaaatctgtgatggtcagtgtcaaagtggttatttttaaaagcatattgaaacttctgcagtttacaatcgtgttctttattttaatgaaagaaacagagccactaggaagttctagctaatggcttttgggcatcacaaagcagtagtgtattcagtctatgatgaaaagctgtgaaatgttaaactaagtcgccatttctaactggtttgattacttttttgttaagctagggtggaacatgctcacaagcacagaacagcagaaggctggttttggcttcctggcgggcccttccatggcctgtctgtagaagctgagtcctgccccctcaactagccgtgcagggtgggaggcagtgtgagttacaaatggaatcatcagcacaagttgttctatgtggtcatttggagagaacactgtaaagaaacatttccaaattgccctctcacataaatgtaactaaattacaggttgccagttcagttctcaatagaagagagaatgagcattttaatcaaattcagcgttctgtactacactcctaattttccacaaactgattagtgctattcactgtggctgtatgaaagtaacctgtatggccaggtgcagtggctcacactggtaatcccagcactttgggaggctgaagcgggtggatcaattgaagtcagcagttcgagaccagcctgaccaacgtggtgaaaccctgcctctactaaaaatacaaaaattagctgggcatggtggcgcttgcgtataatcccagctactcaggaggctaaggcaggagaatcacttgaacatgggaggcggaggttgcagtgagccaagattgtgccactgtactccagcctgggcgacagagcaatactctgtctcaaaaaggaaaaaacaaagtaacctggttgctagaattcatacagctttaggattcagttctgacatgatctatgacacatccatgtgctttcagttgatcagttgcctcccaagtgtcctttccagagattgagtaactgcaaaaatatccttaaggtttccagagctaaggtttccggagctgagttttccaggggcggggccagggggagtggggagttatgggagggaaggggcctgggagagggggaagtggatcaccagaacggctgaaggggagggctctgggcggagggagctgagaatgtaacacattccatttagtatttcattgattgtataaacaatagtaggtcaaaacttgatagcacatactttgccagagatactaattgaccaggaacttaggttacaacttagctcagcaggggagtccattgaagtgcccggatccacgtagctctttgtgttggcatcgctgctagaggaggaggggaggaaggagcttcactcaggctgcatgctaattcatcgatgtttaatattcatgaaaggattaagtcagtgttgatgtttcttctgctcctgctgagtctccacacctggatccagaatgctccatgatccgagtctttgtgtctttataaactatctttagggagctttaggactttatctcgggaaatattaaggaaatggttttccttaatatcagcagaaagttttcttacacataatctaaaatcagctgcttcatgatcttacccaggtgatctttctctgaattgtgcttttaagcctgggaggttaacatactgcttctctgtggatggggttttcaaattacccggcagcatccttgttggtgctttctctaatttgagatcctggagtccaccagggaactccaggtgaccaccttcaccaagacacattgctggtagtgcagggaaaaggtggcataagcacaggaagaagttaggttcagaggaaatttgtatcctcagcctaatagcaagaaaacgacaactgctaaaatatctggaagtaaaagaagcagcttccttttgtaacctcacgtgagaggttattcctaaggcatgggctcctcctatacctttagattcccctaggagccgtggtatagctgtggtcggcttctggtttctgagcttttccccacttagagctctttcacaggcacagatattacatgcatcgcctatgcattcaagccctcctgggacagccctgatctccagcatctgtcccagtgcctccatacatcatcaacacatccttgtttttcagtgtttctccatccacactgcatttcttagactgcttctcagggatcttcttgtgatcaaatgtggactgtctaaatacagtcactctatgcggggcaggtctctaaacccaaaaactgccaagctgtgttcaccttcaaagaaacacactcctatcagcagacttgggtgcacatagcctggggtgtgaggctgggtgctgggagacttcctgagctggggcacacagatgtcctgggtggtcctccagattatatgctactgtgtgaccatcagtatcctagagaaggggctctgtgttgggattttaaaattttgccccagaagctacagtgttagggtcctaagctgatggaggaatgtaggcctaagctagaagagcaccccatgggagctacatcgaggagaaactcagagcatccctctcatacacagtgacactggacagtttgaaatacctttaagctctacctggtttggcagtggaatttagtagctagaacagatgataatgtttttccctttccctgtgatcaccttggcagcaaccctttacgtttgagactacggggtcttagaaccaagttctgtaagaatttggactctgcaactgtatggggttcatttcacagtagatttgaagctgttggaaatctattgctgttttccagacacttgtaagtgttttctatataaatagatctaattaactttgtctagagaaaataattatctgggtgtaccttactttattaaactgatcagaaaacaaatgcaaggtattaaataataatgatttcttgcacaaacagccatcagtggcctatgtacataccacgccgggtctgccttcaggctgggaagaaagaaaagatgctaaggggcgcacatactatgtcaatcataacaatcgaaccacaacttggactcgacctatcatgcaggtacgaagattgccatccaacttaaaaccgcaggccatagaagccgaaatgtacatgaccgaactcctttcctggtgtttatgtattgttctgaaagacccgtatttgtaaaagctttctcacaaagaaaatgcattactttaaatacaataatagcctaaggaagaatttgcttttcaaatcagtttatcactgaatatattttaaaaatgtgacgtgaaagatattttcaaagtaagagcctattgcagtgtgtagcttcttccctgcccagcccccactttaatccgaggctagtttttatgctgggctagtgattcatttttatttcccttgaatgtgtttccccatcctttcccccatcattatgtttaattatttcctccacgctttaaataggccagacctcttattattgctgtttgcgttgttgtttgggttcgcgctcctaatcacacacaccgggagatcctcctatgaagctaacttgtttttgcctccaaaatagcttgcagaagatggtgcgtccggatcagccacaaacagtaacaaccatctaatcgagcctcagatccgccggcctcgtagcctcagctcgccaacagtaactttatctgccccgctggaggtgagacggctacctcatctaactggactcactctgtcctgtgactcccattctttcttctctcttaactctgccttcagtttcgcagccacctcctctctctgatcagtcgttgtgttggtagtgaagggtgttcttgtgcagcctttctacctgcttctctgtctcgcccagttaacattcctggactctctcacctgattctcattctcatttggctaaggccgtggtgacttgtgctggacgtgggcactctcttttcaggacttccaccgttcttgttgtgtttcgcttctttttgcctgttacctcattagaattgcgtaatccctctttcaaataccaagtgctgatattgagtttttaaacatagctattgctttgatcatttgtttttctttcgactgtagggtctttcattctatgggcatacatgtttctgatgcatatttgcatctctgcatcatggctgggcatctgcttgtgctctctgtcgtgtttgtgttgttttggtgccatcctttaacatcacaaatgtcagagttagagaagccaaagagcaaatgtttgaggtcctaagcttgactgtgtcttagagacagctgtgggcttctccacgccctgggtccagatgctgataagtgggaatggatgctgtctcttccacactctgatatgaatgtcatgggtaacaactgtgagattccagatcgttgtatttattgatgtagcttttttcctttttgtgctctaaaacttgccaatctgttcttcattagactgtgagctcattaagagcaagggcacatttttctccactctgtaaaatctccatccataatgcttagtacagaacagtatttttggtacatactgagtagctaccaaaggatggtggttataagtacttaatattgttgtgtgtttatccaacagagaaaatgtaaagttagattgatttaaaagtaaatgaatgacagaaaacaggttttggggatcttccctcttgtccatctccaaagagaagccttctgcaatacccaggtacattttggcacattggaatcgcacatgctaaagagttctaatcctcattgttattctttagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggtaaggctgctgcttttatttggctccattttcatcatgaagtctggcattaattccttgatttccttagtgtttgtagttcttgcagaggaattggattgactgtaaagggtgtctccagagggtctcctcagcctgcatctggcccctgcataaatgggcgggtgggagtgggtgggcacaggctggtagctgtctttggtattggtgctgggactgccttttctcctgggaagctctagtttagacagttcaccgtgctggatggaaaggtattgctctgtgctgttaagattttgttaattgatcccgtctcacaaagtaatctcactaggagttataatcattttcaaataattttttcttttgtcagtttcttcttgcactttcattggcattacccaccttcttttgatttgtcgctttagtttttaccgttcacatcagatcagtattcacacatctgaggtacattttcatgcccttgatcatggggtaggggatgtactgagtgactttggttgtagatctgatagctcctttttgtgatcattttgtcaaaattgatttttcttaccatgcaactctttcatgtactcctgaattgtacccaagaaagaatctgtacattgtattatcttgagcaaaatgagattaatcaaaggcaaatatgcatatctttgtatttctgtgtcagttctttatttctttagccgaatcggtggctttttcagtgtagtatatgattcttttaaaagtcagttggtattttcctgctatataatctctatacctgtaattacactgaaaccggttcccgtatttctggctatttttgatgctgcagatggtttttcttccggttatgtccccatcgaattgtctagctagagttaactcagagtttaacttggtcctactattatctgtgctacttgctcaaaactgatgttatgggaatgctggttgagttttggtgattgttattggccctagctcttcggtcttggaccaacaataaacatacaccattaattcccatttctagtgatggacattaagtgtgtccatttgatagaccagcagccttatattcaagaacaagccctgctcaaggggatttgggctgtcattttatgccttgcccattgtgtggtatcagttcagtccagcaggtctagagggcgtgctcctagaatcctttgaaccgtgggacattgtgtcttcaagggcattcttggcatttggggcagggacatttgtgccttcagttgcagactatttaacaaacttggcttctgctaccaggtgctaatggtcaccattacccccaccccaacatagtgatgaccagaaatgccctacacatttcaaaacagccctaagtgagaaccactctaagagctctttctattttgaagtaagggaatggcctgccaagagaatttctcatttagatctggtaacattcatttggtaaactgataactgcttctaaggcatataataacatgtaggtttgactcccctactagtctgaagataatgttacagatttgcaagcaagccaagagtaagagacgggcagctcgttggaaaatatagtaatggagttctttttttttatgtctttttacttattaccatggaacccctggctgtcctgccagtgttctcatttactatagcactgctgtaatttcaagtccttagccagaaacaggctccagaaataagggctaacgaatataaaagtagatggattagtgtaaggagccactgtggcttgccaacataagctatgattttagtaattttaactagcttggtaatcaaatcccctaaccttttcacagcctttcaagccacaacaacagtgtaattgcagctgggcagattgtattttaaattaaacagcactcgctttatttattgcttgcaacattgctgaatgaaacccatttttactttccagttgcgcctgtttacccagatacttgttattgactaatttactgatttaaaatcataatctgttagaacaacgttttgttgctgctgctagtgtgggaaatcctcaaggtaacaactggaaattccacaagctactccccttcttaagcgaattcagatgtgctgacacagctgcgctatcgcttctaaacaaaggcctaggcaggattttccctgcggaagacacactctaaattgcctgttcattttgacaaaagatgaagagccggagggaagcatgaagataatttgcaacttaaaaatctgttttgagttggttttagggtttgctttgttttttatttttgaaagaagaagagaacaaatgagagaacagcatagctattcttagatttgagcattagaatagaaaaaggaaaaaaactggtaggacaggttgaaaatgatgaaaataacactccttcccccatcggcctgggcactgttgattcttacaccaaccagaagcctgaaaagtatcaggacatttcccctctatacattgagaaattaaaaaatttattgaaatatgtcatgaaagatgaccttttacacacacacagatactgaaggcagtatgccatcagtatttggataaagtttggcctcattctcttttttttaattattattttttttgtttttgagacggagtctcactcttgcccaggctggagtgtaatggcacaatctcagctcagtgcaacctctgtctcccgggttcatgcgattctcttgcctcagcctcctgagtagctgggattacaggcacatgccaccacaccagctaatttttgttgttttttgttttttgttttttttagcacagacagggtttcaccatgttggctaggctggtctcgaactcctgacctcaagtgatcctgccgcttcggcctcccaaagtgctgggattatgggcatgagacaccctgccaggccaagtttagcttcattcaaagaaagaaagaaagattggctttgttccccgcctgggtcaggcctttcagggaatgcatgctggagaccaggggcttgggagggatgtaccaaggagggatgttccatcctcagcagctcagagcacgtgtatacgggttgagtatccctagtttaaagattcaaaatccaaaatgatccaaagtctgaaaccttgtaagcactgacatgacactcaagcaataaatgcttattggagcatttcagattctcagattagggatgctgaagtggtaagtataactgcaaatattttgaaattcaaagcccctctggtccccaagcattatgggtgagggatgttcaacgcatattagtatatttgtgcctttcacaggatgaagcatgggcttgcttttgtagcaagaaagattacaccctagttaagttgcaggtttgttttccatccaagttcaaactaatgaaacttattactctaggtgtggttgctggtctcttccaggatggaaaagataaagaaaaaaggcacttttttttaatccctgtgttttatatattttgaattaggaaagccctttttaaaaagatactgctctttgcatcctgtttaaaaacactttgaacttgatggagggaagcaattttatattacacatgaaagagttcccgttatgaaactgaagaaaggaagaaacaaccaggcacactttatgcgttggatcatttattttcattgcatcagagccctcgttagtattccactttctcatcagctctgaagttgtccataactaatagagagccttgaccgccacttcatgtgccctggcaactaaggagagatgcctgcctccttgagtggctcggtgggagtcagggcttgagggtgaccactagccttagccctcagagctgattcatggcagctgctgccattatttttattatttttgataaaataatattataagcctcaaggcctctggccctcacagtctatgaagtctaggtttccatgcaaggccactttagcagatctttgaaattcggttgactttatacttcatgctctgcccctcactgcctccctgacacttttctctaatttcagcttcttttcacgctacggccccccccgccccccccccccctttaaatcaccagccttttaccaatagggctgattgtctttcacggtagcctacatgtgattccaaggtcaggctggccttgtgtgtagcattcagaagccctgccctctttcatgtaatagcagtcctcagctttctctaaatctggcatggtcataggctaggtggaagcccaagggtcccccgctggttgtggcgttacctggtccggatcagagttagcattgagtgggtagcttttgagaaattcagtgctttcagtttttcctctgtctgtagttaaccagtcatgaatgtttaccagattatcagcttcttggaccttctcaatcctaaatcagcttagcatatttctttatgttctgtgtatgtcagtgtactgcagaatactggattattttgtgcctctgcttagccttttaaaaaaatatattgggttcagggtcaatatgcatcacaaactgctaacaggatttctttcttcatttaaaagttcacctagctagcaagaagcaagggttgatttttgttgttcgtggtcttttttgattcttgccagttcccaagatctatgattatgattcagtgatactatgacttacacggttgacttgggaagcagaaaaatctagtaatttggcagcagcaaaggccctattataaaattgaatgaagctgatatcaaatgtcttcacagtttactttttttaatcttaagcttatttggttgatagtggttttttttttgagtataaagatatggattctcctttttatgtttttggaggcaagactcactgcatcacccaggctggagtacaatggcacaatcacagtttacggctcactgcagccttgacctcctaggctcaggtgatcctcccacctcagcctttcaggtagctaaggcaggcatgcaccaccacactcagctaactttttgtgttttttgcagagatatggttttgctttgttgcccaggatggtctcgaactcctgggctcaagcagtcctcccgccttggcctcccaaagtgctgagattacaagtgtgagccactgcatctggccttacactgcatttctttttcttttttttctttttttttttttttttttttttgagacggagtctcactctgttgcccagcctggagttcagtggcacaatctcggctcactgcaacctctactttccgggttcaagcaattctcctaactcagcctcccgagtagctgggactacaggcacacaccacacccgggaaatttttgtatttttagtaggaacggagtttcaccatgttggccaggctggtctcaaactcctgacctcctcagcctcccaaagtgctgggattacaggcatgagccatcgtgcccggcctacactgcattttaactgggtctacataagtgagagtcagctcctggactctgggtcataatctttgggcaacttcctgttctctctgaaactccatttcctcatctaaagaaacagaccatgtgcccaacctcctaccaagggtctgttgcaggattttacatctgaccatgcctcataaatcatgcagcctgacccaggttgtcagagtacatatttctcttttgttgattctctgtggtatcttatgaagcttatgctttaagaaaaaaattttgtaaacgtttaaatattaagacataaatgagaacttaatctgcagaacttggtcaagaatctcagtaaagttgtatcataactttgtgagtttgcctgatgaaagcgactctccctggagtagccacgtgacttcacagaccagattgacattctctgctgagttcagaaggagtggaggggagcacaagtgctggaggagggtgtggcagggaggcctattccctaacgtgttaggctggctcccctcaccgggagctcgggacccatggagagatttcgaaaccgttgtccccactccctctttgtgccacattcactggcaccctccattctggtttccctagtaacatcactgctgggactctcttccccttccccttctcaaggtctcagggaaatggttaacctttcatgtaaatattcttactctcctctctccaccaagcacaagaaggaagagtacagtctgtctcgagagacagtcagccaggcttcctgtacaaaacagagatgggacccatctcacgctccaggcatggacagcctggttgccttgaaacaaacagctcaagaagaaaagcacccagtaactgcacacagatacttccacttagcatctactgtcttttacatttttcttgcaggaagatccacgtttgaaatttccagtacatatgcggtcaaagacatctttaaaccccaatgaccttggcccccttcctgtgagtacactggagacacatggaatggtctgaatatgtgtgttcctttatccgctcaatgttgatggagaggccctgtggaccttctctatctccaggctttgtggatctcattggtttgtgtttcttaacagaattgggtgtttagctgaattgtagtcatacattatagttcatgtgatatccagtacttatgaaagaggtttctgaattgctagcttctagcagaagatagaccttgtacacaggatgttcaagagacgttctctgcaggtgacaatttaagtggcactcattcattttgtaacttagcaaccactgagtttcagtcatattgctgattaagtcatcagaacaaaaataatgaaaatagtatgggagaagaaggcctaattaatcatagaaagtttctataagtcatttaacctgcagatttttaaagtttttttctcccttgttggtgacggctcagtaggagttgagctatatacttaaaattggattttgaatgaaaccttcacatacatcctcctcaacaactcactctcagtttgaaaaagccgtagggggtgacagggcagtggttggactccaaggctatttttaaatgggaatttttgttgttgttttccaagtgtaagaacctttttgttgcctggtatattagggcaacattggaggctgcgaaggttaaggttcaatcattattcattaggttatacaggtatcccacaccaaatctgtttggttcctgggttcaaatagaaagaaccagagagttagtttagaaaacaaaagaaagcatttttttctgaatctgttggattcctgaggttcagatagcaaatatggatagttcagataatgagggcataccagctttatcttgaaaaaattctccaaatctgtttagttcctgagcttgactagcaaaagttcatggtggataataccaatattagatcatcaactgcctggacaacacaaatacagttaaccatgtctaacatttttatattaaccccctcttcctttcctttagtactcagtatttatttaattaaatggtactcaacttcaaactccactgttccatggaatgctgcggtttccctttgaagcttttgagctagcagcccatttccggttcttcatacagtcagcgcatctgagacctgagcatgtgataaagcgtgttgctagacatggtcaagagttaacttgaaatgttcatatttagttcacgctcaatgcataaatgtaccctagcagaaaagagtacagaggtgttctatagtttttaaatgttgcctttgatttcagaactcctagctaatgtttatattttctctctcccttccttccccggatactagcctggctgggaagaaagaattcacttggatggccgaacgttttatattgatcatagtaagtaggcgctgttatggacacacaggtgttgtgggttagagggaaggagtaattcaaacatcatagtgaaagctttgtcattttactctttatctaggcagccaggtgttatgtggagaaaatgataccagagaatcagtgccttcatacggtactgtgcattcaccccaagtttgcttaaagtagcccatcaaactttcacccaatctgatcttgtgacctattaacgtgtttttttttgttgttgaatttttaaaccacattttgattgttgatcccttgacttttgcacatttaataaatacactctggtaatagaaaataagattagaaatgatgatttagtcaaaaatctgtgaacagtgcttgaagcagcatgtaagttttttagacactgccttcaagggtcctatggcaggatgcccgctctgaccttattttctattcacggcatgtttccttgcacccacaacactaatatatatgtattttctggaaattgtagtatatttgctatagacatttgctccagcacctatgaaaaaatgtgtggtttctcattccaactaaaagttcaactaataaaagtttgctttttagccagtgggattttttttttctcattctttttggaggtgccatgttcttcatggaatcatatttctatgtcccttaaattttctgaaaaagtatattaaaaagaagccttcaaatagatgtaaagtttcaaccatgagtgcaatttggtagtatcttggtctttgctttcatttggttcatgaacagaaagttagggtttccctggcttcacaatttcataactaaacaaaagcacgttgatgagccacctgctgagaagtctggccacaagtaatcctcacacgtataggactggtcactatctcataggcatagtacgtttttcagatgttactaggaggcagagacattgtgaacagaatttcactttcaggccctgggggttgagggcttattataaatggaattaagcaaaagtaccagcagtttacaattcaactgaaagtagaagtcctaggtgtatttagaagagtgagctaccctttgtttaaaccagatatttcaaggtgcagagacttagtttttgtcttttatcaaaaaatgggcagatttgtcaactgtccagaatttcatagtaagcataaagtatttttcctgctttcatgtatgtgtatgccctacttttttccttaatatactatttatttattgttttaagagaatttactaaaatgagagagaggccacacctctttttcccatgaaaaacaaaataatagtttccggcttggtgcagtggctcacacctgtaatcccagcactttgggaggccgaggtgggaggatcagttgaggtcaggagttcgagattagcctggccaacgtgatgaaaccccgtctctactaaaaatacaagtaaaaactagctgggtgtggtggcgtgcacctgcaatcccagctacccggatggctgaggcaggagaatctcttgaacctgggaggtggaggttgcggtgagacaagatcataccactgcactccagcctgggcaacagagggaggctgtctcaaaaaaaaagaaaaaagtttcctttatagtattttttatacatcacaatcacagttttaagacaggtgtgaataatactgatcattttactaaaacaggtctttactggtaacacatcctggtctgtgacgcatggagagcattgcacacaatattgtgacagttttctggctggagatgtgatgcttaggtccccctaaaaagaatgttgtgaatgtgtttcgtataccgcaaggagccaaaaacagaaaaacacaattacaaagggctgtcgtagcatgcgttaaaatagtgaaaatcactgactatttcacttgtggtgtcatagacctagtatgatacatagcagatgcttgatacttggtgacttgaaatcaggttcatggaggatcagtggtgaagctcttaggaagttgttgtgcttgatcagaaagtgaagtgaactcacttgaggagcagtaggtgcccccactccggctttccacccccaccggcctgaggctagcgcaactccggcttactggaaggtggaagaaggtaactacctgctagatgcctgggcttttccttactcctgatcagttctgcagttactccagcactctgcccaaacatttcctcatttcacttgactagagcagcacccccgaggctccattatactctgtacagagcttgatgcaactaagctgtgccaatatatttgtggccattgacttggagattaaaatttattttgcccttgcacaaccatattgaaagattctgttaaagagatatagcataaattaagtgaccaaaaaccatttaagaaaaggatttgtttacgagtgcctccttagctgttcatgctacgtttctaccatcgctccataattcatcaaggtttactcaatggaaagctgtagagcagtacacgtcagtgaaacagttcaagtcatttgcctttccacaaaattcagtctgtgaaaactgcagaatacctatcttttgaagaggctttatcaggctgacacatacattccaaatgggttgaattacctggaagataacatttaggaatgtcctttctgtcagaagaaagcctctttttctaaacaatcttatagcaaaactcagcatctgattttgctgtcataatgcctacaggacaggaaccaggttatgcccacgtatgccacaatgccgtgagtgccgtcatcttgtaaattgcttagagtcatcttgtcttccagcatacctggcacgtgggtccacctggaattacagatgagatgatgagatgcacttgtcttttcaataattaattatttctgctttgtaagtttttcctgagaagttagacattttcaagatgaacaatactcagccatcataaagatttaatttcaagagcaacgaatgatcgagactaacctctttagactcctcgattcctttgtttgctgtctatggaatggctcctggctcttgggcctcaggtgggaggttaaaggaaggtcttaaactgaatctctacatcttgtaggaatgatgtcattcttcttaaagaccagacaggcccagcagctgagtaattggccacaggtatcctatctacaacattagaagagaaaattgaattccagtgattttgtaaagtcctattttagtctttcctgtcaacagtcttactagacctgttcatcgtgactaaactgagtttctcatccttccacttccttcttgtccttttattggaaatatatctcaaagaggaaaagcaagtttaaaagccaaagttctttaaaaaaaaaaaaaaaggataactggctaccccatactttcatacattgaccatacttcactgaagaattctttatcataaccatgtagaaacttgtgttgttccaaaagcttaggctctttttaaagggactttgttttcaccatcagcttcattcagtcattaaaaaaataatgcactaagttcctgttacctgctgggactggtcttaagtggtagagaggggattgcaaagatgaataacacacagtccctgtccttggggaggttaggtccagtgggaagtagcaggggatatttcaggtgttagaggagtgaatcagttgttacacagaaacagaagaggcaaggactgcatctgcttgggaggtggttgggcacagggatggggccctgagagaatgggtcactttttagatggatgacaaacactgagtaggattgaggcagtcaaagccccaggaagagtgatcctaggatgcgtggaggtgtgtgaatatgtgcagatgctgccacgttccgagaaacgcagcattgctccaaacagctagtgtgccgcaggggcgcacaggccaagccaaagggtatctgcccggtgtggggactcgggctcaagccacaggcagtggggagctcccaggggatttcccagaggggagggatggggtcgaaatcgttatttagagagatccttttggcagagctgtagaagatgtcttgaactggggttggggggtgagacaattcccagtgacgcccagagaacagttcagggaaaaaaaatgagccctctagcaagaagcttatcaggaatagagagggttggtccgggaccaccagagtgagtgacacggccaggttcctgattgggacagtgagtggattgtgatactgcacattggaatgtaaggtcacgttaccaattttggtgttgggtgatcagaggtttggttttggtagagttaagctgaagtacttacgggaaacccagatgcagatgtccaggatggagcttgaagttcaggtctggtctgaggacttgcgaatcccaatgagtcaggagttattcatttattttctgctttgatgacaatatccattgatacggttataatccaagttggtgttttaaggcgcaatttttactcagctgtactccgtttcctttatttggttttcttttctcttgttttccatcacaatagcaacttttactttccaaagtcttctgtgaaaggtaagggacccaaaaatgccttttgcttccatcaagattctctcaaacagttgagatttttcatgtaaattttctgccagcatgaaaacaaaagattctagaatcatcacttgctttggtagcttttttttttttttttagcttttcctctgcttctattaaaataataataagactttttaaaattcctaatatggtcattaaaacagaattcactaattattcttatcagctcacttacagtgtatacagaaaataaacagaatcaatattcttcccctgcactcccccgccccggtccccaagacaggtgcagatcgggctggagcatagtggcacagtcatagctcactgcagccttcccctgggctcaagcgatcttcccacctcagcctcccaagtagctaggactacaggcgtacaccaccacacctggctaatttttttttttaaccttttgtagagatgggtcctcactatgtttcccaggttgggcccgaactcctggcttcaagtgatcctcctgcctcagccccccaaagtattgggattacaggcatgagccactgctcctggccaccctttacttttcaaataattttcttcttctttttttttttttttgttttttactaacctagatatccaaaaactctggagaacctactctccctagtgtgccccaccccccgtacctttcatgtgagtccattgcactctctctccctccactccaccctagtacacacacaggaatccgtaaggtctttttaattatgcacagttacaaacaccaagtgatctaaggcagctgttgtgtattatcacctacacaagtaatggtatagatagcattgaacagtcttgtgcacattaactcacttggaagaaagcaaaccaccttttgccagtgtgaccaaacagaaaccatgctctgtaatcttcctctgctgtatctaattctcttttttggactgcctaagctgctttgatttttgtgtgcatatgagtgacgcatgtaatagattattcatttgttcaatgcaggattcttaattgaaagcagtttttcaacaccataagtaaagagaaaagtatttgaaatgagaaaaaaaatcgtgtgtgtgtttgttagccttttgggaaactaagactttttaaatgctttttttcaactaaatgaaaatcaagatcaagttataaatccttaaaagaacaggggtttataattcccattttagcaagttatttgcccaaaacagtatgaatagatggtttatctttagttgtgcatttttgattgagtgtttttaactaaacagtatgtgaggggggttgccatatagactgtagttacctgctaactctgaaatactaatttgtctttagaacacagggtgggggactggacagcttttgaagaatccagaaatacttccttccaaaactttctttacatagaatagatttgaactaatgttctgattttttttttttttttttaacattttcagatagcaaaattactcagtgggaagacccaagactgcagaacccagctattactggtccggtcagtattttcaaattctgcctcttcagtataagattttggttacgtgtttacgtgtttcttgtgtattactgataacggtgatgtcaagggacaacggtgattgagtagttgactagaaacagagcactttgctgccatctccttactgaagtttccaggtgaggtacagctgcatgtgccttttcagatggatttcattataaaggaaaacagcttgataacgacagcagaattaaacatttttcttctcctttataaaagggtggactataagtatagtcaaaattccctcccttcctttttatatgaagcaaaaccaagccctatcttcataaagtgttatcatttctttaggccaggagtagtaaatgtatgccaaaagtttaaatcttttacaactttcaaaaatctgtagaagtttgggtgagattatagctaagttcaggagctggcagagttaagagtttggaactctgccgacccacagtgttctcatggtcccctcatatatgccgggtggaaaaagaatcaattctgatgcaggcgtgatgacctcttaaaacaccgtagcacactgtgttcataaggcagtgtgagaaccccactccctgaagcatcaggagacatttggtatctcacacttgttaacaagtctgtagaatgggaccacactcatcagcagagagcacaccaccagcttttgtcagtggctatacgagtgcagggaggtaatttggaattacaggagttgtactgcgatcagcagaagattgcaaatttgggattcttagaccagaggagcaaaaggaactgaagtttgttatatcacatgctgagctaagaggccagtaggtagatttaaaattccaatttcatggctttaatctgattccattcaaattatgttttgaattagtaagatacatccatttgaaaacttaaaagatactacattgcaaatgtgccccggtaactgactcctgttagttacttgttggatttgtttagtcatttgggtactatttcctaggcaaagtgcccagtagtacctgggtaaaaacagtcaacttttttctctatgcggcttaaacactgccttactctgatgcttccttttgatatatatatattcgcagtcacagttgtttattggaatattattttctcttctacatcattagaacaaggtaaattcaagaaactattctttttaagtgacagaagacttttgacataactttgaagccttttcaaaatatttttatcacttatcaattaccggccgtcactcaaacactgctagtccttattaaatcttactgaaaattgctcagcatcataaagccaagtagatttgcccccaagaaagagctctctgctttctgttaataaaagacccttgtttattccttcatttttattattattattcattatattgctttcaatagaggagaatctgtatttaggtagttatcaacttagtgtagacatttggcctttgttgtcattcagttctaaatatttggcaattttcatttgatttttcttcttgacttatacattatttaaaatatgctttttagtttctaagagtatgggagggttgtgcctattcatttttttttattgatttctaattttattgcattatggtcagataatattgtctagagaatatttattattggatgtttatttaaaacttcattggaagcttgatcactttttgtaaatgttctttttctttttaaaaagaatgtgtattgtgtctttggttgaatatagagttctttttgtgtccattaggtcaagcctgtggtgttcaaattatctacattctcattgctattttgctattggatctaatcaagatagttctgtcagtctctgtggtgactgttgccctgtcgatgttgtctgaggtgtatataactacattctctttctctgttcgtatttgctgtttagcatatcttttctctctcgcgatattttatcttctttcttgccttttgttcaattgatagagtactctctattttattttctctatgtgcttgcaggctgtactttctatttgtattcttatagctctcacattaaactgtgtaacccacatacttgacttagggttaaaatgaatcactgtctactctccttaacatcaggacctcagggaacttgaatgccattcttcccactcccatttgccacgtcattgttgggtggaattttaaaactaccttgctttaaactttcctaatagtcaaatagtcattaatatgttttatcttttttctccctactgtccatactgatttaattttaccaaatgtagacaaatttctttgcccaccattggtttgcccaccattggttcttccatccattttttttctggggtgagttttgatcttagtgaagcctagtccagtttatggttcttactgtgtggtctgctgaccagagtatcagtatcgcctgagagcttgttggaaatgcaagttttcaggtcctaccccagacctactgaatcagcacctctgggggtgggacaccagtctttgttttaactgctctcccagggattccagtgccccctcaggtttgagcacttctgcccagcagcactgccagtgacagtctgagagtggtaatatctcttagtctttgactcaaaaggtctcatttgacctctctgaagttcagctgatgatagaaatcttggttaaattattttccctcagtgctttggagattctcctgcatgtcttctggcctccataaatgatgataacaggtttgctgtcaatctcattgtcgtttctgtgtaggtaaatggctctgttctctagtgattttgaatttttatttgtgtcttagatgttttacaatttcgctatcatcatgtacctatgtgtggagttctcttcatttatcttgctttggactcaggcttcttcagtatggggattgtgtctttcctctgttctggaaaattctcagctattatttcttaacatactgcatttttccgattctctctaagtatctgtttctgtaactcctattggacatttacttctctttcacattgtctgctttatctcttaacttttgtgttttctgtctctcactgctgtattgtgagttattacttagctcttccagttaattctttaagctttttttgtaatctctttatcagttcattgtgtttattatttcagtgactaaatttaattgctcaaagttttatttggtcgtttaaaatttgcttttgtcttcatagttattttgtcctgttctctttatctctttatttatttttgatgctttcatctgcttattatttttaagatatttatttcttagcctctttgagattattctattatctctggtcctaggatcattaaatctcccactacgtctgtagactctccttaagagtgtagattattgcctagttcagtttataatttgtgtgtgtgtgtgtgtgtgtgtgtgtgtgtacatgcatgcaagagggagagagagagcatgagcaagctcatttttttttcctatgaggcttttgtaagtcctgacctgtatttactgttaacttcttagcttgggttcatgcacccccagtcagtataactgtggacctcatacccactttggcacaggcttggagtatggatttattacaggtctgtttctttttgtttttctcccatttatggtcctggacagaaggtaagcttccttgcaacttccctggtccggtgggtagagttttcttgtcccctttccagatgttaggttttaaacaatgactgttctttctccatcatgtagaccaaaggccaagttctgtgtccccatgggagattaaaacccaagcccctatgtctaggtccagtgcccactgatttctctaattgtgagtctttctgcttacctagtacctagagtttctcttcccaagttttaaaaatatcagttctaagtaggcctagcgtttctacatatttttagggagaggggaccctttctgtggcagctcagtgttcagcattcctgtaagttagcatgctctgtgtatagcagatatcactagtaatagcatttagtaagtgatgttcacacatgctgctgtcatgaacactatctcatgttgtgtaacactttcatttttccaagaactttataatcagccgacttgaaactcacagtcgtcccctcagaaaggcagggcaaatgttgttatttccaatttgtcagaagctcagaaagcttattctgttgctgacagtccttgcaagggtcagaatcaggaccggagccccagatgcgctggtgtcactgatgtccccgtgccgggcatgagcccttctgtgcaaggagctccaatgtctcccggccagtgatgatgtgaaaacatttagaaccgacctacacaataaggcagattttcattctgtacccaaaacaggaacacagatttaatgcagagcaaaagggctttaatcaacagatatgttcatttttcacgtagacctattttacaagctaacttgtaagccagaaaatgacattcgagattttcaagtgagaacaaatgatttggtccaataattaaaaaaaaaaaaatgtacgtgtaatctcttcagaagctgcactggaaggatgtttgtcctggtacgttgttggaaagttttcaggaagagaatgtaaaaacttgctcttcttattctatcatgagaactacctctggagagaaaagataatgaatgcaagaggaagacagtgatttttcagctttcacgcatcattccccagaaggagaaaggcttgaaatatctcaacatttccgcccacacctcctcagcccctgccaggagacagagcaggcaagggaacgggcatcataggctgggggccacatgttgaaatctgctccttggggaatttgtcatttaagacagtcgaacttgcatacacagtgatgactgtttaagctttttttccaacattttcaggagtagggggaactgtgatgtaacagtgatgtttggagaaccctcacgaatacaggaacaaacaaaaaatagttgctgggaatcacagactttcagaaatagaagagctgagtcacgtttgttcatccagtcaaattcttccacttaacagtgaagaaactccttagtagagaggatgtgatgcagagccagctgatgagagtctacccgagagtgcaggccttctaacgctggcaggagagagtggaaggaagtcacttttttagttcctatggggtcatttttttcctcatggcactaccacggtttattcattgatttcctattgcctgttgctctcaacagcttgtgagctccaggagggaactgggaaagctacctttggtttatgtactgttatttttctggcacctaaaatgccttgcacagagtaggtgctcaagaagtatcggttgaatggacgagaatgaacaccagaaagtgagaaataaactagagaggaaatcttagtttgtgacgggatgtactgttggtagagcagaaaacatgatctctttattggcttatgtcagaacattgtattctttttcttattttggtggttgtccaggtattaacaaatttataccttgcctagactcagaattgctatgtggtttcatcagactaaacactgcctaaaataaataggatgtgaggtcaaatctgttgttcagtggaaaatcaaagaagactggcttaaaaactaagaaaagaccataggcagtgtaaattgtctatagattgctcctaagctatataaagatgatgtattttttgctctggaattacagagcaaaacactgacgtgctcattttctggaagagtggttgtttgttttgtttcgggttttttatataaacatgtcttaaaactataaaagagggaagttcatgttcttcatttcttctgtttctggtcaagataagtatggtgaaagtgtaaggtttggagtctggagatactagactaaggatcagtatattttattaacttaggccgaaatgataacagcagaagtattctctgctgaaattcatactagtggctaaaaagcaatgagttgttttcgaggctgtcatagttaatgtctgtgtatatgcaaaacccaatcctttttgctcataaaaatatcgtaagctttttcagtagccaaaactcacggccctgactctaagatattgtaagctactttacaaggtagcaaataaagattatttaaatgactacattaacatgttactcctttgcctgaagagatatcacaacttttgaatgactatagttaactcaattcctgagccctcaactggggtactatcactctatttcatagataaagcatttgagatttaaagaaatccttgcccaagaccactaaatattaagggacaaaccttctgacttctaaattgaggattttttgagaatgccatctgcctgattttatattccttgataggagtgtcagttcacttccctttctgctcgttgtatttccccacaaaaattcgttaaaccgtaattagacttttcaaaatgccaacgtaggtcattctgggttgtatgttagaagtatttagccaataactcttacctaaaccacagcaaaaaagaaaaacagaaacaccctgactcatattctgacaaaagtcacttggaaagcatgtttagtttgtgtagcgtaccccaaatggtttctcaaatagcagtatagctgttttcaggggtgaaagctgcattcaaagctgattagccctcatcagttctaggactttcccctgtgctgtgtagacattatctaatttttccatggataatctgagaagtgagaatttacggtttatgactcatgaaattctcttgaatgttgcctcagtatacataaaatttcaggtgtattgtttgcattatctatatttataaatttatcttccaggctgtcccttactccagagaatttaagcagaaatatgactacttcaggaagaaattaaagaaacctgtgagtaatcatgccttccaaaaatgctttgtgttagtcatttgtaagttaccacagtcacttcagtgagaacaacttggttgttacttttatatgaatgctaaaaatattaccttccttttctctctgcactttgatcctcctggttctaaaatctgaattttctttttaacagaaatggtaagtgaaaattaactcagtgttacatatcaaatcacctgaagggtaatttcctatgtaatacataaaaagacaggaatgatttttatgggatataaaataattcagaaccctagtcacaaaatctgtggaagcctattcaattatgcgcagttatcatatttaattaacctggatcccggtaagaaaaatgttcaagtccttccttgtaaatgcaaaagcttagtttcaactacagtatttataatatagtgttatatttaattataataattggcagtattacgtccaaatgtaattttctacttataattatccctggcagtttaaaacctagaaactctaaaaatttttatgggcaacattttaaattataacattgcattttctaatgacacaccatccccaaattgttcaacattgcatcctctgttttactttccgattcctccttagcagttttctcttcaattttctccatcactatggttacacctctagggaggggagagaagcggctgcagctcagaccccctctggtggcctgggctccattgccatctctccctgcctcctcccctcagctggttcctcctgcccgggaacatctctggatggggcacaatgtctgctctcatttaggggttttggtctctgttccaaagtcctgattcaagagcttgcgggtaactgctattgaaatgattctttgccttcaaaactcaaatgatcactgaaaattccacagttttctttgtgagtcatgtcccctggtaatgatgatgactgtggtcatcacccagtctcactctatggctctcacatagcagtgtctgctacccggaaaccatctctgcacattcattcttacagccagaccaagcctggaccgcctctttgcaggaggcagttgccacaaccttggtcaagtgttttgttattttcatgtcagcgaaccatgctttgggctgctttccccacacttggcataatcaggatcccactccccatggcaacaaaatggacttgaggcagcgtggattatatctaccacctggcggccctgccacagttgagcatggataggcccaacctggccaggtggggattattacaggttttgactacctgggctaaagtctcttgagtgaagcaacagatacagtcgactgcctttcggttgccctatgctggagaagtgcccacagttgtttattaaagggggcaaggaggatgttctccttcgcagcagagttctaactttcctgagcatcgctagtggatgccgtgtgtcccatcgtgacacagcaaggctttctgtctgcaagggaaaacccctaaaggagagaatctcagttggaaccatttgtcactgcctgtttctttgaggactgccaacttttctaccatttgctgttgtttttattagaaaacaaagtgtgtatttactgtatgattatgtgttttcttttgtcttttgtgtaggctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacgtaagtatatggccacacccagtgtgtgtcccccactgagacagttgtatgaatttaaacagaatgaaaggataagcagctcatgagttcgagatgcattaactctgctgagtttgttctctcctcaccccacagccccttgcaagtctagaacaggttctgactctacgtggtgaaatagtgtactctgcgaacatctaacattgattttttttcttgtctattgggttcatggagttgaaattgaaaacgtggataattatgataaggaacaggaggcgattttcatttgcagtgttcaagaggaggacttgtcagtgttagaattcaaaaacaaaggaggtgttttttgaacaagagtcgtttctgaggtctcctgtgtaaaggcaaattgtaaggactttgaggacctaggaccatgccctgctcctgtaaggaaagaaccaggtttccccttgcattaggatttcatcattgccaggcttggaaactgaggcagactaaattgctttctgagcaattaaacatcagctacttccaggccagccattcctccttcagactctgaatcctccaagggttgggcagtacccaagcccccagtagaatagtcattgaccttgctgaagggcatttgtcatcactccagccctgggctctaaggggacgtgggttcccccacatctcccacctggtaccagtctcctgggggctcatttggaaggccgcctcagtacattcttcctggttgctctagccaagaattgcccaattgatttgttgttactgagtcccatgagaaagcccactatgtacaatgtatccaactattgaaggtggagggcagggtggagagagacaagatctttacctcttctccacattttcaaagatacccccaccccggaggaatcagtctgtgatcccagtttgaaaactactgatccacatgattgtgaaccaagcaagatcatttggacaaatctaaaaatttgcaggtttgcatcattgagagagccatatcctgttcctaatcccctcgaggccttttcagagcagagtagtggtcagaagacagaccaagggttgggcccatagcaaacatcttatggccaagccaaaagcctctggaaggaattaaacttccttcatcacagagacgacctaaagtactcacatctttgggaatccctgcacagcccctttattatgtggcgtttctcatctccccaagatatttggctgaaccatatgaaatagacacttcgtaggtcaaaaacagtcaaacatcagcgtctcttatggtttaattgactttagagggcacatgcgtcagcctccatggtgggtcacggttgagcatgtggtaagtcaggtcctctagcccacacattttcccactaggtacagaatgctcgcagggacactgtaaaagttgagtgacaggtggcaaacaaatatgcaaaatcttgcatttgaaagtgtgattgggcttttcttctctttctcctcaaaagggacaactacacccttcagatcaaccctaattcaggcctctgtaatgaggatcatttgtcctacttcacttttattggaagagttgctggtctggccgtatttcatgggaagctcttagatggtaagtcttgaagtaataaaaataggtcagtgctgcttgcggtttgctagtaggtgtcttatctttcgcatcatgggtttttaagcaaaagcttcactggtttactcataaagtatttttatgttttgcccataatggatgtccttttctctggtagcttattttgggcactgaagacatagtgtctacacacagttaaaaacaaaagtttttttttaacttcagtgtaaaacacagaacattatgtatttatacatttgtatgttttctggaataactttagtgaaagcaagatttgataacagatggaaaaactaattgaaaagttaattaaaatgatctcatctatctaatatcctgtgattattgcgtttgtccccaaattattttttaatttgaagggactaaataatttcaaaataatgttactgcttagctaagacattaaccctgaaacaaataacacaaaataatttcattcttatttaaagcatatagatcatggaagaatttcaaggtaccttgaaagttagaagtcaaaccctctacctggcggtatctataggcttagagacttctaaaagatttggccaattcaaaatagtgtccttaagaaaacactacagaaatcatcagtgagaaaaaagcatcagaaatactttttaagagcctggaggtagagtggttgaggatgggaagagggagagtaggatttgagattgacattgcagtaacttataagaaagatatttccaagggaactgtgttcattgcatttatagagccttagctattctaataaataatttgtataccctctgtacttttcccatgaatatgtttttactgttaattggtagctgatattgatgctctgattttgttgctttatttggtagcagggcgacagtaaacactttttttcctctagaaggaaactaaaccacacactctttccatgtatgtatagtgtgaatatattttaatttccagctttggagtcatgccatagattgtttcagcctgctccaattcactccaactttctcagaaggtcagtttagtcaccgtatgcaagtgagaagatgctgttagttgctacagtgtctttaataccctctctaacagggggtaatagagaagcataagatatgatcctgaccttagtcagcttatattttagcggggggaaaagagatgagaacaaaaccagaagaatcacagtgatagtgtctgagcagaagggagtgcattgagtcctcagaggagaaagtgacttggctggaggctcagggaatctttcccaggatgagctgcacctcggaggtggggtagcatttgagcgttcaaaggctggggtcatttcagatgagtgaggaccagcccagagtcaaggccttgtggaagaagatgggcggaagcaggaaccactcagggtctcaaggagctggctaaagtgaccccgacaagagtgatcacgatataaacctggaattgcacatttaagagtccaagtgcacatagatgggcctagtcagcagtgtcttcaaatttcccacagatgggaatgtccctgtcggcagggctcattctgcacatctgtccgatgggaatgtccctgtcggcagggctcattctgcacatctgtccgctgctccccctggtcggcttcatgcttttacttccccagacactggagtctattggagcctgcatagggccacgctgagccggggagaattggcctgtactgcagagggtgggtgcctggtggggggatgaaggagcagaagcaggagcctggggtgccaggtctggtggggtcaggaccccctgtgaggaggtgcgtgatgcctttggatcaggtgaaatggaggcacctgcaggacgcctgaatggtgggaggccgacctcgctgctgttgcctccctgaggcctctgccgtccctccgcggggggttgcacaggccctctccggggccttccccatttccagcctgtccccttcctgtgctttctccccatcgctgcccaagcaatgataacagaagacagatggaatttcacctggcctttcactgactccccactgccctcagagagcaccccaactctccagcaccccatgtgggctctgcactgccggccccttctctggcctgtctacccgccctggcaaacggctggcaagtccccagccttgttcctctgcttagtgtgcccttttctcccccaattcctacgcctgatttgcactgcggactctgcttgaccttgaagctcatctgtcacctcccagaggcctttctggccccactctgctgcgccatctctcttagcacagctgccctcctcatgccactctccccctgatctcgcctcctcgcttgtgcaatactgtagaaggcccttggttactccttcatggtttctcatttacattgaaagcaggttaatcttttctttcatgctctgatacatagcagtgtcaaagacctgaaactaaacccagtgtttaccgtgttttaggtttcttcattagaccattttacaagatgatgttgggaaagcagataaccctgaatgacatggaatctgtggtaagtaaatgcacgtcacacactggccatcaccgggcactcgtgtcttatgagaaggtattggagagccatatttgtagtctcagccacttttatgggtgttgcattccatgtgaacaacaggagacatttaattgcttgaaaagttcattgatctaattcttgtaataaatcattgttcacatttcctggaaccatggtacctagggtggatacatccaaatcccagttgcctctgcttacccggcataggacttgtgtgaacttactaaatccaagagacagctgaagatctatggtagcctgtgttttctataaaaactgctgctgctgaatgtttagagcttcatccgctctccctctgtttcctgacatcataaaaatggcagaggcaaaggtcaaaacaataggaagagtatcaggcagacgtcctagacatggatgagtgacgccacagctcaggcaagtgaacacttgagacgttctccaagtagtgatttgggttttcatgttgcatttaacattaattttacctagacagaccattttagagttggaaggattttattttttttttattttttttattttttgagatgatgtcttgctctttcacccaggctagagtgcagtggcgcgatcttggctcacttccgccttgcggattctagcaattcccctgcctcagcctctcagatagctgggattacaggcacacgccaccatgcctggctaattttttttttttttttttttttttgtattttagtagaaacgaggtttcgctatgttggccaggatggtctcgatctcctgacctcatgatcctcttgcctcatcctcccaaagtgctgggattacaggtgtgagccaccgcacccagcacggatttgctataaaacaaaaattgatgttctttttataatatacttctgcttctgtttttcttttaatgtacctataccccacatctacctccagagtgtatgggtgtttgcccacacgccagcacacacacagggccactgggaagcgcgtttgtccatttggggtatttgcagctcattcgtgtttgctcacttgagttaaaaagcccctgcatgatgtcacctgcctgtgataccaactgtattttgggcacggttgggtagatgagctgtgtcctcggccctgaccagcgctgactcagtgtttctgttgctcctcattgtatgaaaggagaggaagaggccagcagtgcccttgaacccactgctggtttgccagtcatggtgggttgggatgcacacctgtgattccggtctccactttgaccctgtgtttgtgctttctgctttcatcactgtatgatgaagcagctaggagcacaggaatttctcttaacgtctaactttataccacatgctgacagttagtgcctaaagtacagtgcgtgtattatttttaccctcttcacagcccgtcgtgtccccagcaggagagaccgtggagggaccagggacaggcgcttaggcctgtgactgatcctctggattctgaaaccagagcagccaccctttttgctgacattaacctggagagtgatcaaagcacaagaaaggggataacttaaaactattggtatttacttagttggaacattattttacttatttatttttttggcgatagaatcttattctgtttgccaggctggagtacagtggcacaaccatagttcactgcagcctctatcccctggcacaagtgatcctcctgtctcagcctcccaagtagctaggaccacaggcacacaccaccatgcctagctaatttctttttttttttttgtagtcatggcgtcttgctatgctgcttaggctggtcttgaacagcctcaagccctcctcctgcctcagcctcccaaagccgaggattacaggattataggcatgagccagcaagcccagtctagaacattctttatccttcctgttttcctcagatactttcactctttttttaaactttatttattttttatagagacagggtctcactatgttgcccaggctggtctctaactcctgggctcaagtgatcctcccaccttggcctcccaaagtgctggaattacagcgatgatattttcactctaaaaagatagaaagtatattgaccagcctggccaacatggcgaaaccccgtctctactaaaaatacaaaagtcagccaggtgtgatgtcacacgcccgtaatcctagctactcaggaggctgaggcgggagagtcactagaacccgggaggcaaagattgcagtgagccaaggtcatgccattgcactccagcctgggtgacaagagcgaaactccatctcaaaaacaaaaaaaaaaaaaaaaagagagagagaaaagaaagtatacttatgtctgtatgttaaattttgtagaccagtatggcagctccatccaccatccagagtaggtgccttccactgtgcatcactaaggacaggatttaactgcaagctcattacaactaaagcagtttgtttgtttatagtttaaagaggaaggtttggtttaggtggagcaggaaacattgcattagtaacatatttcttgagcattctgcacagaattacattagaatgtaattaaagaagtcaaatgagtttgtattttggggaaaaaatgctgaattttcactcctgtgtcattctgtaggatagtgaatattacaactctttgaaatggatcctggagaatgaccctactgagctggacctcatgttctgcatagacgaagaaaactttggacaggtacatgtgggtaaccctgggaactcttctttagctttcaaggggcatttttcttcttgacgggctgtaacacaactttgctggaccatcagaaacaaccagcaggagctgcaggtgttaattttcatctcattgtagcagcacctttttgtcatgccaagacgccacactccaattacaaccatttctctcttccagcaaagttacagaaattccaagaggccttggggcatgaaccagcacctcttctaatccaaagcaaatgtgaatgtttcatttgtgcctcggttttagaatttaggtacttgaaaaaatagtgagattgttgacttagcgatgtaaatacatgaccaggagtgggtgatgttggaagggccattggtttttctctctgttttatggttctgttgtcatggcgacatttgtcttgtgaggctcagcatggcaggctccggtttttctaccattccctctgctttgcccccacgctgttattcaggctggactaatcctcaaagtcagtttcagactggtcagcagggatttggatgggccactgaaagtggatttcaaaggtaaagttgcctgcttggaataattctcatcatgctaaggatctatgcgatgtatttgtctcaattctgaagcctttgcttcatctgccactcagtaataatgatgcagcttgggaggtgttctcaatgtattctctgaccctggtacctgtccttccgcaaaagcccagaggtatttcccatccttcagactaaatctccacggctatgaaattaattagaccatagaactcattgtaatggttgccctctgaaaaatgaaatagacgtgttctttattgctagatgtcaaagattgctagagaatctttgagaaaagaagctgatgccactagaggatttaatgacaactgagggtaaaaattgttggataagaaaataatcacattaatatcagaatcacttgttattcccatgtcctgtgtttgagccaggagagttcagtctctagtgtgagtcctggtgtgggtggaacctggggagtccatagggcccttcagtggctaggcaaggctcagagaaggacttcaggcaccagaggcaagagaccttgtggcttaatgtaaatgatcaagtcctttaaaaatctccttttgtgccccctccccactgcccccctttcccggcctcctccccaccccactgtgttgtgctttatgcctgagaatccttacagacaggcggacactgttctcctgcacggggaccttgtgatggggcagggaggggtcttttcagctgctgcccctctggtctccagcagcctccccaggaccgagagtactggtgtctccagccctgtctacctccttcctctgctgcctttgacacaaatagctcactccccccagagacacctgcaaggcacagtgcctttcactccgggctctcacccctccccactggtctccagtcccctggaagtgcatgctcctctgctggccctgtggatgcaggtgtcaccctgccagctgtcctgcacccgctgcttttttgtctcacccttgctatctggatttcctcatcctacctgtggctccggctgcacccatctccgctcaccaccagcctcttatctcaggccggcgtctgccttccagcctccagaattcccaggtctaacggcctcctcaactgcttctcctgagaggctcacgggtcccagtgctaaagccactttttcctccccagcccccacatcggttatggtctcatcagtgccaccactgtcccctcccacctgacacttgggcatcccctcagaatctccctctctcctcatgccatctcccctcctcatgccatctccccgtgcccaggcttgctgtgccccgtgactccccgtccttggcacgtccctgtctgtgcactcccctagccctgctccgatcacttcttgactgctgttctcacagcctcctgtcggccgccccctttcctgctttgctgttctccagtgccctgttctctagtgcctaccctgttctccagtgccctgttctccagtgcccgcctagctgtgagccccttatggactatttctgaaatgcagccctgaaaatgtccttcttctacttggccatcttgtgaccttcagcataaatgaaaactgttagcatggcatatgacccctcataatccagacctacccccctctggcattaccctctgacacctccttcctgtcaacctgtcaacaaacagtgtgccttcaagggtttccccagagatgcttcagtgccacattgctggctcgacactgcccactctgtaccgatgcattctcattctctctcccatcacctctttccctgccatcctcgaggtattgactgacgtgctgtgtgctgtatgccccctgaggtcttctgggtctctccagggctcagcatgtagttgatgcctgccagtgctcattgagcaaacgaatgaggagtgctaacctggcttattaaaaatatgaataaggtggtaagtaatagaaatcctaagtgtgagaaaacaaaatcagtcaagtcttggtggctttttttaaaaagccggacctattgaagggtcttaaactgccaattttcaaacgattagacatggttagtcaccctggaagtatcttcctttcatttttaacatatgaaggaaggagtggaagtaaagaaccaaggaagactgaaagtcagtcttgtgtgtcacatgcattaaaaaagtcttttcgtagattcattcatagaaaaccatatgaccaaattaacccaattcagaaaactattaagccacaatcagaagcaaatgatctgggaaaccttcctaattacatttaaatgtaattgtttccacctcataaatgaaagtcaaacacagggtgttggagtttttaagcaggcctctaataaatcttctgatgatcgttcaggccagattttcattaaaaacagttctcagacctcctcgtttaatgttgtgaattcttctgacttttgggtaggatcaagtagagtaatgcattaatcaaaacagacccatgagatgagtaagataagaattaggtgcccagtttgttgaattactgccttgcctttttgagagagctatcctgattaacagggaactcacgtatttattttgcactctgggaaggaatttagagcaagttaaatagctgcatatggatctcatctcccatatccagtccatcagcgagttgttcacacacctcccaaacctttctcatttctgtgcattctgccgatctcttctctcactcacacccaagtccaagctcccatcttccccactagacccccgacccgtctctacatccaatatggcttcttataatggcagagtggtctttttggaatataaaaatgagcatgtcattcctctgccagaaaccttcaggggtctcccctgcccttgagataaagaccccaaccttactttgtcccacaaggtcctgcgtggcctggctctccctgctcctcctccagactcactgtgaatcacaggccccactgggcttgtccaacacaagccccttcctgcctcaggccctctgctttctcttccatctgttgggagcatactccctcccagtctcagttcaggtgtcccttcatcagggaagccagcccttgacccagaccctatgcatcttccatgcctgccctgtggcatgtaccacagacgactttgcatttgtctgagtatgtttgtgtttagtgcctgtctctcctgctcagcttcctcccgatgatggcagccgcatgcctgccctgtgctcactcactgtcgtgtacttcccacaagcactttgcctggtgcatggtgggtacttgtagttgttgatgtggaaatctaggtgttagcatgatgcccggacaagcctctcacctctttggccctctgcaaaactgttgactctgacccagaagaaagcccattcctccccaatgccaaacagtcaagtcacttccacagtggggcaaagcaagtgcagttgtcatggggtgaaacagacatgcagtcagccttccacggtgtttcaaccttctttttttttaatttcacagttagaaatatcagaccatgaagtttggtagctgttccttcatgtaatgaagctgcagctgttgccattattttgcaatttgttttctttctgattggtaagaatctggggctgctggtttctagggcctaatatgaaagtttccactgaagaaatgtcagtgtttgaactatgatcctgtgccaagcaggaagaataagccgtacccccattcactgctgtgcacacatacctgcccccaccgggaggaggggcccttttagggctgtaacaagtgaaaattctttattgcaagttcagcagagcaacgtctaatttggttatgggtttgtttgtttgtttgttttttgagacagagtctcgctctgtcacccaggctggagtgcagtggcagaatatcggctcactgcaacctctgcctcctactttcaagcaattctcaatgcctcagcctgctgagtagctgagactacaggtgcaagccaccatgcccagctaatttttgtatttttagtggagacaggacttcatcatattgcccaggctggtctcgaactcctggcctcaagtgatctgcccacctcagcctcccgaagtgctgggcttacaggtgtgagccaccgtgcttggcctgatttgattgttttgaagagctgccagaagtttcaagaggctgtgcagtagttggagggagaccatgggcagcagccatataggaaggttctttaggatcgggtcgagccagtctccataggaatgattacccaaagggaacaaggaggacatcatctcagacattgaagtggttagtggccctcccagaagccacagcacattccacaggtgtactgtggatctctctgttaagatttcatggagagaggtgggccactggcagaaagaatctaaaaaggctctttagggggtgataatgaattaaaaggtagagaaacacttgggggaaggcagtgagtgaaaaggcagaaatggtcaatgagggagagggcagagcatgtcctggcggaagccaggagccagacgaagagcccggagctggaggtggctcccaggagcgctgaggccccggccccttcaggccagtcagggacacagaggggtggcacctggggagacgggaagtgggaaggctggcatggacttgctgcctccctgctgtcggtagttgcgctgctggagaggctggggaggatgaggaaggcctggttggtggagtgatgggggtgcagggtgctgactgcccccgaggccgtgccctgcaggatttgtgagcacccatcagtgggcgtttgcccagcagtgctccgtttccaagaatggagtctgacaagcagataagccttgctccacccaagtccagcatattccatatgagccaagctgtttctcagcagcttcccaggcagcgcaaagcatttatggagggtcagggagatgtgtgggaatcgggttgttaactggccaaggcagggagtcccccagaagttcctctgatctctgtgaggaagagagccaagtttatgctggggccagtagacttaaagaggaatttttctactgcagtgttctcccacgagctcttgctgagcgcctgctgtggctgggcattgtgttccttgtgtggggtcctccaggagcccaggcacaggagggcgatggcccagaaagccctgggagggcggggtgtgcgtttcgtggctgaaggtggcaagaatccaccccacagagcaggctctgcagactgctcaccagggagcagggcccctgggtgccagcaccagctccatctgcagttcgctgtttctccttggtcactttgctggatttctgcctccgggatgctgtccaccctcatgacgggggccagggcgctgccgcagcacctataggagatgcgcagggcagagagcagcccctgtgtgacgctgccccgatttctcccacttagggttgacactgtcacggtaccacccggtgttcagtgctgaggacatacagtccctcccctcctgtggtggcaacagctgatgttaagaagggacaaatttgggcgaaaggagaacacaggctgtagttagagtgatggtgagacaggaatgaaggcccgcagggaatctgtgtgcctggaggcgagcattagagtcagatagccgcctctccaacccccatggagcctcgtgcccaaccagcaaggactctggggcatcggccagtggcagtaagccagtgtggtgggctggacaatatgcctgcactgcaggagacggtgtcacgatcagcccccgacagccggtctcaaaagtggaatttgaagagtggtcattgcttctcatgaaagtgtcgccgtaactcatgaaagtgtcacctgtaacgaatcctagagggatgcatttctgtaccacggagggctcgagccgagacaccgagatctgggggcgtgacccctaacctagtagcttagggagcagaattacaaacccctcatcctgtgcccatccttgggccctctcctcactcccccacagagaaacccagggtcagaatcaaccatgagacttgacggctgcccacaggatgatttactgctgtgacctcatttagcatgggttagtgtgggcccattttttcttttctttcaaaaattatttatttatctaattataaaatattaacctccataataaaaataaagccagtataataaaaatatgtaaaataaataaatgtcacttattcccagtatctcaagaaaactcaggattaaaatttttatttacattttccagaattattctctgtaagcacaaaacagatttttttttttacagaagtggaattgtactctgcatactgttttcttttttattttatttatttatttatttatttatttatttatttattttgagatggagtctcgctctgttgcccaggctggagtgcaatggcatgatctcggctcagtgcaacctcagccccctgggttcaagcgattctcctgcccaagcctcctgagtagctgggattacaggcgtgagccaccactcccagctaatttttgtatttttagtagagatgggttttaccatgttggccaggctggtctcgaactcctgacctcgtgatctgcccacctcggcctcccaaattttttttattatactttaagttctgggatacatgtgcagaatgtgcaggtttgttacataggtatacacatgccatcgtggtttgctgcacccatcaacccatcatctacattaggtatttttcttaatgctatccctcccctagccctccaccccatgacaggccccggtgtgtgatgttcccctccctgtgtccatgagttctcatcgtttaactcccacttatgagtgaagctggaaaccatcattttcagcaaactaacacagaaacagaaaacagttttcaaattaatatatcacacataccttttcatgtcactgaatatcagtctataacattctaatgactgtgctgaattttactttgtagacgtgccatatatttttaaccatgccctgttggtagacgtttaggctattttagtattttctatataaacatataattctgtataaccctggaatactcacatatatacataatatatatagcatacaaatgtataatctggaatatacattttgtgtacttgactaatttttttccattgctataaactccaaaagagaaattactgtgagaagggatatataattttaaaattgtgatgcctattgccaaattataatatcttcagaaaaagattgaaccaattagactcccacccacagtgaaggggagaaccagttctctgcactcagcaacactggcttattttctctctcatccctgggcgctgcttttggaggaagcagagtgttttcctccttagccctcccctccccactttgtctgtggccgacccgctcattcagtagctctctggaaattacaactttcaggcaacaccaaagaaggctctgtgatcaaagagagagggctggatgaatgctggaaggagtgtattacagggattgtggatgcttatctacttgacctccttccccttccctgtgcgaggggaaagggtgggaggaaagattcggcttgagtgtagccgagctgtaccgaaagccttctcgataccaatgcctgggctgggatttattaacttgtcattgacgtggatctgataagaaaactcttaccgaaggaacaacaaggcagtctggggaggaataaatggggaaaagaagaaaagccaacctgggtttattaacacatagaacaaaaggtatggatgagcactgtccacgcacctctgagaaccagccacgaactggcagagtttcactgtagaaacatccccaccccacccccaagtggaagctgtttggcatcctccatccccaacacggcctgtacggggcaggagcagatgacccctgggagaaaatgggatgcactgggaagatggcagctagaaagggaaatggagaaatgaaggatgtcagcaaaaccggaaacgcagcaaagggattaaaattcacattgggcacagtgaagagttcagttgactttgcagaaatggaaagcatagtggaaaaatgagattccttcctgaataaagagaaaaagagaatgtcgagggaccggatggatgatgaatgtgttttacgttgaaaagccatctcagtgtgaatgggaacaagagccagtgcgtggagaagccgcatgagagacccaggtgtgagtgctcgggtcagaggggctcaggatctcctgggtgcaggtggcaggaccaaggaacccctggaggtggcctctgccagggcatagagttcatcacaacatggaacctccatccctcctgggtaccaccctaacacttactttggaaaaccctctcccctggcttggtttactctataatgcaaccagcaggcagaggaaaaaagatttagagggaaccccaccaaaatagtggcatggctttctttcagtaggagaggtgtaggtgctatatttttccaccttttttccccaaaatttctacaatgagaaaaaaacattttattttaaaatagtaggcctctctcccttccctcacgctggttactgtgctatgtggccttatggtaagctaggtctgggtcagggcataggagaaagggctgccctgattgcagctgcttttttcatgatcatgggtggtgctaagggaggaagcttcagggcagatgagtgaggagaaggcgtccaatgcaaataaatgccttcaaaaaccagataaatctgtctcttcagcctggatccttaagcttctttcttgtctttaagtttctgtttgcatttttgaaagaaataccatgcatcctttttttatgactagaaaatataattttcagaaacagaatgcattagaatttggatttctggagtcttgatgggtgtaccctgttcttttctctgttaaacataattagtttcctgataaatgaatagcagaggaaaaaatgttgctcttcattattgctaatatatgaagaataattaaaagtcataaataaccataaaacaatttgcctttaatgatagcatctttaactgtgtaacatcctagcaaaaaagcctcattggacattctcttgtgcacagagcccatttgccgggaaatatttctgaatacatgttgtcttccctttatagtaagacattgtcactcaataataatatgcaagataacttcgtgatagtaattgttgttttgtctttgtaattacagacatatcaagtggatttgaagcccaatgggtcagaaataatggtcacaaatgaaaacaaaagggaatatatcgagtatgtatacacatatttactgccttttctttgaataattgaaatgcatgtttggtcactgtcccttgctgaaacagctcatgcatttattatgggcatgagtttattggtcagttttcaacaaggtaagttcttttctggcttgggctaatgggaagttgaatatgggatggaaagtctgtcttgtatcatgactccattgagctgccctataaaggagcagaggagggagaaaaggtctatattattgagtaatacggcaaatactcttttggaatatgtggatatcaactaagatttagaattgcaacggagaaccacggtgtcagtgaccagcagggcaaaattaggaaccaacaaagaaaaaatattttgtctctctcccaacttcttttccataatagaaatgtatagaaatagttaaaatggataggaagaattcagcatgtgcaaccctaaggaattctttctggtatttgtaatattcttaactcaacttcagcctcagtggaacaaaatgttgagtctttttggaagtctagctgttaagtgattctaagacatttgtaccaggcagaagtttttctctgttgggcacgttacgttttcttttttagtgtatatgtgtgcttcaaatgcataactctgggatcttccaaggagatcccctggtgcaggggtgaggtgagcactgcagtgtgtggttcctggcacctggtttctgctctcttgtgggtcgccacagtggccctgagttcctcgtttgcattcagtgcttcgtttcaacaggctaggctccctcctttcttctcatttggaattggtcagaggtcttgaaatcagacagctcttgcattgactgtgggtcttagcacctttcagtgtgatctgcaaagaaaaacctactgtccttcctaattaggaagaaacggagcgtgttagagtctctactcagagatcctggcaaggagtggaactattacatggcggactcttttcactctcaagttgaaagcttgttatgctgaatacatagactagaaataaggtacctcggttcttacctggccacattaattggcactctcgttctgaatatgaacaatcttagctgatgacatcctggcagacaccattgtcttccttcagaaagtacagactgtgagtggggtttaaaaaatattctagctcagggtgacccaggtctcaagtctgaggactctgacatgcgtggtatgtgtcttgcatcattctttgcagttaattcttttagggttcaaacgtggtgggagtcagggccaggcagggttccagctagctttacttttaaaagtataattgaaatcaccaactgctccctgatacctctgctcccctggtgccagaagaatgctgttgagctgttcattgtagcccaggaggtgccacctgagaggccgcacagtggttgtgctgcaggctggtcctcagggccattaccatggttacagtgtaccaccccgaaggtgagaacccttcagaatgatggaatgcctgagatgacatccagagtacatttgccttgcgatcagttttgctgtgcattaaacactgtcgcagggaacttggttttggtgaacttcagttgcataaggaggtcttaccattcatcctctaaattttggcattaaattatgagtgcaaatcattttgctgataaagcttatatgttattgttgaatattagcacattggatactagaatgaaatattagataactaaatgcattgtcctgagtacactttacaaatatgtatacatatatgtgggtgtgtatacgggtgtgtgcatcttatacatgtatacctgtgtgttcataccccatgaacttttcccttttctccatgttgtcacattttaaagcagttaaagcatttaaagcattttaaagcagttaagcatttaaagcagtttaggtcagccaaaccttgatgtgggggaagttaattactcttttgaaatctccagtgagattttaggtttttcacgggtgttccagggagtcttgaaagaagccatgaataaactaaacagtgggggcacagaggagaccctcccctctgctctgctgtcgtggatggaggagaagcactccctgttgcggagaaagcagtgagcactagtgatgatggaggtggttcaatattgtcctcttttctcctgcagcttagtcatccagtggagatttgtgaacagggtccagaagcagatgaacgccttcttggaggtaagccatgctggccagggttctctgccatgtgcctctggtcccgggtcgatgggggatcgcgcttctcctttagctagtgtggtggagctgatcagagacagaggcgaggctggggaccctgcaggaagaccgggatcgcacagctcacaccgctggccagtctccagcacaagagtgttcagccaccgtgccgccacctccttttccttttcacgggttctcctgcttgacttctcttatttttacatttgtcctgtttttaaagaggacgttttacagacttgatctagaaccattgtcttggagtttcaggcggtacccaagagaaggctgccttttgctgcagtgacaggttccaagaagcccgagggctcagagctgaatgatgaagcgcagtccccaaagtgcctggccacccctccctccctggatcactgctgcctgggcttgattgattgattgattgattgattgattgattttgagagagattctcactgtcacccaggctggagtacagtggtgcgatctcggctcactgcagcctctgcctcccgggttcaagcaattctcctgcctcagcctcccaagtagctgggactacaggcacgcgccaccacacccagctaatttttgtatttttagtagagacggggtttcaccatgttggccaggatggtcttgatctcctgacctcatgatccacccgccccggcctcccaaagtgctgggattacaggcatgagccgccgcgcccagccatggacatttttttttaatcccctgccctttttctttgtggcataattcattgcaggttctcttctatacagatacatggaaaacacattttcttaagctgagtttttatttattttatacccagccacctcatgacagcttttaccctgttacagagcaaagtgggcactgcccagatcgaacttttaatatcagggatgctcccaggcccctagcagtgggtgagggattcatcattttaaacagtattccacttggaccaaaagcaaaattctttcttaaatatgatatagtattagttacctcaaagatcacacaggaaacagcctcgtgtccacgtgactgattttctctgcactgaggcagagctctcgtggggtgatgctttcccttcactcaggtacctacacaggatgcgtgaaagcccgggcagcacactcagaaacagctcggggccttagggacttaaaatgggaggacagaatggcaggtttcactctttatttagataagaaatcccaggaagcagattcctgggccccaccgcaggcggtccacaccttcagaaacgcggcgttcgcagcgcgcagggcccagcagagctgagctcatcctagatcacgccacagttagtggtacctgggaactggagcatggttttctgtacgcacagtgtctgcacccatcacctgcctccctctgtgtttcttctccctgcctccagcacgttatttttaagcgtgtctcttacacatctgtagcctgtgcatcttaggacgcactgactcacagcagtgttataaatggcttttggaatccaccctgcctacagtatcccatattttcatcaggtttcagaaattactccactacttgaatcttctagattctatgctttttcgaaactgttatattgtgactgtgctgtttttactggaactatagttacttgatactgtcactgacataggaatcatcaggagagattatatttttttctggctaaccagaaaagtttgtttttcctgtgaaattttttttttttgaaggcaataggtgtttaagatgttttttttttttctttcagggattcacagaactacttcctattgatttgattaaaatttttgatgaaaatgagctggaggtttgtattataaacattattttatgtaaagtggattttttaaagtatctctcattactttacaagtaatattttaatattcttggatccataatgtcctagagagtaactttagatgaattatattacatgtctcttatagggcttatttgccaatgtggttctattacatgtctcttatggggcttgtttgccaatgtaggagtaaggaacagcaaaaataatcagctgtagttgccttgtccatcagagggcagttctggaacatgcctagtaagtagaggccactgagcagagctgggatcatggccctatgcaccaggcgaggcaaattgccacaacaagtagaaacaaggtttgcagtagccctctggacagcagaaacctgcttacactaccagactggccaagtatcctctgctgcatccccatccacccccaccgtggcagccaaatgggggtcttggccacaaggtggccgtaagcatctacttgggcctgtagaacgacgtctcattgaacttgaagtggtttatgttgagtgaggaaaaatgtcagaaggcaacagggttgtagcaaaaggtagtttagtgattgtctagttcagcttcttggtgttgacatagttgagtaacagccattttaaaaacaaaggaatatctcgccctttgttgtgtcgagagaaacaggggaaagactgtctgttgagaagccgttggtgggactcggccatttgccccgtccatagccagtgagtgtttcccatacactggccttctatacttttatctcaaaacagaaagttcaagatcgatgatgtctatagaaatcatatacctcaagcctttcctctgataggtgggaaactgaggcagagagcagctgggtttacccagcaaggttttggcacggtcaggcctaggaactttatttccaggcttctggcttagttctgtttccatttcattctggtacctttgcataaatatcttccatttgtccacaggaaacctcccctgatggagagttgcataataggaacggcaaaccttagactaaatgctaagtcgaagacccagttgtgccttagcgtatgtctgccattcttaggcctctgggcagatgaggtgatttgtcatcactggaattgatcaacctggaggagagtcataagcactaattcttttgtgggtagggagatgcttttagatattcagaggaataacctctcaggaggagaagcagccagggtaatgcacagatgctgctggagcgtgagagaatccacaggtcccatgcgtaagactagaggggtagggaggacgactgtggcatttttatatccgatacgacatgccgtggcttgcgcaaggttcgaattgagctgccctcgtgactgctgcctctgtgatctgctatggcaggtggagcctggaacaggtgtctgccttcctctgttgttatgatttgctagcttaccttcgcggcacagtgaccacatgctggcactgagggtggtcatttctcagtgtgtgatctcgcacctttcacatcctgcttttacatctggtaaattttcttcctagttgctcatgtgcggcctcggtgatgtggatgtgaatgactggagacagcattctatttacaagaacggctactgcccaaaccaccccgtcattcagtggttctggaaggtaactccggggcccagccccagccggtgtcctccacctgaggcaggattgagggctgtgtggcgccctccattgtggtctgacttcaggactgatgctggctttggggtctgttagagcttggactgctgggggagggaagaggcaaactgagccagcagccccgtggtggctcctctgtaactgtagcagacagctagacttgaatgaagttggtccctacaaaagcacactggccttccttgaccacctcgtgaaagtgacttttatttgagggactggtcctccaatgcgtaaatagaaatggggggcttctcagggcagaaacaggcttcagggatggctttgcaagatgccactttctgttaagaagtcgttttctcaatttttaaaatatattccaacaaatattttgatctgtgtatctttcaaccaaagataacacaacatttgatttattatcttagggccactgtttgtatcctgttcagcttaggagggaagtaaaataggaatgggttagtccaaaggagatatagtaaacaaacttaaaaaaaaaaaaacagttatcccccaaaaaggctgattatttacttcaccccaaaaaggaatcatttaactttttcaaatttatttttatttatttatttatttattttaaagatggggtctcactgtgttgcccaggctggattcaaattcttgggcttaagcaatcctcctacctcggcccctcaaagtgctgggattacaggcatgagccaccatgcccggcctttttcacatttctaaatgccttttattactatttcaaatgccagcaggaatacagagataaaaaagcaaaatcttcaaagcctagtccaggtctcacttggcttgttttagatgtttgcctacagcagtccaagtggcattaccagtaaagccacctggattcccataataatgcagatatgtaagatacacagattattttagaaccccatctttgcctttgttgttttgtttttgttttgttttgttttgtttcattttataaaatgatgtcttctagggaacgtgtctacaatctgaaatcccatctcataacctggcttccccttgtgatgacaaatcttaaatactgtatatttataattggcttagggggaactggtaagcctcgaacacagaaacatgagcttggtgccatcagagagtttgctttttatatcatttattttggcctattggcagaagaagaaagagacggacattgtgatcactcagtctcttagattagagaggccagctagtattgtggccataaaaaacctactcagttttcagagtcaactgtctaggtcttacattgcaatataaataagattaagttctgcctgcctgcatgacagcagcatgtgccatgggtcacgtggggggtataatgaccttctgcctctgttcataggctgtgctactcatggacgccgaaaagcgtatccggttactgcagtttgtcacagggacatcgcgagtacctatgaatggatttgccgaactttatggtgagcaggataccattggattcagttgtcctcctgggaatttccagccaggcatgaactctggcccaagaaccctgccgccaggcctctgcagaaggctaagtttcaggacagtgtgccatgcataggttccatgaaagttcaatgaaagtactgttatctatactttatatagataacatggtgcttctacttcgagggattggggggcagtttgtgaagaggtccataaggctgctcttttttttttttcctagtttagttttttagtaaatcgttaaaaactaggttttgtagggtcatttatatggtcgtaaactgaggtataaagtcacctccagtaggcagaatttttcagtgtttaccatagatttaaaaatcactctgtactttgcatactgaaagtcacatttcattcaccctcccacccacaaaactagtttgaagtttaaatttccagggcccagctgagaggctgtagctgcctgcctttccacgtaactgttgtgtttgttaatcttggtgcagttccattctggagactaagcagagtctttctgtgaggttgtgcagacctctggcttccctcaacattaaatatcaatgttgcagcagaagagagtgtcttgggcctcacccctgggggcaaaccctgccctgacagtagctggactgcagaccacaccatagcttcattcttctgccccaagcaatcttaacatttctttttcttttcttgtctaggttccaatggtcctcagctgtttacaatagagcaatggggcagtcctgagaaactgcccagagctcacacatggtgagtgacaaaaacacatgcatgtcaatgcaatatctgaactgcttagctgggtatggtgctgggctcaaggctattgaatgctctgtttcctgtctgtaagtagcttagagaattaaaggacagtgatgtggatgaaaatagaaattgtacagtagtgctaataagacataatgcactcagtatgtttggcacataaagggctcaggcctccctgctgtggggaatttctcctctgagcccagtccttccctcattattctaggtagtggagctttcactgttcagcatacatagataaggcagctctcaacctgtataataaacacgttgggtttttactccaaccttaaattggttgagaagttaggacaaaataccctgtagaaacatcctttttcaaaggccttctatgcccatgaataacctgtaattccctggaattgagcagtaacatgactgtggtcggaggagggtaagagggctgacacgtggccagggatgcccaagcgtggagcgtggctgccctcagaaggccctctcaggaggcacagtgacgcagaagggtcccagttgttttctgaacagttgcatgaaacccagcacaaatgcagactggatgggatcagtttcttgaagccgggttcagggagctcttgctaactcaaactcccatgtccctcgtgttggtttttctgcaaaggcctttatttcttgctcctgaggaagcagcagaagtgggccttctggaaaacggtgagcagcgtagccctgtgtttctcatgcagcgggggctgcaaagcctgctctggccatagtgagctaacataagcaaccaaacactccctgcaggaaacgccctcccttacactagaagtgctggccaggagagaattctcatgaacatgtgtttgcgaaaaattggctgtgaaaggtttttcacttctgtcggattcccttgcctcaccagaaaggtgttttttttttctattcgtaccattcacgtgactctccagatggaaacaatgtggtcattgcctgtcagagccttgaaagcaagctgactccagcctaaaattcatgaatattcagagcagtcattgtccgtggttctctggctttattctaagggaagaatgtttgagtagttcagagcttttatccaaatggtgtccaagtcatatgtggttttctgggttctactggcctccatatgaaggcaccagcgttgagccaagccccaggactgtgggtggtgatgcgaaactcaagctcataatactaaccaggatgaagattaggaaaagcgaaattattgggcacagtcatcatctgtggtcaggcactgcttaatctttatggcagccttatgagatatgttattcccttgggctgtcagaaggctggcccagggctcaccagagtcacagattcccagatcacaggatttgaactcagagctaccagaattagagcctgcaccctttaccactacaccagatacactgcctctgttgatatacccactttctttttagacttttccaaggaaaccaaattagtgaaccaatttcatgttcattcagcccatgtttctctgtgacttcagggacacatatcttactattgaactgtcttttttatttcggagcccacatgattctgccacaagtagaacttcccagataagacctctgaactcagtggttctcaacctcagctgcatgttggaaccatctagagagccttaaagaaatcactgatgcctggaatttggacttcattggtctggtgtgtgacccaggcagtgggattttcaaagctccccagatgatttttataggctggcagggttgaaaattcacagctcttccctaggaagggcaaagatccacctacaggaagggaacaacccagctggctcttaccagaacttattttcctctttatgtgtcacggaaataaagcaactgtgtagttttcctaatgatgttctccccagactaacttgacccggatggagaggactggcagttgcaagcaacactggctagcatgagtgggactgttctgctgtttcttctaaatggctttcctccctacctgaccctgactgtattttgacataggaaacagaaacttcactggctgtttcgtggcaacagttctgccataaaattttgccatacataggtttaatttcttccacgttttatgatacacaattaaagttcagaataaaaatctgatttcctagaagagcagaagctgaaggatctggttctctgtgatgagggtacctttcattaagctttccaatggtgattattgagtgtctgacattcaaaggacttcatttcattgttctataaaaggtcactactcagacatttaaaattactcttcattaagaatcacaggcccacctgcccttttaggtagactctaaagcaaacaaaaatcatctcgttcagcccatgcatcttccacgtgaggacgctgaagccctgtgaggacaatgagctccttaaagtcacccagctcattagtgcagagcaaagccaggtccgtgtgtcctgacctctgaaatgataggaactcacactcaccaagcactctgttcattccggggatggtgctcagcacttgatgcgattgactcataccatcatcacagtggccctaagaggtgggtgatgttatgacccacttttttacagataacactgggatgcaaagcggtgaagcattaagcagcatgattcagaacctcagatcttgacatcccgtctttgcctctctcttcatcatgccagtgtttctcaaacctgaataatctgtgcaccttttttaaagggaaaaaatggtcacagattctcaagaatgggcctgagacccccatagggattgcaggcccgggactgtgaaaccccagctgaaaagcctgaagccactttcggtgaaaggctcttttaaatgccatctgtagatgtgaagtcctgtctttattaatatgataatagaaagttaaaagcctgtattagtacttgctcttttaggattcctgggttcctgagaaccccagtttgagaagcacagtgttattctctgtcttttagtgtttagtggctgttagagaatccaagtggaactcagtgggacttattcaatatttagtggttgttaaacggccctctacggtatgtgtttcttttctgttgctgtgacaacggttagcttttagtatatgtgcaagtgctgccaaagcgagcacgtgaatggttagcttttaaaacccaagaagttactttgctcattcttggaatcacacatcaatacctggagggggcggttttaaacacagtttgagcactcgcggcagaggcagcacaagtgcacttcaagagctgggctttggagcaccccagggctgtacctggccccgtgtgaccttgggcaagttacctaaccttgctgtgtctcaagctcctcctctgtgaaataggggtgaagcattagctgccttacaaagtgattgccagggttcataacattgagacaaggctgatggggcatggtgagcactccatgaacatgagctcttacgtcataatgagctgtggcaagtgtgcatgccattttcatgacagatacacatcagcaatcaccccccaacacatacacacacacacagaggtgcaggttctgtggctaaaggctctggtcttgagccccatgtagacatacagtaaatgttgaaaggtgttaacactgataccatctcttgagtaattgagcccttgctgtatgccgggcccactgatccgatccacttggcactcatatgtgcagtttccccatgtcacagaagcacagaggccatccatttgtctgaaaaccctcactattgccagggcgatttgcagcccccgcccccacctgaagcctccagatatgtagggactttttctaaatgcaactttacatagcaaatgtcaattttgcctgactttgatcagaggaggtagcttagcactggtgttcccgagccccggacagcctgggttctgtttgtgggtctgccgtttgacaaagactgtgacctcaggaaccttgccctatgtctctgctccaggagctcctgtgcagaatggagataacatgacctgcttcatagggttgtgatgaaaatgaagtgagttaatagggagaaaagcacttggcttgaggcctagtgtggaataagtaatagtattagagatagacacagtcttaattcgtgggtaactccaaaagcatcagctctgtgttccaagggtttggaaatcttgccggttactcccttcccaccaggattcctccgagatctgcatctgactatagcaaaggtttcatggaccatttgaaaatgttctttctctgtaaattacaagagcttatttagtgtggatgtttcatagctagaggtttttggggtttttttctccaggtaatcaaaattgttggttaaggcttttttattctcttactcaaacctcatgccctattaaccagatcgaggaagtgctgttgtggcttttcacctacactttttgttccttttgcagctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 371 - DNA, 11839 bp, Homo sapiens
ctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccggtgagagcggccccgacttcccgcccctaggctgtggccccccgccctctgctggggatgccacgtccggctgccctgtcctgtggcctcctcccgctgacggctgcgatcgctcggccggtcacctcccccagggctgtggtctccccttccctgccccgccgacgcgggcgcccctctgttgcccagtagccgtcagtaatcagcagcctgaccttgggcgagtcatttcaccctccaagcctgtttctcccccagcggccaggcaactcggtgttcctaattgggcttgcatccaatggctagaagtaagaaaacatccgtgctgcaaaatgaggtttctgaacgcagcctctctgcagggagaggagcgggcaggtgccacccggggccgtggcttgagaaacctggggaccgcccagacactgtggacggaaggccccacacccagaagcaggacgtggctcttctcctccctggccaccttccgccgtgcccctccctgtcgcactggaccgagcagccattgccgagtcccggggtggagccccgtgcactttctgaccaagagcgactgagaagggaagcaggcaggagtcgccttcagtctggttttaggacggcagcctctccattattagcaagacttccttgctttgttttggttgacacatctgtcaacatcacccttagcaccgcctgccctggccaccacgtgatgaggctgtaagctggcccttcctgtatttactttctgctctgatattatgtaagtgtcagcagtgttcttcactgcccacgagcataattcttcatcacacaggagagggcatccgggcaggaaaagatagtgaagtcgtgagttccagcttgtggtagcgcctgtgtctgtttttgtttcatatggtcaagaatgttttagaagtgagttttccttctgagttgttattttgaaatttgcatatttatttagtaagcttgcattccatgtcctctagaattcaccctggcacatttttcagtttcaccatagctgcttccaagaaactgggtggctgtgttgccatgagaatgactattgggtacacaaattggtgaagcaggtgtagcctatggttgcatcatatggcaaaaggcaggattttggcggaggatttttaaggtcttcctttgatgaggaatgccgctcccatctgttcagtctgaagacctaacattgtaaacaaatacctctcaggtatacaaatttgtgtctaaaaattattatggctgaaacatacttatcatttgttttctgtagtagaaaatggcataatatgagaaggcctactttgtaatagttgtttgctttacttaatatttttcaaatcagccatctgtgtgaagactcaatatcaagttaggcctttaaaagggggaaaataattcaaaaccactggcagctgtggttttccggccttttctattggttgaactctgtaataaatgcaggaccctacatatacaaaaggtactgttttccaaattcacgtatgtattagcatttacctttaaagttctcatccgtcagaaaaacggtgaacacagcattcagtatatttattttggtttagttacacagtgtcaaaaagttctgatgtatatggataagtagatgcactttttgctgttttgtttgtttaaacagcttgctttaattatctcaagctacttggcaggaacacctttattccaggtttcgcataatcagttattctggcaagagtagattaacacgttagtgatctccaatagacagattatatgttaatattatttgaggccattatttttaagtacaatttagacggagtttcaaatagattttaaaaatgagatttgtataaaagagtgtgcagtccctatggtgttaaaatcactgatatggaggagaagaggggttggaattgtgacactgtggcagcagatgaccttggacaagtcagtttttcagactttcctcccttaaaatagggatactaaatctcacagggtggttgtgtataatgtcacccacacgccatctcctctataactgcatttgtatgccaggaaattgtctgtgaaggcttcagtttagaatagcttcatattattttggggcactgctgggtgattttggttaaggctggccttgggagttctctgagttttctctgaaaccaaactcaatttggttgtaggttccctgtttgctgtttgttgcttttagtaataggagtcagtcagtttacctgggagttaagtttggactggagataatttgccattctttttttttttttttttttttttttttgagatagggtctcactctgtcgcccaggctggagtgcagtgacatgatcttggctcactgcaacctctgcctccctggttcaagcgattcccctgcctcagcctcctgagtagtttgggttacaggcacaagccaccacgcccagctaatttttgcatttttagtagagatggggtttcaccatgttggccaggctggtctcgaacccctgacctcaggtgatctgcccgccttggcctcccacagtgcttggattacaggcatgagccaccatgcccagccgataatttgccattctgtatttatttgcgtgttagagaccagttaaagttaagacactttctaaatagaagtcttgtatatggggcttttgagaaagtgttttcccgtgatgctggggggaaacacacatattcaaattacttgtataaaacagtttattctgtgtttaggaacttgtaggggtgaaatgctgacctgtgttactctttctttccatgatcagcgtccagaggaccagaggttaatttattctgggaagctgttgttggatcaccaatgtctcagggacttgcttccaaaggtacatcacttacacattaacttctgaatgtttttaagcactcaccaggttaggttcaggtccttaagtaccttcgtattacttttagcaggaaaaacggcatgttttgcatctggtgtgcaatgtgaagagtccttcaaaaatgccagaaatcaacgccaaggtgtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagttaatagtagcagattgttccgttagtgctgtagtagaaaggtggagttacatattgcactatcttatgggatatgatttgatctatggttactgtgtatctagattactgaactaacactaatcgggtttttattgaatttagcacatagcaagtttcttcaaaggagtcactaatttttataaagagtacaaaagtgaatatatttcctttggaaattttcattgtgattagttggataggaaaagatcagagtttttatcaagtgatctttaaagaattttttttttttaaaaatggtctcgctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggtgagtgttataataaagatcttggcttatgcaacatgaatgttcctcgtttgcatcaatttaagaataaggtatgtttacacgtatataatcagaacttttaaacatacagaattttgctttataaatagcttcgctttaaagatctcttatatatttaacttttcttaatacacagccttttagtacacacaaatttaaaaagtaggtaatgcatatattgaaaaaaaaaagaaaatgtaggcgttttatccttccattgtgctgaccgcttggttgccgtcatgataggaaattagtgctgctgcaggagaaaacagctgtcgtaagcattgtgcagctgctttgctgagtggctttgtgctttattgtaacaatgggtgacaacaagggagagactgtttaagaagtgtccttccaaagacttgggggtactaggaaaattggccaatttcttataactattaaagcttttctttagagcaaaagtcagaactaaatgctctgttatttggatttttatagctcttggaatacattgtttttggggaaaaattcattaactgcaagttgcaattctgtaactctccaattctccgtccccctttttctagtactttttatacacaatattttataaagccaggtgttttaggaatgagtttttcttccttttcccccttaatggaactttcaaatatacacaacagtggggactggataattaatccccacaccatcacccaggcctaataaataacaatcagagttttaccatagctcatctattaccctttcccttttttttaaaaaaagagtatttaaaagtaattcccaggcatcatgttatttcatccctatattcttcagtatataactatgaaaaccttttagttatcttgtatatctagaatgccattatcagatctaacagaaatcttaaaagcactttatcattttatttccatgcactgtaattttcttaaatgatcaaaaacagcatcataccaaagcttacttgtattggaatactattttagaaatactctgtgtatggaatttagttaaaagattgtcagcatataaattggataattattggatagaaaattattggttagaaaaacttaaaactacttcccttattctgattcaactattcttaacttgagaattgaggctcatatttgactctctgaatctcaccatatttaaacttgatttcctttaacaaatatttattgaacagccagtacatacaactttgcttaaggatatgagttgacctgcaggaatgaccacataaccaatttctgatctttgggcaattctattatggtttcaattttgtgatgtgctactgaagaaattgactgtgtaagaagcacaaagccaaagatgactcgcatacacctgccctgtgaagttgagggctgtgtggcctgattaaagaagcatgcatttggccgggcgcggtggctcacacctgtaatcccagcactttgggaggccaaggtgggcggatcacgaggtcaggagattgagaccatcctggctaacacggtgaaaccccgtctgtactaaaagtacaaaaaattagccaggtgtggtggcgtgtgcccgtagtcccagctactggggaggctgaggcaggagaatggtgtgaatccgggaggtggagcttgcagtgagccgagattgcgccattgcactccaggctgggcaacagagcgagactccatctcaaaaaaaaaaaaaaagaagcatgcatttgacatcagaccagctctgaaatccagccctgctacttactagctcagtgaccttgtgcaaagcccctgtcttccctgagctgtacttgggttccccttgtaaaatctccttcatgagattgctgtggacccagcagcctgtacaggacccccggtggtcagtaagcatgcacaggtgataccacatgcacacttcactatagattcagatggaggatggaggaagaagtggatattgggaggatgggagagatttccttcaggaaagactgggagaaatgtggcttttgagctgctctctaaaagatgaacagtgggttgagacctgcagtgagactcaacaagtcaaaactgaggtgggatctacttaacccaaaaaggttgtttatatatctgtgcactcagcaagcaggtggcaagggctgttgttttcctgtgggatgggactgtggtagaagtgctgtgtcatttagtaccttctgtgcttgtggtacatgggtgcgtcatacagtcatttaccatgtaactgccgtaaattccattcttctgtctcttcgatttgaattcttgattttaatttaaacttagttttcatttgttcatactcaacccactcaaaatgagtgttttttcaaatctatgtataggcctgaagctgcccagcaggcattccaaggcctgggtcctggtttctccggttacacaccctatgggtggcttcagctttcctggttccagcagatatatgcacgacagtactacatgcaatagtgagtccttcccgccatgctgggtgtggccagggctcccgggaattgaagggaattttatccatgttacctgtaaagttcagaatggagggatgagtgtattttcatcagtctgcagagccctgctctgtttggtctgtgggtagagtgtaaatgacagctgctacctgatttgtgtattgacacaagggtgcttttgtctgatacatagtttagtgactttatttagaacatgttactttcttttcaatttgtgctatcttcaaagttttgtgaggattttaatttgctactgtgccataatcttacagtgggcttgatgtttaatttcaggtgaaattcaccttgtggcttttcttagaaaaggcatttatagatatagttagtaaggaagttcttcactaaattgaagaaaaatcaaaggcatatctacctacttgaaattcttaacagtaaaagactgctgtgtaaataagccacagacttcacggtgctttggtctcaacagtatctgcctctgtcgtttttattttagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgtaagcagatggtttctctaatataaattacactacactgtgttcacactaagcagattttgctctttttgtttcttgttttttttgagatggagtctcgctctgtcattcaggctggagtacaatggcacaatcactgcaatctccgcttcccaggttcaagcgattctcctgcctcagcctcctgggtagttgggattacaggcgcccaccaccatgcctggctaatttttatatttctagtagagacggggtttggtcatgttggccaggtggtctcgaactcctgacctcaagtgatctgcccaccttggcctcccaaagtgctggtattacaggcgtgagccaccactgcgcctggccagattttgctcttttttgagcagtctcagttactgtagaaggagatgtgtttaaatagtatatcactctgtggctgggcgcagtggctcacacctgtaatcccagcagtttgggaggccgaggcaggaggatcacatgaggccaggagtttgagaccatcctggccaatatggtgaaaccccgtctctactaaaaatacaaaaaattagccgggtgtggtggcacgggcctgtaatttacttgggtggctaaggcaggagaattgcttgaactggggaggcagaggttgcagtgagccaagatcgcaccactgcactccagcctgggtgacagagcaagaccctgtcttagaataaatacataataaatagtatgtattctggcactttcgatacaaggaattcatggcttggttgtatggtcccaagaacatatcaatcctgtgttaatataagaatattatcttgtcctctagataagctaccttaccttccaggctcacaaaccacaagtatgtagccatactgaggcatggaacagaaaactgtatttgttttgaatgagaacacatttgcctttatcagaccacagctgccttccagggtaaagtcaggcactgactgttagcatggccctgaaaggcaagggaaccttcacatacctgacatttggttttagctgtggcccgaagcagtagttctcaactgggggtggttttgtaccctctctccccaggggacatttggcaatgtgtagatatttttggttgtcacatctaggggaagtggtcctgctggcgtctagttagtagaagcaagagtgctgctgaattttctacaatgcacaggacaactcccacagtaaatatttggctcaatatgtcactagtgccaaagctgagaaagcctggcctagagtgatgggtcttcgtggttgaaactaaaagaagaaattttcctgtatagtaaaaatggatttttattttagcttttaaaaataaaaaaggaataattagaatataatgaacactcaaatatccacaattagtcattgttaatattttattatatttaagacttgggatttaattggtttcttcaaataaaacgtttagttaatattttctgtagtctctagaatcatatatttaaaagaccaaatgtaggttgtcattatgttatatataattatagctttgtaggtatatgcattctccccgctctgttcaggttttcaagggtaaggtttagttcgtcataagcatttattgagtgcatactatgtgccaggtgctgtttatatggctgggtgtgcaatgatgaataaaacacagtccctgccttcaaggaccttacagactggtgagaatgtctgggagacagtgtgatcaaatgcctctgtagatgggtcttgcagtgagcttatcagggtgctgctgtgattagaggtggggagccttggattcttgagtaagtctcactgtgacatcagctaagatggacttttatgtgcttcctttgaaggcatcacgttgggtggtttccatttagaccgaggccggttcagaacttcccaaatgatggtcctcctcctgacgttgtaaatcaggaccccaacaataacttacaggtatggagcctcccacgaagcccaggcgagcttgacgtgatatgccaggctctccaatcctcaacctttagattgccagcttgcggtttaccattttattgggctaaatatttcatgatttgttcacatttcttcttagagcagcagctatttttaaaacgtcgaatgtgccatcacattctatcacatatttttgacgtggcaatttgcattttggcttaagtaaataacatttttttaaacccactattttgagcgttcagtggtctgtaacagtgtgttataccataagaactggtatgaagtggttaactactagtttaataatagttgaagcctgggcgtggtggctcacgcctgtaatcccagcgctttgggaggctgaggcaggtagatcacctgaggtcaggagtttaagaccagcctggccaacatggtgacaccccgtctctactaaaattacaaaaattagttgggcgtgcctgtattctcagctgctagggaggctgaggcggaaggatggcttgaccttgggaggtggaggttgcagtaagccaagatcacaccactgcactccagcctgggtgacagagcgagactctgtctcaaaaataataataatagttgcagatctagttgtttcatttgatatttgctgccaggagcagtcaaaactatgacaacatcaacacagttgtgctgtggaagcctgagaaacagccctatccagcctagggcatcattccctggggtcctggctgcctgctgctgtgcctatggggcagggggcagggatttaccctgccctttcctaacattatttggtgttcatcatagccctaattgttttctcattgtttcattacctcattgtttcattacctgtaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcaga

SEQ ID NO: 372 - DNA, 136002 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtagcggccggggcgtccctcttctcccgtgcccgccctcgccccggggggattaccctgcttggcccctggctgttgggctccgcgcggccccgcccccagcctaccctcacagggaggtggcaccgcgacctcggactccctgcattcggaccaggcaggcacttcccgctccccacttgtctcctggtcctcgtttggccccctagaagttctcacccttccacctcgcgggccgcgcgccgcgtggggaagagtcgcccagctgcgggagacgggccctacggacctttttttagctcggggtttagaaatcacagatttcaggattcctgcctttggtgcctctcgggttcacgcgtcaccggccctccccgaggaaatagaaagcaggtggcagctccagggtgtgcgcgagtcccatggtatgacagcttctggacccctagcctgtggaccattcgtgctgctcccctagtctcgtctaccacatggtggatttcgtttctggttgtgttggtttcagcttgtaccgttactcaggtcagcagtggctcattagaaacaacatagaaacactccccttcagaaggaatgcttgaagatgccgctggtggcgttgcctgcatcttttcagctgttactgccctcgtttcccagtgcactttgctttgtttctttacctagttcttgtgacccagcctcgcatggaggatatgcgatttcctggattcttgtatgcctgaactaattcctcagaggcgagactgcttttcttatataactttatgattgcctgcgttttgtaaatgctgctgatgcctaacgagtgcgtgtgtgtgttccgctacagaatattggtaaacttactgacttcgaacacttgaggacaatcttgaagtgtctagcaaacatttagaaagtgaattgtgtgccccatgcaatttagcccactgatctaaaacgttttaactagtgtggtgggaaattactggtcctttggattgtgtgtaatgaatcatgataggaacacattccaacgtttaaggtgaggtttagatttagatttgccgtgtaatgtaattgcaaattctatctcaagtaagttaagtataactaaaaatccgcctaggtattcatgagtggttttcagcatatctaagaaaagaccgtgttcctattgggtaacgttttctatatgacatacataaagaacagtttccttttcattgccatactatctgagactttaaatatatgtgtatgtgtttcagaaacccaagaaaacactgtaagaccatatgtgagtgctggttgcttccacccttcttttgtttcttgatagtggttttccctgaggtctctatgaagacgtggaattaagtcactcctgctgcattttggggagcctttctcctgttggctcttctgcaatattgtttttggccacagctatttatactctatgacattgacttctccttcccattttggtgtcctaccactcagctgaaaaagtagcccatctaaaaagtgaaagctggtagaaatgttttatgtatatacttaacattgcaatgggaaagtagagtctgattttttttttttttttaacaaattccttctttttgcactttggatacatatgtattaatgggggaaggcaggggttactggaaacttgcctcagagaagcagggaagagctgaagaatcttttggatctctgccaagtcactgctgagctaagtaattaggcttaaagtttaaaaagcaagatttctctattacatgactttttaagtgatccttttcattgaattttccaatactttgctatacataacatttacaatgttatgttcaggcagccacaagattttatgccagaagaaataaggttggtgtctgcagtgtaacaataagaggccaggggaggaaagttggatttaatctgaagaaaaggcaccacatataaataaagtaaaagaattgggtgctgtggtgagctgccgagttccactctgatagctgattgtgcatgacccatgcttcccttcctggccataatttgtatgcaggtagaatccaaactatcaatttagatcgtgattaattataatatttgtatatactgtacttaaggacttgaaagatcacattagtgtatgaaatccatatatattgcagatttgtacattcagaaacataattaaaagcttagtatatacagatgctcctcagcttatgaaggggttatgtgctgataaactcattgtaagtcgaaaatactgtaagtcaaaaatgcatttaatgtacctaccaaacattgtagcttagcctaacctaccttaaacgtgctcacaatacttacattagccaaatttgggcaaaatcatctaacagcatcttttacaataaagtatcaaaatacctcatgtaattcatgaatacttcactgaaagtgaaaaacagaatggttatatgggcactcagtacagttgctaccaaatgcatgtcacttttgcagcattgtaaagtcaagaaattataagttgaaccatcgaaaggtggggaccatctgtatactttgtcctgacataccaaattcttgctgcttattcttggttacaatatttgaatgagagcataagtgtgatttcagttttaaagtgacctactaccaggcaaagggctaagggctaactggattaacagcttttagaaaattagagtggtacataccttttgagaacctttaatattaaacacacccagattagatatatgggtcattgttttccacagtgatcataaagaagtacttatgacttaaaaatctgaattgtccaaccatcattataactttttttttttttttttttgagatggagttttgctcttgttgcccaggctggagtgcaatggcgctatcttggctcaccacaacctccgcctcccgggttcaagtgattctcctgcctcagcatcccgagtagctgggattacaggcatgcactaccacacccggctaatttgtgtgtgtgtgtgtgtgtgtgtgtgtgtgtgtgtgtgtgtgtgtatttttagtagagacagggttttaccatactggacaggctggtctcaaactccaaaccttgtgatccgcccaccttggcctctcaaagtgctgggattacaggcgtgagccgctgtgcccggccattataactttttaagtacatcaaggagtctttcccaggagagatgaaaattcatttgattttttatatttcaaggtttagcagacaataaagataggcacccaccagttacataccgcagacttgtcaacatgcgtatgtattggaaatggtacatcctttggtgggttgaaaagggggttaagtaagagcaaggagcatacattcctgcaggcaacctcttcacagtcagagctggggctgctgcaggcagcagctggtgtccattacttggcatgatggttaaaggaattatttctttttcttttagagatgggggtctttctttattgcccaggctgaagtgcatggttactcccatgcattgcagccttaattgatcttcctacctcagcctcctgagtaggtgggactacaggcttgtgccaccatgcccagcaagttgttgcatttcacaatccctgcctcagctaggaagcataccttccccaatttttaggttatgtttactgagctgccactgaattcccaaatatggtccagggaatcctggagctgggatgtggagagaacattccaatcactaagttccttttccactggtgtcaggggaaggctaagagaaaccccgtcttcttctcctctccgctctgtgctgttttcctagctttgggctttgacatacctctgatgccctagtgtctgtcgctggtacctgaaacctagtaagcccatctcactttatttaagcaggggtccttaacttcgaccccatggacttaagaagtgagctattataatctagttactaaaaggagcactagcgtaatcaggcctgtggctcttttggttgactttttgaaaaataggtttcaagataaattttgtgttgtttcattttgatgttgtttttgcttaatccctagtttggcaatatctactttctgtattctattttctattttttaatcagtgtctggtaatttacttgcatcaaaggttaaacttgtgaatttgcctaagagcctaaccactctatggcacttcattttgttgaaaaaaatatatgttccatgctctaggtagcagctaacagagaaactcttgaaatgttaccagtttgttagttgtagccttactgaatcaagaagttgtattgctagtactgagttctctgcctctggatattctttttcttcataattggagggctaaaaatttaagtaaattaagagtatcatctgtatcagctgtcttatacattttaatattcgtattctttgtcactatttccctcttctccaatcttacttagaactgtggactttcagatttggaaaacattcttaaagattatgtagtacaactcctaagagagaaagtcactcaaagtcgtgtaactaatgtgtggcatttcgtggcaatagtaagtaaaaatggattagtctgcagtagcatgcaagtgagcaccttgtactcagtagattttttttcctctcataacacttacaaatgaaggactacaaagaaacataaaagcaaaaatgaaaataatgaagtaaaggtatcttcttttccagtttgctttatctccatagaatgttttgtggtaacttaagattcagggtaagtgggtgtggaagggtcctaaataagtgtgagttcattcggcatttacttaatcgttttgtcccccggtcaggccggtatcttcggagtacagatcctcttttttttttttttttttttttttttgagacggagtctcactcttatcacccaggctggagtgcagtggtgtgattctggctcactgcaacctctgtctcctgggtttaagtgattctcctgtcttagcctcccaaatagctgggactacaggtgtgcaccaccacacctggctaatttttgaatttttagtagagacagggtttcttcatgtcggccaggctggtcttaaactccaggcctcaagcgatcctcctgccttggcctcccaaagtgctgggattacaggtgtgagccattgtgcccagccattaatagcttgtaagtgaaggcctggtttaattttggtctgatgttaagtaatttggttaatctgggagagagcatccatatggcactgtgaagctgacagctttatttctgtacttttcaaaagtaactcatctttttttgtcataaaggactgtttctatgtttatacacttccaggatttagttacacctggagaggtcatggtggttattcactaatttgctaggcatctgccaaacctttgcagtttgtccaagacctttgcttcaaaatgattctcattcagtccattttttcagatattgtccactattatttttcttcttataaattactgagattctgactttgtttatgctgtagggcagtgagaggagcttggaaatgtacagaaataaattagaactttaaataattttcccactttttcaattttttaaatttttatttatttatttattttgagacagagtttcgctcttgttgcccaggctggagtacagtggcgtgatctcggctcacctcaacctccacctcctggattcaagcggttttcctgcctcagcctcctgagtagctgggattataggcatgtaccaccacgcccggctaattttgtatttttagtagagacagggtttctcctggtcaggctggtctcaaactcctgacctcaggtgatctgcctgcctcggcctcccaaagtgctgggattacaggcgtgaacccaccacgcccggccataatgttttttattttttaaagacaggtcactctgtcacccaggctagagtgcagtggcaccgtcatagctcaccgtgaccttgaactcctaggctcaagtgatcttcccaccacaacctccctagtacctggaactacaagtgcataccaccacacctggttagtttttttttattttttgtagagatagggttgtaccatgttgctcaggctggaattcagtggcatgattatggctcattgtaaacttgaactcttgggctcaagtgatcctcccgcctcagcctcccatgtagctgggactacaggcaagtgccaccacacccagctaatttttgtattttttgtagagacggggttttgccatgtcacccaggctgatcttgatctcctgagctgaagcaatcacctgccttggcctcccaaagtgctgggattacaggcatgagccgccatgcctggccagctcatctccttcttaactttgttgtttttgtttttgtttctttgcccttgctctttttcatactcaccctttagataagtagttctcaaactttaccttgtacaaaaataattggggaattgggagttgcttgcttaaaatgcagatttccaagacacccagagtatctgattcagtaggttggtggtaaagcgaaggattctacatttttatcaaactccttgggagagtataatgcaggtagaccacacatagtctaagaaattcagttttagatattgccatccttccagcttctgttccagtttttttaaactctgtacatacacctgagcatcagttaccatatgtatgctgagagtatctgcattccttttgtaacttagtttttttctccagagttgtagatttaagacctttttttttttttgagatggagtcttgctctgtcgccaggctgtagtgcagtggcgcaatctcggctcactacaacctccgcctcccaggttcaagcaatttttctgcctcagcctcccgagtagctgggactagttcacgtcagaaatctagttgtctttaattccttagtctcccttagccatcaccaagatctttgttttactaattatattttacttcttcccatagctactatcattactctaattcaggccaccttattattgccgcagcttcctgttcttctcctttgttttatttaattaaaaattttgaaaccatcctgggcaacatggtaaaaccccatctctactaaaataccaaaaaattagccgggcatggtggtgcgcacctgtaatcaaagctactcgggaggctgaggtgggagaatcgcttgagcccgggaggtggaggttgtagtgacccaagatagtgccactgtactccagcttgcgtgacagagtgagactctgcctcaaaaaaaaaaaaaaaattgaattcagaaataatgcatggcattgtaaaaataaacatccaccatgccagcatgggaatatttaataaagtgaaatccctccacctctatgcactctcactccccagggaaagctacctttaatagtttggtgcatatcccaggatatggtccaaactctttctattgacaaggttttggtggcagggagggagacagattctcgaacatatcttatgtgacctggcccttcctctctagccttatctcgggtcatccttgagtaccccaccctaaccctagagtaacacacacagccatactgacttagcttttgtgagcatccccaaatatgccgtgttctcacttcttctgggcctttgcatatgttgttcttcccccaacactcgagtctagctgagtcatactcgtcataatataaacatcattttctcagtgaagcttctggtatgcccaaatttgaataagctgttctatgtgcttccatagcatcctgaattcctttatgaaaggatctaccatactgtgttgggcctacctacttaggtaaatgccacactagacatttctcaatgaatccttatagtattcagtaatattttagtcatctggggactaagcctaaaagaagcctcagacttccatgtctttaaagctttgagtcacgcattattgaatcagcccgtaggccctcagaaaaggtgcacagtagatgagaagagccataatttcagagatcattcctgcttacctactgtagtcatgttgtgttatgcaagggaaatcatcctcgctgtctttgtaccagtttagatatctaaaaggtcaactttaatgcgcaggcatcaaaaagcaaaaagtatggggcaacaagagacaatgaaaaagataagcagaagaaaataatcagaaaaaacagaggcgtggtagatgagaaatggcagctgcactgttgaggagggattagaaccagctgtggggttcagcagttgttgcagtttagaagtcactctggtgaaagtaaacagaaggcgctctgatagtgaagaataaataagagggctcacgagctgctcacgtcaaaaattagaacaactttgcattccaaaatgttaaggagcagggtgtaagctaaaacctgcgtctcagctgtactccttgatagcagaagtgaaaacaaggggaatgtctgtgtgtgtgtgtgtgtgtgtgtgtgtgtgtgtctcttttacagacagacaccctaaaagagttatctgtgctcgtggagtctcctctctcttccttttttaagccccctccaattcatccttcatccctataactcttgtcaagatacccagagcctatgctcagttctcactaatcttaagttcttagcagcccagcatttgtcttcatatcttactcagctattttcttacatgcttacctaaaagagtggctgacacatagtatacactgaggaaacactgagtaagggagagagaatgtgtgcaactaagcaactttttacacctgtaatagctcttacatgcattagcatacagaagagccaacacgtattcctggtttttcttctcagtccctggccctgacttctcattttcttctgctgaattcaccttttcttgatgagtcttaggtgttggtgtgccccttttcttccctctgtacatatgttcaccagatgatcttttgcagtctcggggcataaagtaccatttatattctaaagactctcaaatcttacgtgcagtttcaacttcttcctgaacttcagactcatatatccaactgcctactgaacatcaccatttagttgtcatcacaaatacatcatgtcctaaactaaactcttgattttctaccccaccacacctgatcttcccccattcacaaaattgcccaggtccaaaattttggtatcttcttgactctttctcatatctcaaacccaacgtagtaataacttgtcagccctacttccagaatgtttcctgaatccagccatgtctttccacctccatttctgtaattccagtcaatactgtcttcatctctttgcagaacctatgcagtggcttcctacctggtctccttgcttctacttttgtcccctagatctgttatctccagagcagccaaagtaatctcttaaaaagcacagctggtcatgtcactccctttgggataggagggaaacaaagaacatcagaaaatcttcagtagtttcccatcatacttagattaaaatctggagttttccttatggcctacaaggtcctgtaagatctagaacctggcacctgtcttctcctccagcctcagacaccactttctttcttgtgtggtgtggtgtgctctgcctcagccataccagccctcgggatgttcttcaaaccaccaagcttgattctgcctttggacctttgtccttgcttcttcctctgcagatggcatcacggctcagcctctctctcctttcaggtctcttttcacatgtcatctcttgttctaactagttttatctaaaacagcgtctatttgagccttgactattgtgtcttgatccagcttttcacttaccttccttttagagttgcaaatgttctactttattaattatgttatttgtatatgccctggtgacatgaattagaaaatgtggactggtagcactattataggaagttactcatttgtggttcatgttgaaaatggttactaacttgcttgtcaattaggagaatggtgattgtttacagacatgaatattctcataaaattgactgcaacactatagatgttcaaatctagataacaactgtgcaatacgtgtcccttacctagattattttatgtaaatttacagctgtaaggatacatttgtacatttcaggaactgtgaaaatgagaaggtaaaatccagttgagggtaaaactttagaaaacagggatataaggccatggaaattcaggtgatagtcaaggtttagcatgatagtcaaggtttagcattttcattaatttgaagtttgttttttcctttgatgacttgatatcctgtaagattaaaatttgtttctgatttctttttttttttttttgaaacagagtcttgctctgtcacccaggctggagtacagtggtgcaatcttatttcactgcaacctctgcctcccaggttcaagtgattcttctgcctcagcctcccgagtagctgggactacaggcacacgccaccacacctggctaattgttgtatttttagtagagacagggtttcactatgttggccaggctggtctcgaactcctgacctcaggagttctcccgccttggcctcccaaagtgctgggattataggcttgagccactgcacccggcctctgatttttcaaaaatactgtacaagtactctagcttcaaaaagtcataattaacaaatatatttccaaatcttggcagttcattataatagttttctcaatctcatacaatgaaatgtttctagtaaaagatctgtttatattacacatttgttttgacagttatagccaggagcccatgcgtatctctctcaagagtggaagctgggctgctatttttgcgaacctgtacttctctaaacctcaaagaagatgtaagcccatgatggttagacttgaatcctgaagagataattccatgagaagtggagcaacagactttctgcctgcgtcattccatccctgtgaaactcatcttgcttgctaccatagtagcctggaagggatcgcaaacagaagggtctcttagacaatcatttgattgtttgagctagatttgtgataagggtaaaaatctgagggaagaaaggtaaggagcaagaaaatacaaaagatgtttcatttttgagatgttctaccttggtccttatctgtgagaggaattttttttctctataagtgaatacacgagggaaaaatacaagattcttcctcagacctaagcttatatttgtcattacagtttgtttaaggaaaaaaaaaaaaagataaaacatgttacgtagtgttctaaagtttcagtgttaacaaacaagatgacctgtggatagcacattaaaaaaaaagaacactttataaatttaaataatacatgttcactgtagaaaaagttagaaaacacaaacaagaagagaataatcacgtaaagtcatatcaactagaaaccatattcttaaaatatgatatataaactgtcagatagttaaagagagggggcaggtttgtttgtttgtttgtttgtttgtttgttttaagatggagtctctgttgtccagtctgcagtgcagtggcacgatcatggctcgttgcagcctcaaactcctcaagtggttctcccacctcagtctctcaagtagctaaaacaggcatgtgccaccacacccagctacttctaaaaactgtttttgtagagatggggttttgctatgttgttcggggaggggaggtgggggggggggtcttgaacttatctcaggtgatctttctttgtcctcccaaagtgctaagattacaggtgtgaaccatcacacacaggtgagattttttataagtacattgtgaatggaaaaaacatctcagtttctcccactgttctcttacaacatgtttctgacaccaccaagcaagcagtcagttctgcagctgccacaggctaggtggcttccaattcagttctgacattgtctacctggcagtggcatcagatcctacaggtcaagagctcagtgccacaagactcctcccacccaattcagtcccagcctcttctaaccaaccagcttcaagttggggctcccatagctgcctctttgggttcaattaatttgccagagtggctcacagaactcaaggaaacttacttatgtttactggtttattatattagaaaagacacagatgaagagatgcacagggtgacgtatggggcaaagggtgtagaacttccatgccctctccaggaacttccacatgtttggctctccggaatctcctgaacccagtccttttggggttttatggaggctttattacatgggcatgattggcctttggtggtcaacttaaccttcagcccctcttctctcaccagaggttaaggggtggggctgaaagtcctaatcatgccttagtctttccagggacctgccctgatcctgaaactacctaggagctgccagccatcagtcaactcactactgtacaaaaagacagcactttggagattctaaggattttaggagttgtatgccaagaaaaggtgggtggggtggaagaccaaatatatattttacaatatcacatacacaaaagaaatacatatggccaaggaagagactgaaatgtattcatggcctgacgcagcagctcacctgtagtcccagttactccggaggctgaggtgggaggattgcttgagcacaggaattcaaggttacggtgaactatgatcacaccagtccactctagccttggtgacagagcaagaccctatctctttaaacaaaaaagaaagaaaaaatgtatatattcacccttttttctgcattcctaaggatgtgtaggaactcagtcactgttgttaggaatttaagttgattcaactgttctggagaaaagctagcaaaaactgtaaatttacaaatgcaaaaaaatagtatagttcctttaacctaacggttttctttctgttacaggaaagaaataatctgatagctgtctaaaaaggttcatgggtttttttttttgagaaggagccactcttgtcgcccaggctggagtgcagtggcatgatctcctttcactgcaacttccacttcctggcttcaagctattctcctgcctcagcctcccgagtagctgggattacaggtacctaccaccacatccagctaacttatttttattttttatttatttatttatttatttatttatttatttttgagacagagtttcactcttactgaccaggctggagtgcctggctcactgcaacctccacctcccggattcaagcgattctcctgcctcagcctcccaagtagctgggattataagcatgtgccactacgcctggctaatttttgtaattttaatagagatggggtttcaccatgttagacaggctagtcttgaactcctgaccttaggtgatccacccgcctcagcctgccaaagtgctgggattacaggtgtgagccactgcgcccagccaaaagttttagtataggatgttcattgtaatattgttaaaaagggagaataaccaaaaacctgaattttagttaggaacctgggtaaataatattaaccactaaaaatattgacataggtctgtatttactgggaagtctgacaaaatgtacagaggaatagagagaggaaggaaataatatagtagatatattattatcgtatttttgtgaaaatatttacctacaaagctctgtgtttgtgtatgtatgtagaagttatcctgacatgatatatatctaacagcagatatctctgaaagtgaaatttcaagtaatttttattttctccttcatattgtctatatggtactgtgtttgtttttacagtaaaatatatttagtttataattctaaaaaagattttcttagtattaagtagcttaaggataaagagggctgattttgccatgaacaacataactgctcagaagtagccagccactgctaattagagccttggtttaatttgacaaattgacagtttaaaagaagctttttttttttttttttgagacagagtctcgatctgtcacccaggctggagtgcagtggcgcaatctctgctcactgcaagctccacctcccaggttcacgccattctcctgcctcagcctccccagtagctggaactacaggctcccaccaccacgcccagctaattttttgtatttttagtagagatgaggtttcaccgtgttagccaggatggtctcgatctcctgacctcatgatccacccgcctcagcttcccaaagtgctgggattacaggcgtgaaccaccacacgcggccctaaaagaagcttttaacaacagctttggaaaatattcctgcccagagtgagtacgaatttatatgggcaaattgaaaggatgataatttcatatatttgaatatcagactattttgggggtataggtctggctagtaaaaatgtgatacttttacggtaacgttaagtcttttatagaagtaggatttgaaaattaaaaggagttttagaaatcatttgcttgcgtcccttcagtttatagatgaagaaacagaagcccaggcagggaagatgatctgtttaaagccatacagttagtcatagactggtcagatgcatattttgtttctgatctctggtaccttagccacttcacgttttttttccaaatagtcatcagtgaatgataatgctttagcagatggagttggagtatctaataaatgtggcagagtatctaacagatactgtcctcaaacaatcaacagtatattaaatgcctagcatatacctgaaagcaagttacatactgaaggtagaaaaagaaatacataaaaaaatttttgtgggaaagcactccctattcaataaatggtgctgggatgactggctagccatatgcagaagtatgaaactatatccctaccttttaccatatacagaaattaactcaagatggattaaagacttaaatgtaagaaataaaactacaaaaatcctagcagaaaacccaggaaatatcattctggacataggcctgggcaaagaatttatgactaagaccccaaaagcaattgcaacaaaccagaaatggacaagtgggacctaattaaactaaaaagcttctgcacagcaaaagaaactatcaacagagtaaacctatagaatgggagaaactattctcaaactatgcatccaacaaagatctgatatccagaatctataaggaacttaattcaacaagcaaaaaacaactccattaaaaaatgggcaaacgacacaaacaggcacttctcaaaagaagacatacatgcagccaacaaatatgaaaaaatgctcaacatcactaatcactagagaagtgcaaatcaaaaccacaataagatactacctcgcaccagtcagaatgactattattaaaaagaccaaaaaaaaaaaaaaaaggatgttggcagggctatagagaaaatggaagtcttatacacagttgatggaaatgtaaattagttcagcccctgtggagatttctcaaagaacttagaacagaactaccatttgatccagcagttcctgtactgattatatacccaaagaaaaataagagccacagtagtaataagatgccctaggcagagggacataggtgaaaattaggtggaagtttagaaataacacatcaatactttctgtattataaagttttcattggaatgtttgggcaaattgtaagggctgcagatacagtttgattcaggactcaaatagtataacaaggatcagtttttctgtttttgtttctttgcttcgtcatccccattctcaggccccatgtagatacaagatggctagttaccaatagctcaaagttctggattagagtctctttagtaccagctgaccttactggagtagtatctcagaaataatcaccatgaccaagggaaagaaattctctgacaacggcttcccatatggggaaggaagcaagtgaggtgcttttgccacaggggggacttatggatattggatagcaaacactacaaatactcactaaacagaaccatttcaggttttacatagaggcaaaatcttggcgactttgaagattttgatttatgttttccttcatattgtcttaatatttaaataactataattctgaattaaaatattaaaattattttgtccctagtttctaacttaaggggaaaaattttaaatgagaatggcataatttaagattatattcatcagtttccaagtgctatttggagaagagtgagtttcccatattgctttcgtgtacctagatgaataccatttaaaaaaaaaaacagtgaaagtgttcagtatatatgaagaataagttgcacatgagagcttgaattaatgttacaacagaaatgttcagttttctgccataaagaataattaaaaagtgattgactcaaacttgtttttgtaggacatcaaaaatgtttatactcttagattggttaagtttaaaatgttcacccttaatctgatttggcagtgaaataattaccctcatatagtgagtgatatttccatgttaccatgtgaacttactgaatttgttgagatagggttccagattggaggtgtagatattaacaatatcttggttaattaaagcaacaaataacatgaacataatttgataggagtaaaatatttactcatgttatatataattggatacatgtacaggttgagtatccctaatctgaaaatgcagaatccaaaatgctgcagtgaactcaaaaagtatcggattttggagcatttcagatttcggattttcagattaggaatattcaacttgtacttacataatgtattcaaaggaaaatgaaattgaattgccttatatggcttgtcattttctttattataataaactgctacagtaacagtgaaattttgtttacttggaactcttagagaatgaatcattctgaataatagaattccatagagcctaatttccagatacttgatcaggttttccctgtagtttaaatttttctctaaaatacttttcataatttcttcacctccttaaagtaagtgaaaatgattataatttttctttacaattcaggttattatttgcatcatttattgttctgtgcagcaatggaagtttgtagggttgtttatcctttgtgaaaaagccataaagtgctttgagatcttgtgtgttcattatgtcctttttaacctacctctctgtaattcctgtctcctttttgcttctggacttacagcagcctcttttcaatgctaaagactttgaaggcatattaacattcttttacacgttgtatatgacacaggagtacatagactctaaacattgactcaggacatcgactcatagtgggcctggcttatagaagcttaataaacacttattggttgaatggatgttgtaacatgttcatgcattgcttaaaaatgggggtgtgttctgagaaatgtatcagatgatttcagccttgtgcaaacatcatagagtatacttaaacacacctagactgtacagcctactacacacctaggctacacacttgtacagcatgttatggttctgtaggcagttgtaacacaatggtaagtatttgtgtatctaaacatagaaaaggcacagtaaaaatacagtattaggttgggcgtggtggctcatgcctgtaatcccagcactttgggggccgaggcgggcgaatcacgaggtcaggagttcgagaccaggctggccaacatggtgaaactccatctctactaaaaatacaaaaacttagctgggcgtagtggcggacgcctgtaatcccagctactcgggaggctaaggcaggagaatcgcttgaaccagggaggcagaggttgcagtgagtcgagatcacaccactgcactccagcccaggagacagagtaagattccgtctaaaaaaaaaaatatagtattataatctcatgggagcaccatcacatatgcagtctgccattgactgaaatgttatttggcatataactgtatttacaaagttgtcaaacatactctgataatctaaggaggagaagtatttgagaagtgagaaattcacattaacatttcccaaagacaagtcatacatcttaaaatttaagaacttgaaagtacctcagaaaacatgtatgtcaggctgtaagtcttctgcagtcaacttttatctggcaaagatctttgccatttgctgtcacctcaaaaagagaaacacagctgtcagtgaactcccttccttctgctaataattttatctttatgcctcctctgtatctttgctgaactaaaagcttcaaggaaatgataagtacttcctcacaattgaatgttgaccagatccatgctatggaaatattattaaactttgttatctagtaactttttaatctaaagctaagattatgctttaaatagttctttcaatcttcatttatctcattttttctttcttgcaattcttcaaatatcaggtaaacagactggttaggcattttgttttttggttttgttttgttttgttttttgtttttttgagacagagtctcgctctgttgtccaggctgaagtgcgttggcgcaatctcaggtcactgtagcctctacctcccgggttcaagcaattctcctacctcagcctcccgagtagctgggactacagtcctgcgccaccatgccagctaatttttatatttttaatagagatgaggtttcaccatgttgggcaggctggtctcaaactttcaacctcaggtgatccacctgcctcggcctcccaaagtgctgggcttacaggcataagccaccgcgcccagccttggttaggcattttggaatgggactgtcacacttccacagtttcttccctcccccaattttattttttctaaaaatctcatttaaaaatacctgtagagtcatgtactaaatagctatctcttgatgtctggacggagttgtaaattaagcactttctcctgcttccttatgtaaagctcttatactctggtcactggcagtagctttaacattttttcctgtatcccattccattggacagtgggtctctctgtcactttattgatttacttaggttgtttctgattgtccttttgcagctacaaatgttgtaatgagcatccttatgtatatccttgcctacttattgaacaatgtctgtaggatagtttcctagactttcttttgctcaaaggttatgcaattgtaacattttgatatatgttgtcaaatgacactccaaacaatgagaacacatttataagccagctaccagtatatgagtgttcattttttctacagcttcaacataattgtttgatttgttgatccagagaacatgagcaataagtaataaatctcaaggttattttatattatctttgatttatgacttctacaaatagctttcaaaaagaggtacatttaatattttccttttatcacttccaagcctattcagatatgaaatgtgctatcaaaacaagacaattcattttttattattacaggcatgaaacatcatttaaggaagttactttatcaatcattgccaaatacttctttactattatatcacctgtaaagtcagaatatgtactttgaatgcttgttcttccaagttggagttcacaggacaactgttgcacttgtcattccctttgctaacatttacatgtgatcactttgaaatactccttgagttttgctgaggaataacgctgattacaatggcgaatgaacaataatttaaagcatattaatgactttgttaatccaaaccagcattaatgaaatccgagctttatttatttattgcttgcttgcaggtggattcaccaatgaacttgaagcatcctcatgacctagtcatattaatgagacaagaagcaacagttaactacctcaaagaattagaggtgaggcaactgggcatgtgagatgcagctgatgcttgttgcatttcacaggagccattgtgttcaaagaaaagctaaagcatattattttttaagtctgagtcttctgacttttgcgggaatatactacctgcaatgtgtgtgtgtgtgtgtgtgtgttttttctttatcattttatcaaagtgatatttgagtagtagtaagaaaaacagactactctagcctgggtatatgcgtgattcttaaaactcatttatctttgaacagaatttctgtgtttttaagttttttccatcaaatatgaaaatgatataatctctgaagatattcctagaataatctggataaaatatgaaaagaaagaaaggttttaatagcctaaaaatgtaattattgtttattctcaggtagtaaaaactaatgtcttcctattatgttttcttatggttgacgtgaaaaacattaatcaccttgttccttgaaagctcgaatcttattagtgctaataaaatctgactttttttaataaacatcagttttccttttctctaacatatttccataaattgattttgcttaatagcaaacagtatttgttatttgaaaaactaggttttttttttctcatgaaatctctgctttaaagttacagtgtaaattgaatctaaattgtaaataaactgtaagttgtagaaacattaaatcaaattgcaaaatgagaaaaaaactaatgggaataataaaagtaataaaagtagaatcagagtatttgagaattagaaggaatcataagatcatcctcattttagaggcaaggaaacaattagacctaaagacaatgaattgcctgacttcacaaagcaagatatggcagaaccagaaacaaaagctgtatctcttgacttaaaagctggcatacctgttttttgttttgttttgttttgttttttgagtcgaagtctcactcttgtcggccaggctgcagtgcagtggcatgatcttggcttgctgcaacctccacctccccggttcaagccattctcctgcctcagcctcctgagtagctgggattacaggcacctgccatcatgcccagctaatttttgtgcttttagtagagacggcttttgccatgttggccaggctggtctcaaactcctgacctcaggtgatctgcccacctcggcctcccaaagtgctgggattacaggcatgagtcaccgtgcccggccaaaagctggcatacctgttaagccaagttggcatgtattttcttgttatgtaaaagtcccgaatttcatttacatacatttagtatatttatcaacatacatatgtctacaaatagttataaatatgtacttttaaaaaaatctgtgaattaagagagagaagactttagcacatggtaaccagctctgcctaattagtagtatatttagagtgtttctagaacttgaatacctcaacattgtaaaaatagtttctcaccttgttcctactggttttatcacttgtaaatttggaaatgttgatttttatcaatactaggaattagacaataggtatccttatagtgcttcatgcttggaagcatgatctatttttatttaaacccggtgttcagaaagatgcaatggtgcagaaaaaaatttttttttcaggtatatagacacattgtatatgtttattgctatctttttagggaggcagtattatataaagagaaagagatttaaattggaggatatataggaagaaagtgccatttattaagtcagtgaaaatgaaatgaaaaatattgactccaccaatttttggttaaggtagtgtaggagtttatacttatactaaatataaacttctatttttgtttatacttatactatgaagcttctgcttcatatgcatagcagtgccaggtaaaatataaaaatataaaccaaaataaaatgtaggcaggcttgaaagtagtataagcatctccataaaccagaaatgaggagaagcactaaattgggaatgtggccaaagctaccgaccttttgggctccaaggccaggagcagactatagtagtgtctgatatgcagcactgtggagttaagggagctgacagtattccatgcaagatgtaggaacagaacgaggcttactgcttgaagactaggatggagccattctgctcctagaaagagcctggcaaaaataataataataacaacaacaaaagaaaacatatcaaaaccagaaagactaaccctgataaccaaaaaaaggaactgaatcatccaatagttcaataattacatcttcagtttcctgaatatcattttaggatagaatatttgggataggaactcgaaaccaaaattggaaggtctgattctgagcttggtaactggatagaacctggaaacaaccacaaaactatgagacctagatgatggtcatggaatgattggaaagaaggggatgagacagagggcatgaagaaatacttcagggtttctgacctgagtgattgcaaggctgaggttgatattagctgagataaagaagactgaaggaggtacaggattggggaggagtttggctttgaaatgttaacgtttgaaatgcctatcaggcattcaagaatggatgtcacgtgggcagttggtccttctagtgcaaactcaaggggaaagatgcaggctcaagatagaaatttgttagtcattgacagatagacataaagccatgagactagataaaacagtttatctaccaagtagtgacaactatatgaacatcttagataacagaagacagtgaagggtaagggaaaatcaattctactgaaattttatattcttttaaactatcatttaagaatgagggcaaagtaaagataatttctgacatacaaaagcagtactaaccacagaccctcacttcagctgaaagaaacatattaagtatgtatttctgcaagaagaaaagtaaacctagtggaagttcatagaatgtctaatgataagttaaaaacattgatgaaaaagttgctaaatttatttacttattgggctctctaaggtcaaactagataaaattaataatatgtagttgggttggagtatgttcagtaattaaagcatgttagactgttttgtcatgttcaaaagataaaaataactgaataaattaaaatcctatgggaaaatttattggcaaatatattaaaaacttaaggatgttgcttgctactttttaagtagtcttgccaaaaaataatcaaaccacaatataatttgttattcaatgtaatttgtttcctttgtctttctcttacattttatatatttaaaagattattctgagaagagatttataggcttcatcagactgccaaagaagtccatgacacaaaaagattattactctagatcctgctgtcaatattcaggaaatacagaaaatagaggaacatgttcagtgaaccttgagtacctagtcagcaaattcccctagagtggcaaactctacagaacaaacaatccaatttcctttttcttttttctttttattttcttttttttctttttcttttttttgagacagggtcttgctctgtcacctaggctggagtgcagtggcatgaacacggctcacttcagcttcaacttcctgggctcatgctatcttcctgcctcagcctcttgtgtagctgggaccacaggcgtgcacaatgcccagctattttttttattttttgtagagacagcgtctcactttgttgcctaggctggtttcaaactcctgggctcaagcagtcctcccaccttgggctcccaaagggctgggattataggcatgagccaccatgtctggccccagtttctttaacaaataaattacaagggagtgggggagagagagagagagtggtatccagtagattaaaagagatgtaagagacaaatcaaccaattgcagtgtgtatggactatgttgaactctgattcaaaccaactatgtatttttttatttttttattatttttttgagatgaagtcttgctcttgtcccccaggctggggtgcgatggcgcaatctcagctcactgcagcctccgcctcctggggttcaagcgattctcctgcctcagcctcccgagtggctaggattacaggcatgtgccaccacgcctggctaattttttttttttttttgtatttttagtagagacagggtttcaccatgttgaccaggctggccttaaactcctgacctcaggtggatccgcccaccttggcctcccacagtgctggctgggattacaggcgggagccaccgtgcccggccacaaactctatttttaaaagagaagaaacaattgggaatttgaatgcagactgaatatttgatattaaggaattactattttttacatgtgatagtggtgtggtggttttattttttacaaaagaggcttttcttttcaaaacatactgaaatatttactgacgaaaaccaaaaacaaaaaaaaataggggcaagcactaaaataatagacatgcaggccaggtgtggtggcccacacctgtaatcctagtactttgggaggctaaggcaggaggattgcttgagaccaggagtttaagaccctgtctctacaaaataattttgaaattagctgggcatggtggcaggcacctgtagttctagctactggggaggctgaggcaggagaattgcatgagcccagatgtttgaggttacagtgagctatgatagtaccaccgcactccagcatgggtgacagagtgagaccctgtctcaaaaaaaaaaaaagaaatctatagttaccaaacttacaaataaaaaaagaggatgtaggaggagaggagagaacatagaaaaagtatctactatgcaaatgctaagcaaaagaaaggtgatatggatgtatttatacaagttcacagttccttatttgaaatcattggggctatatatgtatttaggaatatggtttcttgttttggttttttaattttagaaatgttaggccaggcacagtggctcacgcctgtaatcccagcactctggggggtcgaggcgggcagattgcttgagcccgggagttcgagaccaacctgggcagcatggagaaatgctgtttctaccaaaaatagaaaacttagccagcatggtggtgtgtgcctatagtcccagctacttgggaggctgaggtggcaggatcacctgagccagggatgctgaggttgagtgagctgagattgcaccacaccactgcactctagcagcctgggtcacataccaaaaccaggtctcaaaaaacaaaacaaaaaaaagaaatgtgatgggcacaaatattttatatttcattctacttctcagggctatttcaaactctacaatcagatacattaatatttctttagtgacatgtatgaccatgcatggtaagagtataaagactgtaaaatggctttccatcaggttttgttgccatgtgaattttaatgcaaaaaatttttttaaagctttaggttttcagaattttagatttacaatggtaaagaacagtgggcctgtctcaggcaaaataagagcctaaaataattaatagacagatactacttgctaacaacctaccaaaaaatataatatcgtatacttgtatgtacctaacaactcggcctcatggatataagtatgtttatatcaagacagcaaaaactaacagaattacatgaaaagtcaaccagaggaagcgattttgcagatctttatcagaaactgataagtccaacaaaaatactataaaatacaggaggtaacacctttggatctatatatatctatatgtagatgtatacagcaagacatagaaaaagagatagagggagcgagtatgccctaaattgaacgaagataacatacagtgttttcaagtagaatatttaccagaattgaccactgccaggatataaaggaaataatttacaaagttttgttatcatgcataacatgttctctgatcacagtgcaattaagttaaaagaaataaaatacacatacccaggaaaaaagagagaaaacacaaatttttgaaaatcttgaaggcattcttaaatcacccatggtttaaagagaaaactcacaaaactttagactatggtgggaacacttcatttcaaaaatcctgaaatgaagcttagatatatttagatatgaatttatagaaaaatgcatttattaaaataaatggcacagtaactcacatttgtaatcccagatacttgggaggctgaagcgggaagattgctcgagcctaggagtttgagtccagacaggacagcatagcaagagcttgtctttaaaaagaaaaaaaaaaaaaaagactgaaaagaaatgagttaaatattcaacacgagttagaaaacataataaaccaaataactaaaataacctaatataaatatggaaataatattataaataacataagaaattaaacagtctcaagaaaacagtattgtttatttaaaaaataaaccaaactctagcagcaaggcttaccagaaaaagaaatgacagaaaaaaagaaatgttagtgatgaaaaagcagatatcagataaagattttttaaactaaagacataattattaatactacaaaaactagaccaatatatttgaaaacttaggtataatgtaaggttttagaaaacatgaaatataaaaattgattgaataaatggggaaaggatagactttttataaatgatattaggaaattgattgtccatgtgggaaaaaaatacctttcaatgtacaaaaaaaaaaaaatttcctatgcagtttaaaaatctaagtatgaaaagtgaaactttttactaaaaaaaaatattgatagtcatgcattgcttaacgtcaggaatatgctctgagaaatgtgttgttaggggatttcaccattgtgggaacatcatagagtgtacttacacaaacctaggtgataaagcctgtataacatgttactgtactgaatactgtaggcagttgtaacataatggtaagtatttgtataactaagcataaaaaaggtacagtaaaaatgtggtattataatcttatgagaccactgctggggtcccttgttaaccaaaaacatctttatgtggtacttgactgtagttgattgatgtaattacgatctcaggtttgggaaggatttcttaaataaaacaaagtacaaacaattaagaaaacagttgataaagttgcccaccttataattaaaagtttttcttcaaatgacaaaattaaaagataagctacaaactaaaagctgatacttgccatgcatataactcatagaggatgagtttatagaattactttttccataaatttctatagattaatttcttacgtatgtatgtatttatttatttatttattcatttttgtgagacagggtctcactcttgccccagctggaaagcaggtaggatgatcattgctcactataacctcattgcctgggctcaagcagtcctcctacctcagcttctccagtagctaggactacaggcaagcaccaccatcatacttggctaactttgtttcatggggatggggtctcgcagtattgccaggctggtttcaaactcctgaactcaagtgatcctctaggcttggactcccaaaatgctaagattataggcacaagccaccacgccaatcctactaatcagttttttaaagaagaaaagctattggggggaaaaaataagcaaacttaaacagttaattcacaaaatatctcataaacatatgaaaatatgttcaatcttattaaatattattctattggttgatatagtccatattttatagtgtattagtcagcttttgcattggcaacaaatagcccgcagaacctcagtgctgttctcatgaaggaaagtgaaggctcaaggaagaacaaccaaataatataagcctggttaaagtttctactgagaagtgacatacaccatctttactcacattccattggccaaagcaagtcatgtggccatgccttgaagtcagtagggcaggatagcatatctccatgaaaagtgtggagggaataattggaaacagatcataggctctgtccccattaataataaccccaaaaatcttaatggcataaacaataaggtcatgctaagtgatcatttggggctctgttggggatctgtaccatgtcactgtgatccataagacaggacctaggccgacagagcagcctctgtctgtaattttggcattctcagtagctgagggaaaaagaaagaacatggtgaagcacacactaactctataaaacctttcctataaaagggtcacatgggacttatgttacattggccaaagcaagtcatgttgcccaagcctgagtccagcaaaaacagtgatgtatcatgtaaggaggggcaggatattagtgaatagtaatacagtccatcacaataacatagtctactaccataataaatataacaaaataatgtttcatacctatttgattggcataagttaaaaagtatgacaaaaccaaacattgctaagattctggggatataggtgttatgatctactgggacaattctaattgttataatcactgtgaaaagcagattgacacgtctatataaaactgaaaatgtgcatcccatatgacccccatatttctgcccttgctagaatttttcacatgtatacaaggagacatttataagaatatagtagcatttttaatagcaaagaaagtttttcttaaagaagcaacataaatgtttacaggaaaatggataaatacatatttatacatccatttaaatgaaaaatttagagctatcctgactaatgtagataaatctcaaaaacatacatactttttttaagttgtagatacattaagtatgataccatttatataaaattttaaaacttacaaagcaatgctgtattttgatttttgatacacatataatgaaagtaatattttaggagagtaagagtaatgtagtattttatacaaatatttataaaaatatacatggaaatgacacataaattcagattaattataagaagttagagatttagaagacattaaagaataccttgaactccctttttttttttcttttaaaaaaaaaatctgagctgggcatggtgtcttatgccggtagtcccaacactttgggaggccagggtggaaagattgcttgagcccaggagtttgagaccagcctgggcaacatagtgagactccatttctataaaacatagaaaagttggccaggcatggtggctgaagcctgtaatcccagtactctgtgaggccaaggcaggtggattgcttgcactcaggagtttgagaccagcctgggcaacatggtaaaaccccatctgtatggaaaaaaaaaaaaaattagccagacatggtggtgtgcacctgtagtcccagctatttagggggctgaggcaggaggatcccctgagccctggagtttgaggttgcagtgagctgtgatcgcactactgcactcagcctgagtgacaaagtgagaccctgtctcaaaaaaaaaaaaaaaattaactgggcatgtgggacatgcctgtagtccagatacttgggaggctgaggtgagaggatcgcttgagcccaggaggtcgaggctgcagtgagctgtgatcacaccactgcagcactccaacctgggtgacagcaagacactgtctcaaaaaaaaaaaaagggtggaggggggagataaaatattggcatatgatagatacgggtggtgaaaatgtggatatttgtgttattgtctgtacatttgaaaaaatagatattttatggttgacaggaattaactggaatacccaggtaccaatagcaacatgtactatgtcttgaaggattgaaacaacctgacaggtttgttttcactgcagagccattttgtgccaggaaagttaagttagtagatgtgcttcgtgggtagtcagaaatcatcttatgaaggcccatgtgtgtcagtatgataaatgttgtgttctgttactttctgtatgtggacatcttttttgagaagcttgtgtatgttgactaagttaactaagggcattttcagaattcttgtcttcctacatagaggattctgacttcttcagctcagattcccctttctcttcaatggtagttagactaaaatattagaagaatccattctgttcttactttcttctcaacagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcaggtaaagaagttctctttccaaaaataaaattgctgtttcaaacatttcctttctcaaattagtaagaaattatttctgtaataagggtaagcttcaatcacagatgagttttcgaatttgaaaattcaaaatacatactacatgtagaattcttataaattaatttaaaatatttaacaccacagtagaaaatggaacaacttggctgggcgtggtgcctcacacctataatcccagtactttgtgaggccaaggcgggaagattgccaacagccaggagtttgagacaaggctgggcaatatagcgagaccccatctctacaaaaaaaaatgttaaaaattagccaggcatggtggtgtgcacttgtagttgtagctactcaggaggctaaactgagaggatcacttgagcccaagaattcaaggttacagtgagctatgatggtgccactctaccctagcccagactccaggctgggtgacagagtgagaccctgtctcttaaaaaaaaggccgggtgcggtggctcacacctgtaatcccagcactttgggaggcctaggcgggcagatcacgaggtcagaagatcaaaaccatcctggctaacacggtgaaaccccgtctctactaaaaatgcaaaacaaattagccaggcatggtggtgggcacctgtagtcccagctactcgggaagctgaggcaggagaatggcgtgaacccaggaggcagagcttgcagtgagccaagatggcaccactgcactccagcctgggcgacagagcaagactccgtctcaaaaaaaataaaaaataaaaaataaataaaaataaaaaaataaaaatgaaaaataaaaaagagaaaaaaataaaattgaacaatttgtagttaaaaaaattaacaaaaactacctatggccaataaacatggaaaaaaatttctcagaaattatcaaaaaagtacaaatgaaaacatttagatagttttcatctaccaaaatggaaagcatatcaaaaaaatagtaactggtaaaaatgtagagagactgtcagtggaagtataaattggtttaacgtttctagacaattgagcagttgtattagttattaaaaagtccatgatcttattctgtgacctatctactattttccctgtgattcttgactttaattcaaactcccaaaatgtttgactcttcatggcagctatgtgaaaaggtatgaatattgactaacaattgtgtaaagttgagatgctatgagaatatggggaaaatttgacatttcttaaagtattattgactgagcacagtggtttacgcctgtaatcccagcactttgggaggccaagatgggaggatcacttgaggccaggagttcagaactaccctgggcaacatagtgagacctgtctcaacaaaaagtaaaaaaaattaactgattgtggtggtgcatgcctgttgtcccagctacttggaaggctgaggtgagaggatcgcttgagactaggagatcaaggctgcagtgagctgtgatcatgccactgcactccagcctgggcaacagaatgagaccctttctctaaataaataaataaaatattgtttatctcaccttttattcattcattgcttctttttgattttagtcctgaagattatatagacacagaatctcctgtccctccagacccagagcaacctgattgtactaaaattctagaacttccatatagtatacatgcttttcagcacttgagagtaagtagagaactttaggatttttttttttttgcgttgcgttcttctttcagttggtctctcacttataaagaccatttctctttcttctctccttcctgacagctttgtaattttatagacatctcttatttcttaaaattccaaaatattagtatttcaaaataaacactacaagatactgaattatttgtcatcttttatatcctttgatatgtcttttgaatctttttcttctcttcagggtgtacaggagagagttaatctttctgcacctctgctacctaaagaagacccaatcttcacatatttatctaaacggttaggaaggagtatagatgacataggtcacctcattcatgaaggcctacagaaggtaagtcatcagtcacttaaagagccagcgggctgagccagcgggctctgtgtaaacagaagatatttttatcttggaaaatacctgactaatttgtttttatctagaagacgatttaaaattacacttacattgatgcaaattgcatagttcagtgctggggagaaatatggatagactagtctcctttcccaggaagagatgctggaaagttttatctaaactgatgaaaaacgaaatataaactgacataagcaacagcgtttataggctggattatatacattgtgtaagtaagaaagttaatgttttagtgtcgttaatatatctatacacaatacatgtattattactgttttctgagacagaaaaagaatcaccaccagcaacaaaatcttctgtaactttcttttaagagactatctactttaaaaaaaatgaaatagggaattatgtaacaggacccaggaatgtaaatgtatcattcaggattaacgtgggcatttagaaaatgtttttgctattctttgtgcctaaagagtatcataaaatgcagtttagtttctaagcagtattatagtggtataaaataagatgtataattgccacctttgtatacagttttttcaaatacatagctttgtatattgagaggaattttcagataaaagtccgataataacttgactttcagatgctttatatggttatttctgtagctgtgttaccatcttcatcttatttttctgaaggtaatgtaaaacttttacattcccagaacttgatgagtaataagagaaaactggcccaggattttacagtgtccttcagagaatggttagttgagagtagaccatagtggtaagtgttctatagaaaattaaaacagaaagtaactgggtggctactttagatctagcagttggggttatcctatccggaaacgtgaaatttaagctgacacctgaatcataagaagaaaccaaaattcaaagaccacggaagagcattctaagccacagcaaaggctctgaatcctgattgaggttaggtggttgtatttgtctgctcaggcttccataacaaagtaccactttggaccgtttctgctcaaaacacttctgacaccaaatgtatggagttttttctcacacgactaattcggtagttctcccgacatcaactaggtgttctacaactcaatacaattctgacactaactacctggagttagcacagaccccacaggtcaaggactcagtcccacaaggctacctgcacttcagatgccagtcgcaagtcaaggccaccagacaaattagctataaagtcagggtgttcccacagctgcctccccaagttagaacagctcacggaagtcaggaaagcactttacctactattattggtttattgtaaaggatgcaattcaggaacagccaaaggcataagccagggaatagggggaaggggtgcacagagcttccatgtcctctccagaacaccaccctcctagaatctcaatgtgttcaccaacccagaagctctcaaaactctgttgtttaagggtttctacggaggtttcactatgtaagcattattgactaaagtattggccatgagtgatgaactcaatctctactctctctcccctccccgaaggacagggggaggatgggattctgaaagatctaaccctctgatcatgccttggcttttctgggaccagcatctgtcctgaagctatctgggggccacctgcctccagtcatcccattagcatatgaaagacacacattactcctgtgattcttcaagttttaggtttgtgtgtcaggaactagggacaaagaccaaatatatttgttcttaccacatactaggtggcttaaatttatttctcatagtctggaggctgggaagtctaagatcaaggtcccagtgatttggttcctggtgagggctctcttcctgccttgcatatggctgccttctctccgtgtcctcacatggcctcatctgtgtgcatgcttgaagacagagagagatctgtctcttccatttcttataaggacacttataggaagaaatcaaatttgggccccaatccttatgacttcatttagcctttatccactcctcacaggcctgataacacttgaacatatgaactttgaggagacatagactttcagtccgtaacaggtggcatgcagccaaattcaggccaatattgctggagcctggtgagcaagaggaaggatgataaggaatgaagccagagaagtaggccagtgccagattatgtaagggtctgaaatccagggtaaggattttggattttactccaagtgtgctgagaagttggagcagagaagcaatgtattgcaattaatagttgaaaagatcactttgattactatatgaagaagttattgaaggggccacaactggaaatagacctgttagaaaactgttgcagtagttcaagagagagatgaaggtggtttggactagcaattgttagtagtggaaatgagaggacttgaactattcaggagatatttaggagtttagaagcagatgagttagatatggggattgaaggcaaaagaggaatcaaggaaaacttaaatttttgacttgaacaactagaaggaagagagggttggggtgggagaagagaaaataagagttctatttgggccatgttaaattcgaaatacctatatgagtttggaatttcagggaaagttagagttgggcacatagagattaattattaaataatgaatatctgaagccatggaactggatgaagtcatctggggaagagtgaagtttgagaagaagccagtctgactcctgggtgcctcccacatgtagttatcaagcagagggggaaagccagcaaaaaagaccagaaagggtatcctgcagaatgtggtgtcctaagagtcaatggcagaaagtggtcaaagaaaggagggagtagttcacagtaacattagaacatttatagatttgggggagattttatgagaactacacaaagatatttctttaaatatatatttttatcttacctccagtatgctatgatatatatttaacttatcatgatctcttcagtagttcatgtagaactttttttttttttttttttgagatggagtctcactctgtcgcccaggctggagtgcagtggcgcaatctcagctcactgcaagctccgtctcctgggttcacgctattctcctgcctcagcctcccgagtagctgggactacaggcgcccgccaccacgcccggcaaattttttgtctttttagtggtgatggggtttcaccatgttagccaggatggtctcgatctcctgacctcgtgatccacccgcctaggcctcccaaagtgctgggattacaggcatgagccaccgcgcccggcctcatgtagaacttttaattgaactttttgtccccgtttacattataatgtgaaaataaaagatgaaaatcaaaatgaaagcatttgttgatttgaaaaacaactttctcaaaaggccatcaaaaagaaaactgaaacctcggccacaagtcagttgtgaagaatgtactgtcctttaaccagcttcaagtagaagttcatagttgatctgctcatagtgttaaaatctgtaattgcatcactcaaaaatcacatacttttcttgaagatagaatacttaaggatgaataatgcaggattgtacttattgtagtcttaaaaagctacgtttaactaaattcaaactatttttaactacattaaaataactcttttaaaaataattggtccttgtgaaagagtcactgaaaatctataaaagaaagtaaaattaataatttcaaaactggtttgtaatatattcttttggagtttgatttttacacagctttatagttaaaacgtaattattccccataggatacatttttaatagtagaattgtgggagtcaaagggtaaatgtaatatacattaatatgtatgataatgtaatatacattacatttttaaagctttttacatacatgtcaaattgtcccccagaaatgctatagtaacttagcatttctatagtttaatatctaaagttaataatattcagtaagtattggctttctttttagtctttgccactttgtaaaaggaaaacttgtatcttttaagtttctatttctttgtgaagttacacattttacatacttcttagctgtttgttcatgtttttggccctttttcctttttttttttctgtctttatgtttagagtaagcctgttggtttgtgccttcactcagatattacataaatagaaaaaattctaaaatgttaatttcaggaatttcatgttagagctatttctaagtagatgaggtcttctgacttaacttctgaagtcctgaaatagagctcaacaagttgtgatcagttggtgggatttttcttatttccctcttggaataagctggagttggatggtctctatatgaagatcacaccctaatgcacgtgctcagctgatgattagaatgctcttctgacaggtatagtttctttgcactgtgtcctgttctttatcattgcttatcattcagtctggctcttcttcatcttgaatttcagaagagccagaatattaaaggtgctccttttgagtattctaagttaaactgtcttgagtcgtgtttgtaattttacttttttaatctctagaacacttcctcgtgggtactgtataacatggcttcattttactggagaattaagaatgagccatatcaggtagtagaatgtgccatgcgagcacttcacttctcttccaggtaagattcctcctcttctggacctgattttccacattcctcaggactgttaaagaaacaatacataagaaagcagtaagaagcaacattgcattatatacttttctccatccctgttcaaagaaataagtcccaccacaaaaaaaaaaaaaaaatcacagatctcaaaaagttcaaagtgataattgtgtaatatactttccatttccattaaggaaaaaatatgtagatgccctatgattcacatgatacttgaatggaattatcataaactaagtttaacttttcttaaagcaaatataagccctaaataaattgtaaaatcatacagtgtctgcaataccttattttagtgacaaaatttgtagctatcagattaagagccatcaataatttaaaaatgaaacactatgattatcttattttctccacctatatcttagtttcctaagcacaagtaactttgaatgtcatttttccttgtcaagtggttctacataatcatggaatatgtgctgctttccttaggcacaataaagacattgccctggtcaacctggcaaacgttctacacagagcacacttctctgctgatgctgctgtcgtggtccatgcagctctggatgacagtgacttcttcaccagctattacactttggggaatatatatgcagtaagtactactctttgtttcatgagtcatgctagttgccactttcttttttttttttttttctcccccctcagtagaatgttacttttttccattccttttttggtctgaacgatggaaatgaaattaggaggaagaaaaatcctcaacacagtaatgtaattattctagcctcttgccaaaaaaacaataataataattaaattggaattttaaacttctacagggtacaccttttaaggttagcaatacctgccaactaaaccatcctatagtatgccttaatattgtagggatctggtcactgatcaaaataatggtcactgtagagtaagaggtaggtgtgatctcataaatcattagaggatttggacagatgcaaccaggccgtggctaacatttttttttccgtgtgtgtgtgtgtgtgtgtgtgtgtgtgtgtgtgtgtgtgtgtgtgtgtatgtttgtttttgtctcttcagatgcttggggaatataaccactcagtgctctgttatgaccacgctttgcaggccagacctgggtttgagcaagctataaagaggaagcatgctgtcctatgtcagcaaaaactggagcagaaattggaggctcagcataggtaattgagaggaaaaatttcactcaagcattagcactatcgaaccttaggttaaatctgtgtaggggatatcagtgttaatttggtaactggaattaagaaagaaacctcttcactactgcaagtcctatcctttttctgtaagtcctggtggtttagcacaattcagtggttgtgtagaggaatatctttaattgtatggattcctgcaactagagaatatttgtagtaaaagctgtcacttaaatgtttacaattttgaccattgattacttttatgaagtcagttggggtggggagactgggatacttagttgactacttactttgttgactgcatttttatttgcatagaatatactaagtttcagtaaaatcacttacatgtgcaatagttgatatttctcctcttggagagaggtggtggctcctagggttgagttattgttaaggtagttaaatggcattgagagacattatttggcccacgttttaatcatgattgtgtgttaggttgtacagtaatggaattctattgtatttgatccttgaggtataataagttaaaaaacatttccttcaatcagtagggctagttaagaaacttcatgttaactcagaagtgaatttttcatatctcagaattagctgtaatatttgagtttactttggttagtagagaattaaacagagatttagaactcattaaacttttgtatttgcttcttttccaatctttttaaggcataatgtggtaggaagtaaaaaggatgccagcttgcttattcataactggtttctgttatacctggctgagctttttccagtatcatgctcttaataattgagctggctctatctttacacaatctgtatagttcctaaaatctctgtatgttacagtgtgtaataggcagtatgggttttctgattaaatgtaatcaggcagctgatttactgaaatcaggtggtgaagcatattcctttcgaagcatagtttctgtagtttttcctggcctgtaaccaataagctagagtatgaaagcaaagtactgtggcccctaactcttaactttgtctttaagcagaatctagggaaaaagtgaaaaggaggaaaggattctagaaagactttgaatgttgatggaactaatgcaaattttgtagagagaaatagagttgttaaatacataaacttgtatatcgtcatgtatttttttatggcacctgaaaaatgcaatataccatttgatgtcatgatagttgtattgccaggtgtcatggctgatgcctgtaatcccagttattctggagactgaggcagggtggaggggaggaatcacttgatgccaggagttcaaatctagcctgggcaacacagcaagacccagtttctaaaactaaattagccaggcatggtggcgtgtgcctgtagtcccagatactccccaggagactgaggcaagaggaccccttgagcccaggagttgagcccaagagtacaaggctgcagtgagctacaatcaggcctctccatccagccttgacaacagagcaagaccccattttttaaaaaagttgtatttaaaggaagaatttcacatttatctttttgccctagtattcttgaactggtgatacagggttgtatgttaaataaaaggaaaacacacagtaattgttgctgagaaccagaaaaatctgtgcatttaagtgggtttaaaatttatgattttatagctctaactttttcctggtattaaaaaatgttaagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggtaagtagtgactccaagtaattgaagacaggttaggaaattcacttttagcatgctttactatcataactttcttgtagccttaaagcagtgtgaagttgtgtttatgacttccctacatctcgaaagcatgattcatcactgtgggtataccaggaggcctggggagctggtttggtctaccttgcttttttcaaatttacattttgaaataaaaaacaagtcttgtagatcctagaagtcttaacagttatttgcattctgtgttcaacatcagttttttttcctaccctaatatgcatatcagtctcctggagatcttgttgaaatgcagattatgattcagtaggtctgaattgaggcctgagagtctgccttcctaataagctcccaggtgatgcttgttgccgcaggtctaaaaactctgcactatgggtaacaaggccttacactaagtgaatacaagccagacccaccctacaaacaacccatccatactcctttttttcttgctctcttaaaaacagtgttttagaagtaaaattttagactggaattcttaacctgggtcaatggattagtttcagggggttctgaaatcctctccaaaattatatgtagaattgtgtatgtgtccaattttatttttctgggaagagggtatctagcttttattaaaatctctcaagcatctgtgatccataaaaatagaaccactggtttataggaacttgggttggcatgagaacaatgatttggttatatctagaatgttttgtttctaatgacaagggagcagatctgacaactcaataacagagaataaattaatagaatctcttaattatacccttctcccttgataagtatgttggtcaagaaagcctcttaacctttggcacttagctgtgaccatttatagtttattttacaattcccttaacaagttttctttgctattatgagtgtaaagagtatgctcagtctttggaattacttactgcccagtatattgaaatgtaaccagagctcttatatatgcatttgaaacaaaattatgaagtatgtaaagcaaattctctccagaaagatggccaaagtctcttaaaacgatgtaatcactagattttacaatcacagactataattgctgaaagatacctcagtaatcatctagtggagtccctttgtttttgtaggtggaaaaactgggacttcttagaatgatttatttgattaaccattaatgaatatttctctatataagtacgtcctacgtaagtagcctgctaggctctgagggatacagggttgatactaaatgacttagtctaagaaaatcacattggcattgttgaccttgctcatcatttgtgtaatttcctttcttattccaggaaatcatcagatatgccgactggtcaaccagcagcatagtttacattgccagtgggaccagcctgtacgctatcatcgtggagatatctttgaaaatgtggactatgttcaggtctttttcttggtccagtctaattcttataaacgtttgctttataaagattttttaaaacttttgtttttcctcttgattctttgtatatttgatccctaaaatttgtgattgtcatttagatctttaagattttgaggctgggcacagtggctcacgcctgtaatctcagcacttagggaggcagaggcagaaggatcacgagcccaggagttcaagaccagcctgggtaacatggtgaaaccccatctctacaaaaacatatataaattggccaggtatggtggcatgcacctgtagtcccagctactcgggaggctgaggcgggagaatcatctgagctctggaggtcaaagctgtagtgaacccagatcatgccattgcactccagcctgggcaacagagcaagactgtgtctcaaaaaataaataaataaataaataaataaataaataaataaataaataaataaagagcgagagagagattttgattatctgttatgttgttatgtttacgaagtcagattttatagggagtactcaataactccatggatgctttctatttcttaaagtaccatctaaatatttatatgcacatgcatttgattcttttctcttttaccatgggagctagaattgggctattattattattgaactcaaagctttcatctccccactttcccttttagagtaagacctatttaaaatttgagagcaaccatgctatttgtttcctgaagtaatcagtccaattatattgcctcaaccaataccaccaacaaaatgctcattatcaacagaaaatctttattaagcccactgctaggtgtgtactttctctcactttctgtcgctgtatatacacacgtgtatacacacacacatacacatatacaatcctaatctatctagttgggaagaactaacacatgtaatgataccagatagtatataatagatgttgaataagtggtacagacagcaagtacagccagaattctgagtataaaaaaaaaagattcaaactctgaaactttttgagcactgacatgatgctcaaaagaaatgatcattggagcattttggatttcacattttttgattgggatgcttaacaggtaagtgtaataaaatattgcaaaatccaaaaaaatctcaaatctgaaatactcctgattaagcatttcagaaaactgatactcaacctgtattagaaataaaacatttattctatcttagagaaaactcatcatgtctaatcgtagatacagaaatttccagcaataactacttaagataactaagagattaggagagcatctataggaggacaaaccacaaaaacttagaactctttaatctggaaaaatccagactgcattgggaaaaaataagagacaaaaattaagaagccattttaaaggggaaatagtgatagggaccaaaagcttcctatgagtattgtaaaccagctcccagcaatatctcatgtttggtttccaagggaaaaaataaagaagaccagattcacaccctctgggattatagctctttatcttaaaaccaagcattttaaagggaagaagggggatgtttagaaatgaaatagattgaaacccaatacaccttttggactttttgatggtctcaagaccgatcatttgaaggagtgtagcttccaatagtctatattcataaaattgtatcaccactatatagtgaaagaatccattcctgttcacaaagacctagagctacaaattcgtcatattcattccttttccttttgtctttcctaccccatcccatccccagtcccattctcattatctagcaaggtttcagaaatacacaagcatctttgtaagtatatccaacattgttccaccttgctttgaaggaaggctgtatatgtttgtgttctctcatctaggttaccctttcaccctcaaaacttttctttgtaattgattgcacaacagtctgtaatccttaagtgatagttatagaacccttaagaatactttcttaagttccctcgcctctacccacacacggcacaccaattttagagtggtgagcattttagtgtaggaagaaaaggggaataatgaaccagatttctcaattagctaattattaacctaaagagactaaatcataaaaatgaagcaaagggacaggaaaacgacctatgccatttttctcatactccaatggcaaagttattgaaagttgttaactatgtattatccatgaaagaatatcgttggggcatagttcttaaaagatccaattgctttattactgagctactttctgattttctactaattttgaatattcactcgcttttttggtgtgagttaaattataatcacaactccttttccactttcaatttgattgaactttttgtttcattttctagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggtaagttaatagaggatgacgaagcagttttctcaaactggcaagatccattaaagcagtggccctcaacctcactgattaatatggcctctatgactgttcagattagttcagcaaacgtgtagtacatttctattaaatggaagctattctgctaggtagtgaatgagtaagatgcaatttctgccttgagtttttcccagtcaagtagagcagatagacaccctgatttcagttcaaagctttatcctctgagtattattaccaaccttaacaagtttctaaacttgacccaagcgtatgtttttatatacttcacttaatcggcattcttttattgaactcccacctgtgtgccaggctaatgctggcagtataatagataagcccccttgctcttctggagcctacattctggtagatgatacagacaataaacaagttagtacatgtgcctgtctagactagctaagaaagaattgtaggttagctgaggcggataccaaggtatgaggacagagactgtgtgctttttattcaccattaaattttcagaatttaatcaagggtttaacagaattaaacagccacttagatttaattatatttaatataaatccctcaaagtttgatagcttgaagatttaagtttagtaagcctctggtacatcttatttatttttagagaaaattaacattttacaaatcataaaacaattgttaaactttggcattggcaaagaaaagaccttagttcagggaaaagtagtgttcaatgccaggttttataggcttatgtatgctttcaggtacaagtcataagctccacctcaaattaaatacaaagaaaatgtgcctgttactacaggaagtccagaaataggataaacttcaggtttggttgattcagtggcccagtgatgtcatcagtgacccatttcttctttttctttttttttttttttttcttcactctgccatccacagtattggtttcatccaaaagcttggtttttttcatggtcatgacagccagcagcaactggaacaacatgattttttgttcatatgtaacgtaagagcctaagacttgcttctctttccgaaaagccccaagcaagcctcttcttgtgtctcactggctcaactggcttatacccgcccaaccctgaaccagtctgtggtaaagcaggtagaattactgacttagattaataatctgcagtagcaggaatattatagagtctaccataatcttaagatattatagttttgttcaattattgtagtatatcattttaaaagtttatttagcatattgaaatattgaatccaaagaaatttatgagaaattttgtttctttatcaggacaaacagcatattctatggcctaaaagagcagattgtacagaaagctaccctagagtccctgttggtggggaattgccaacgtattttctgcctccggaaaacaaaggactcaggcaagtggtgatggatttggcaaagcacctgattctgcatgattgtcatctagcggttctttgagagcaccagccttggacttgaaaagttaagtctttatcttgaagtcacccaaactttgaaaatatgaatcttgttcctttttcttgtgccaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaagtaaggctcacttaggctggtatttattgccgtccattctgggtgacttcagaagcctcttaaatggaacaaaaaattgatagaaggtagctgttgagctttaagtgtataaaatggaaggatagagttaaagaattggtgaaatgatggcgaagtcagtcatgctattaaaggagtgccagagagttcctcggggctgctatacgtagatcacctaaacactattcctctaacgcagagcacttcaaagatgagtagcacagaactctctgttatctaatggagttggtgtaatgcaggccattgcaaccactaaaagttagctttgcatcctccaggcctccagaagtgtatataaattgaaagcttgaagaatctctctctggccttatcaaccctgctgtgaccttatatgaggtccataggaatttatattaatttgataatgactctgcaaacattagaagttcaattatgctcttttcctaaattcctattaattatatataactacgagtgttttattactgtatattaccatattagatatcattccatagataaaaatgaaaaaaaaaattacctttttagcaatcacagaccatcacaaccacctttttttttttaagttaatttcaaaactataggcacttactgttacttatattcaatagacatttccttaggcaaaaaacattatgtgccagacattgttttggatgctaggaatacaaaaagataaacagaccatgatctgtgccttagagttgtttaccgttatataaatgctgcaggaacatgaagtagaataattgagtatctggtattttccaggaaggaaagacagtagatttttattacatcagatattgcatgctgttgtcttttgaataatttcttcttgggttctgaacacttaggctgactttaatggggtatggtaggttactttaatgtgtgggggtatatatgtctttttaactttttagttaaactattacatacatgtgagcaggtcaacacctgttggtatgtgaatgaatttatgtcatatatatgatcataaatatttgttcaaattagctgttcctgaggagcttaagaaaagactgccatctatagaaattcttttcaaatgtcttccctgttattttcaattgagtcagtcttccttttgatgtttcagattttgctttcccgtattaataactatactatcccagaagaagaaattgggtctttcttatttcatgctattaataaggtgagtcatttactttagacatctaaaacttaaatgcttcttaattataagtaaaagttaaaatgcacttattaaaaatcttatttagaacaagtactgtattcttgtactaactgaagtatttttggatttttcagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgaggtgaggttttaagggatttcatagttccgtatactatgtagggtaactcaaatttagattacaatttgtatttttctagggaaagcataaaaaatgtcatgttttgtctttcacagtagcgtttgcattatttcaagagagtgtgaaaaagcttttgttgtattttgatgtgttctttaaattttgagtgaaatttataattacacagttaagtttttttttttttggaaacttacatttaaataagaataacataagctgtaaaaatatactgccgcttttttatgtctgtctgaaacatctggtttgtattttatcctactcatcacagcatgcacactgcttaatattacactgttttacaactttaatttatagaaatatttatacccttcaagccagaggacagttcaaaggtggttttgataagaataaatagatacattgattttcatgccccaaacctctcacatgcagcttatggagttacatcagtgctttgtagttcatggttttgaagatacaactttggtttttcatattttaacatctctgatatcaggatggatgttataattgctgtcattttaggtttcatgaaattcagttataataaatatacaattaaattgattttatacctaatgtctaaatgtttataggttttgtattcaaagaaaccttcagaagggatgtgcatgaatggttgaggtttatttatggtgtctgaaaactgattttttaaggatgagaagaaaatattgcctgttttcttttgaaatacagaaattcacaactggattttaagcagaagtttacaatctcaatattatgtaacaggtcacattgccagagaagtacatcaaatatttatctagtgcttactgtgtaccaggtgctggtacagtgggaacagatgtgataaagtgggcaatggaaagcgcaatgcagccgtattcccttgaaacttttcatgattccctttttactgttttcagccaagggacttaggtagtattcttctgaagaaaaaagacctcctttagtgatcagttaccttttgatattttaaaatcatactaaaattttagttgttaaataccatggtgctacaataagaataaaaagataaattaatggatcagggtgggtaccccaaaaatataccttttttttttctttgagacaggttcttgctctgttgcccaggctggagtgcagtggcgtggtcacggctcactgcagcctccacctcctaggctcaagtagtgcacccacctcagcctccctagtagctgggactacaggcatgcaccactgcgtatggctgaattttgtatttttttgtagagatggggtttcaccatgttgccaaggctggtcttgaacacccgagctcaagcaatcctcccatctcagcctccaaaagtgatgggattacaggcatgcaccaccacacccggccccaaaaatgttccttaatcagcaccctcttcccaacttttggaaatttttccttataagcatgtcttctatacaaatatttcataatgtttcaactctactgtacaggtgatctctaaaaaacttattcctacctaattttaaagccctcaatttaaatggttgtataaaggaccaatgaattgatatgccacaacctatttttctgttgctgcatatttaggttgctaacagtacttagctattatcaatgatggttttctgcaaaggccttaaagattgttagcagtggaattactaagtcaataagagaatgaatattttgatggctctggcacaaaataccaaacaacccactaaaatggttgggccagtatatattgccatgaataaggtctaaaaatattaattccacctgtgtctttattagaattgaacaactgaaataactgccaatttttttgattgtttactagagccaggcacaatactaagcatcttacatgtagtaactaatttaatcctcataacaaccctgtgagatggaatttcccctttgatagatgaggaaactcttaagagttaaatgtacagagtaagggatttatgggaagtcacagagcttggtgcttggttttgaactcagggagattggccacagggcaaatactctagtcgtgttatactacctctgaattaacatttataaaacaagtttcgcttgcttaaaaataccacctctccgttgtaacgtaaagttttatcttgtggttgtttttgtttttcttttttccttttttcttttcttttttttttttgagacaaaatcttgctctgtcacccaggctgtagtgcagtgacatgatctcagctcactgcaagcttcgccacccaggttcaagctcttctcgtgcctcagactctggagtagttgggatttcaggtgcataccaccatgcccggctaatttttgtacttttagtagaaacagggttgtattttaatagaaacatgttggccaggctggtctcaaactcctgacctcaagtgatccgcccgccttgacctcccaaagtgctgggattacaggtgtgagcccttatgcccaaccttgtaattgtatttttaaagtaaaagtttgtatacacattttgttcattttagaattttgttttttagattttgtgcaaaccctttgtatgataaactctttaactccatctctcatgtgttaaaaatattttctctctttgcctttttatcttagcatttaaaaattgcccttaagtttgccagtcttttcaatgttgatttctattgttagatttcaagtgttctcaataaactgtttgtttttgttttctatggcttaatctttgaatagttggctctcaaatatataaagatcttttcctgtgacgtctcctggatattttatagttttaggctttacaattaggtctatgattcatttcaagttaaattttctttgtagtgtgaggtagggatcaaagttcatatttacacggatatccagttcttcagcttcatatcttgagaagactgcccttttcctgttgaattacccgtcacctttgccctgaactccagactcctttattcaacagcttacttgacatttccacttagatgtctaaagggcgctctagaacaaaaggccaaaaccaaactccttaacgctgttccaaatttattcttcccagtcttcctcatttcaggaaataataaagctatctttccagttgctcagaccaaaaacttaggggcttccttcatacctttctcctgttctcagggaaaattcagtccactggctaaccttgttgattctgttttcaaaatatacctcagattttactatttatcattgcttctactgctgtcccatccaaaccataattatttttgtctggattattttaatagcctctagactggtttctctgcttctgccattgtcccccagtctgttctcatacagcaacagtgaaatccttataaaaagtcaaatgttgttatttgttggctcaaaatccctgtagtggctctccatagaactcacgggaaaatacgaatttgtaatgatgtagaaggtcctacatgaccttgttacttttctgaccttatctctgtgaagtcattccttagcacattctattctagcctcacttgcctccttgtagttccttgaacatactaagcatgcccctacctcaggtcttttgcattttctatcctctctggttggagtacttcatcccaccaatattcttcattgcttactccacctccttgaagtcttatgaatactaacttctcagtaagtccctctcatactactctgttttaaatggtgcactccccccgccccccacaatctagtgctacctttatttcttccttctatatttttctccgtcccattttgctcactgacatccccacactggactgtaaggtctatgaaggcagcagttacctttcttattttctgctgtatcctcaatgttcaaaactatgcctgcaacatagtaaatactcactacttattttttcgttcaagggatgaagttcaactttttttccaaaatgctaaccagtttatctcaatgcaggatatttttacagctgtcattttgtcatagggataattataacactttgtttccttatgcaaaatataaagatacatttgaagtctaagtatgggatttaattttgtatctgggtgtgaattactaagtaatagtttgaatgtaatctgagctgcttaggttagacttccttaatctagaatattttttatcctctggcttggttacagtgagacatttctgatgatctaacagccccagtcaaaagcaggtaattggataaatcataagcattgttttacatagggatatattgtacagtttgaaaataaaacattcttagatctttttaactatttttaataataaaataaatttaaaacatatggtttgcacacaagcaaatataaaaacactatagatgtatttcagttaaaatgacctaaactgaatactttgggctgcttatgaaaacaaagtctcagcaaacaattggaaaatagcatacaaagtacactgtttacaatagcatcaagaaaacatcagatctgctgtggtggctcacacctgtgatctcagcactttgagaggctaagtggggaggatcgcttgagcctaggagctcagtaccagcctgggcaacacaatgagatccactctctacaaaaaaagtcaaaaaaaattagccaagtgtggtggtatgcacctgtactcctagctacttgggaagctgaggtgggaggatctcttgagcccaggagttccagaccagcctgggcaacagaatgagaccttgtctcaaaaaaaggaaataaagaaaacatcagatttctaagaataaacctaaaagaagatatacaatatttatatactgattacaagatatcactaagagaaagaagacataagtacaggttgagcatcctaaattcaaaaatctgaaatcccaaacattccaaaattcaaaactttttgagcaccaacctgacactcaagggaaatgctcattggagcattttggattttggattttcagatggggatgtacagccagtaaatataataaaatattcaaagatgttaaaaaatctgaaatccaaaacatttctggttctaggcattttggataagggatactcaacttgtaaagggagatatacatcatgttcacacattgagagagtcaatattgttcagatgtaagatctctgtaaatcaatttatagattcaattcaatctcagtcaaacacctagtaattgcatatatgtgtttgtgtattgataagttgattctaatatctacatagaactggacctagaatagacacacacacacacacacacacacacacacacacacacacacacacaaatgggggcagggtgatggggaggaacagagttggaaggcttttattaccagattttgagatttactataattaaaagagtatggtattggtacaaagatactcaaacatagcaatggaacataatagggaatttagaagtagaccaccatgaatatggccactggtttatgacaaaggggtacctgtagttcagtgaggaaaaaacattttggtttttcagtaagttagtgctagaataattggatgatatccttatggagaaagataagaactttgacttctgcctcacaccatacacaggattaatttgaagtggatcatgtaccaaaatatgaaagataaaacaataagccttctttatgaagacataggagaaagtctttatgaccttgcagtaggcaaagatgtcaaaaagcactaattataaaagaaaaaaatgataagctgaacttcattgaaattaagaaattctgtttatcaaaagatactattcagagagtaaaaaaacaaaccatagacagagaagatttttgcaataaatattttcaacaaaagactaatatataatatagacagagagctccttcaaggccttaagggcaacctaattcctttagatagagaaaagaacaggcacttcagaaatgaggatatccaaatggccaataggcacctgaaaaaaaaaaaaccctcaacattattactcatcatggaaatgcaaaggaaaaccacagttagacaccactgcagctcactaaaatagctaaaattaaaaagactgacaatacagagtctctgaattctcacacttgctggtaggagtgtaaatttgtgcatccatttggaagactatttggttgttatctactaaaactaaatataaatctaccttacaacctgtgctaagtatatactcaaagaaaatgaggacaatgtgcctatcaagacatttacaagaatattcatagtaactttattcataatagacgaaagtggaaatagcccaactgctaatcggatgaacaagctgtggtgtattcttatgttagaacattacacatcagcttaaaaaacaatgagctactgatgtatacagaagcatgaatgaattttagattgagtgaaagaagctacaaaaggacacatattacatgtactcataggagaacatgcagtttgatttcatttacctgaagttcaagaactatgatgacagaagtcacatcacaacaatggttacttctggggttggattgcccaagggaacctcctggagtactgaaaacattttagtatcttgagcagtgtggcggttacaggggtatatacatatataatttatattacatactttatatattttttatcttagcaaaaaaagtgaacacatttacatgtattatacagtttagaattggctggtatgaataaaatggatagttagcaataacgtttatggggtaacctaaaaagagccaaaagccatatactgtaaacgttttgtaactcccagaaaatattagttcattaacattttgccgatttttttttcttttcagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaagcagctttcaaatgctgacaaactaatgagctcagccagagttcctcttctgatcaaaagaacacagaaaatgattttctctattttacccaaggattttagataaccagtataattccagatgcataggaaaagatgttaattccttacttactatagatgccttagggtattaaggcttaattctctcttagaactctggttaagaaaggctaactaaaatatgtggtatattcaactgggatggataggctttgagatttttttcctccctccaaaatctctggtgttttataataactgacattcctagtaaagtacattttttctgtccatgaagtcaaagtatacagttttaattgaagcagttcttctatatactcagtcactgaaatacagctccttgtctttcattgaaggtgattcagacctttactctacctttaatatagtgacccaacattaagtggcatatttttctcttcttccactccctcccacagcatatatatgggcatatatgcctgtgtataggtgtatccacctgggtaaagctaatatctaaagctgttgcactttcgttattagaaccttctttctaagaatcacatgatatttggttctctgtttaaccttcactataagaaaaaataaaatcgtgaattttaactctctgccttgaattgggatgggtgcagtttacatacgtgtggatcctcagtatctagccattgtagagtgcacagtgggtgctttattaatattcaaattaggttataatatttaatcagatggatattagttcagctccttcacttttgatatttaaaaacaaaatcctgacatccacttatttatgtgacttgtgtaaaagacatgaataattattagtagatttgggaccagaaagtggttttgttgattcgctataccagactgccttacaattttaatagagtgatagacggtaagtagtgcttgccttttaaatatcaaagcccaattatttactgaagaaaccaagaatctcccagcaatatacctctgtagctcagttgtgggtcagtgttgatcacaatctgaattaaagttcttttatgaatgtcaaaggcccaaaacagtatagcaaggcaatagagtggagtggctagcactagaatcttacagattcatgtttgagctgcagctctgccattactttcttttttatttttaaattttttatatttatggatacataatagttgcattgttcttaccatatagtagatactggctaaaagtaagccattagaaattcatagtgaatacaaggtgctcagaactttaaaggtgcaaattgtgaatttttatcttcttaatcctggaagatatgctgtggtctttttttgtttgtttgtttttaattctactgcatcttctcgcaacactgtggtcttttaaatgttgtaggttacctaagaacagccttataaaaaggattttactttttcaatgagctttttatattaatagaatctcttttcttaatttactatcatctccctcaactctgttgaaatttatttctgtttttgagaagaagcattttgtcactgtatacatgtagtgacccttttctaaaaagtcttctccttagcattaattttacatgtttttatttagtatttcagtttcttgaaatatattcttagtacatgtaactcatgtcaaaagagggaatacagttgtcttgaactttttccccagaatgtaacctcaactggtccaggaaactaataacttggaacagatctttctcagagttgtagtatctgatagtccagagaattcagagaatattattgggtccaatataataacaataagagaaaataacttgacatggaaacacaattttttttaataatagttctttcagagggagctcatcaataaaaaatatttagtaccttttacattgtaattaattaatttactaaatttagttagaatgtctgctcaaactcactaaggccaccagaagaagttacttaatcctggaatatattctgtggtcttcttgttttaaaaattctactgcatcttctcagaatgctgtgatctttcaaatgtcatagtttacctaaaaacagctaatagtctattactgctggtagacttaaaatcattctgatatgaattagaaaataatccaacatttgctaatacctaaataaatactgttacctcctaatggatatgtatgctatagcattttctaggtttaaaaattcattagtagtagtgaaacaatttcaatattgtgtttttctttgacaatgattttgagttacttatttccagagtaatcccattcattcatagttactttgctgacttgtagctttgaaaagctaaaacttgaaagaagccaaacacctttatagaaaccaggaacttcttatgcttgaaatctaaacagttgcatctattccagttatctctgagctttgctaaataattgattaaaaaaaaaggaaaaacctctgaaggatgattaggatttctttacctttagtgaaatcagatgattctgtttgccgtttcctttttcatgtttgcaatattgaagtaagttttataagttatcttgtctgacatctgtttcaagtatttattatgacaatatagaggtttcaagagagtgacaaggcttacgattctttttccatgtaatagtcatggaattcatgagattgctggctgggtcacagaattcatgataattgttggccaggcatggtggctcatgcctgtaatcccagcactttgggagaccaaggtaggtggatcacctggtgtcaggagttcaagaccagcctggccaacatggtgaaaccccatctctactaaaaatacaataattagctgggcgtgatagcgggcacctgtaatcccagctactcgggaggctgaggcaggagaatcagacttgaagttcaggcttgaacccaggaggcagaggttgcggtgagctgagattgtgccaccgcacgatccagcctgagtgacagagcgagactccgtctcaaaaaagaaaaataaacaattatttttacagcaactataatatagtagaatgtcttaaatagtatgacctggtggtaaaaggatgggcagtttaacattagcaagtattttgttatttttcatatataatcatggaatttttaatgcagatttttaatttgtgtttcttggaatgcctatgcaggtaatgtattgtatcacttgtaaatactgttttgttcaacttaaaaatacacaatcactatgctaaaaaaatttttttgtacttataaagactttatagctaaaactgtattgattaatgaagtattatttatctgacaatgttttcaaacttttattaacctacaaatcaatgtattggctgccatttgttagattcatgtgttcttatagcagctgtttatcatcatcatctctccctcttttgaataaaatttcataaatcctggtcttttataggtagttttatatcactaccatttcaaggatgctgtgaagaacttaatacattgattttttttacttgcccactcttgaattgactgtaaaagttagtgctttcagtttcgattaaacatcttgtttgggcagttttaaaatacctactgttttccacatttataggcttgtcattttacagttttatttaacttaagcagaactgaattggttactgtagcaaacttattcttcaataacagcttcgtccttttaaaagtaaaatagaatctgttaaataaacttataatgcttttgaatataagcaatgtctatgaagtgctcaacacttaaaaaaaacagcctttttttattggaaaaaataaaagtgtcacagaatgaaactttatggaacagtaaaggttatcttctctaaaaaatggaaaataacttttaataacaatatgagcaaaatgattaaatattgaatctgtagaaaagtccagaaatacattgatgtggcattacaacatgatagtggactttccaagcatttattaccgtaaaatatttttgaaatactaatctgcaaattaaaaagttacatctagcaaagatattttctactactaaagtaatctaggctgtcttatatctttgatacattcgattttactttatttttaatggtctatatttattatttttcttatattagcataaaaccaataggttctatgtattagaattttatgccacaaacagcaacttcgctgtttacagcatataattaagcattaaacccaagatttctgagctctggtcatttcttaattaattgaggcacacgcctacttaaaaaaattggcccagatccttagaaagaatgaataaatattatgcagaagaactcagactttaatgtttaggtgttcctgtaattgtctgcaagtttctctgtctaatacatatttgatatcttttgtctctggaacaaaaagtagaattttcaaatcatatacgtgagatttaatatctattccaatgtgcagatggattatcttgtcttcacagtgtttctgtatttatagcatctatttatgtaaatcatatctccttttataacttgtttcattgcctgtagttttagtctgtgttcttcaacctaaatttttgtagatttgtaacttgcagcttaaagcaattttacagagttcagatgttgaagaaaaagaaatcctgcactttgctgccctccagtggattatccagcatatatactgcctgcaatgaaggatctttgctttatcacatccttttacattcttttataagaattagtgaaggtatctgctttttaaaaaaagatattcttatagacccaattttaatagtactttttttagaggcagggtctcactgtgttgcccaggctggagtgcagtggctattcacagactctatcatagcacaccatagcttctaactcctggctcaggcaatcctcccatctcagcctcccaaacagttgagactacaggtgtgtaccactgcacctgactcttaaacagcattttaaatatgctactagttaggtcacctccatttatttctgtaaaaagaattaaaactggttgatgtattgcagattttaaaatcctgagatgcaggtatatcctgcaacaaaaccagatgtacttctgtgtatgtaatgtgtctaaatctgtatatttctttacttaaaagggctgtagttatttggttaacaaacagttttttaacatgtatctttaacatgtatttaacatgtgatagaggagagaataggaaaaagaatttttgtatttatgaacctacaagcaaagattgtgatttactcaaattacagtcagtctttggcggagctgaaactaaaaagtgagtcctctgtcttccagggccagtgtggttcctgtgcataattcttctaccttcagccaatcataaattattccactgccatgattgaaagattggaagaattcatatttgtagatacctgggacattttataaaaatggtataatcactacactttttatgtcatccctcaaaagagatgcatttctacgtaaaacatggatgtaaactggattatagggtgcagtcataatgaaccccaagagcatacctaaaatggtctctcagtttaacatgtcaccctgatcttttctgaatcttgcatcattagattgccacatagccttctattttacgtggaagatgttatgcctgtacttttgtagtattagcttagtagacagtatttttcttttgggatttccagcatttagcttttttgaacaaaagggatacttttggtttttataagaacttagagacagtattatcagattctgatgaccaatggttttatacttcagcctctgaaagacattatatataaatatttgttggtttttaatgtgaattttttgtcctgcatgccaaaaaaaatgttttattttaaagaatgagcctattagcccttgcctgagatcttttcacagctattcatccagtcattataggttgttagccttgccaaataatacttaagaaatatgaaatttgatagaggatataatcttctaaagcaacaatttgttttctttcaaccaaagaaaactgggtgtggtttattcttcattcattcattcattcaatgaacacttatctactatatgccagtcactattctaggaattggaaaccaaacagaaaatacctccagctcttacagagctacattctagtagagggaaacagagagtagataataaacataataaatcatttaattagaaagtgagtgctcaaggggttggggtcattaagggaggccccactgagaaagtgacatttgaacataagacttgaggaaggatagaggttctaagccatgcagatatacagcataaaagcatttcaggcagagagaatagcattgcaaatgttcatgttaggaatagcaaggagggctttccatctgtggtggagatgtaggagatgaaagcagagataaatatggtggaggatagagccacttttttgatgccttgcagaccattctaataatgtgggcttttcgtctaagagaaagatgtaagactaggaactgggcaacacagcaggaggtgagtggtgggccagcaagcaaagcttcacctgcgtttacagtcagtccccatcactcgcattactgcctgagctccaccttctgtcagatcagtggtggcattagattctcataggagcatgaacctattgtaaactatgcatgcacgggatctaggttacacgatccttatgagaatctaaagcctgatgatctgtcactgtctcccatcacacccagatgggaccatttagttgcaggaaaataagctcagggctcccactgattctacattgtggtgagttgtataataatttcatcatatgttataatgtaataacgaagtgcacaaaacatgtaatgtgctcgaattatgccaaaaccccatccccacccaccccccagtctttggaaaagttgtcttctacgaaagcagcccctggtgacaaaaaggttggggactgctgacttggaagattttgaacacaagagtgaaatgaactgatttacatcttaacataattcctctggttgctctgttgagaatagactagtggggtaagagcggaagcatgaagacctgttaggatgctattgcaaaaatatcagtgagagatgatattggcctgtaccactggggtggacagggagaaagtgagaaatgatcctatttggaatatattttgaaggtagaaccaaaaagacactcctagaaagggatatgggaaatgaaagaaagagaggtcaagggtgactcttaaatttggaacctgagcaatcaggtaaatagtggtgctatttaatgagatactcaggtctgagaaaggagcagatttggggagaaaaacaagtttggttttggacatgttaaatttgagttgcctattaagtgttcaagtagagatgttgaataggtagttggatacatgagtgttataatgatggggaagagaccaggctagagataataatttatgggtcatggacgtatgtattttctaagtcattagcttggatgaaattacctcaataattactataaaaaggaaaatgggtcaaaaatcagttactagggtattctagccaacatttaaaggtcaggaagaaaaagagcaataaaggagtagccagtaagctagtagaaaaaccattgaagtattttatcccacaagccaagtgaagaaaatgttttaaggggttatcaagcatatcattattattgtaccagcatgctatatcctgagagattgagctggatgtgggcagagaatgaaccactggatttagtaacatggagattgttggtaatcttgtaaaagcttgtgtgaaatcggttttgaaaggaggtgaggaagtgaggatggcaagcaactcttaagttttgctatagtgaagagcaggaaaatgggatatagctggaggggcctgtggggttgaaggtatttgtttttgttattctaaaaatagaaagccctgcagcatgtttcagtaggaatgatccagcaaagtgggaaaaattgaagatgcagcttagggctaactgtagaagcagaattcttgagtagacaggaggggatgaaatctaaggcacaaatgtaagagtagtccttaggaacaaggatgatatataagtaaagttgtaggtatgttgaaagatgtgatggtgggacttctggttgcttctcagcaacatattaggtgacttgtcagatgagagtgaagaggtacagagaatgttggagatttgatgagagaggaaaggctgaaaacagttgtctcagaatgcgaattaactagagaggtttctaactttggtaactggatagacgtcaatgttgttaagaatgggaatacagaggagaaatcatctatgcattgatgtgctgggaatagcaagttcagtgatagacatgttcatttggagatgcctctgattccctcagaatgtgcaggatgtgaagaaaacgccaagaatggaatcttagaaaatactaacatttaaggaacagagtcaggaaagagtgcgtaaatagaggcactggaagagcagggtcatgaagtttagaagaacagagagtttgagagggacaaagaggacaatagtagtgtgtcctgaattgattcatttgcaagcttttagttggtattttaattttaatatttatggtttattttgatgagcattagaaaatatatttagctggtacataaaacctctgatttatgaaaaatgataatgattttcccttttaacctaaattagtgtaagattagactttagattcattaaagaaaaacattatgttaagtaatgatactgctagctatggaaaaatcatgatagtaattggtaaatgaataaactgtgggaagctctgggtttaacagtttagaaatcattggtgacttcattttatcaaaagcattttctataaaatgaggaaatagctacactaaaacaacattaataaattttagaataatgaaagtattaaagtgagctctctatatataattgaattacttttagagctattagatatagtttctaaaatatagctcattttatcctgttacttagtgactaaaataactttaaagcaaataggagatgaaaccaataatcattctttttcctttttttttttttttcctgaggcggagtctcgctcgctcttgtcgcccaggctagagtgcagtggctctgtctcggctcactgccatctccgcctccctggttcaagcaattatcttgcctcagccaccccagtagctggaaatacaggtgcccaccaccatgcctggctaattttttgtatttttggtagagacggggtttcgccatgatggccagactggtctcaaactcctgacctcaggtgatccacctgcctcagccttccaaagtgctgggattataggtgtgagccactgtgcccggccaagaatcattctttaaaaaacatgtaataataatagaacacaaatgaggaaagctttctttaaaaacttcatttgttagaaacatgaaaaggtggctgggcatggtggcttcacgcctgtaaccccagcactttgggaggccgaggcaggcggatcccctgaggtcaggagttcaagaccagcctgaccaacatggcgaaaccccatctttactaaaaatacaaaaatcagctgggtgtggtggtgcatgcctgtaatcccagctactgggaaggctgaggcaggagaattgcttgaacccgggaggtggaggttgcagtgagctgagattgcatcatcgtactccagcctgggcaagagagactccatctaaaaaaagaaacatgaaaagttaattgtgtatttttaataaaatagtagaaaaccttgatgggcaattgaagaaatagggcatttctcagaaggatagtctaagccctgtaagcaagagggggtctgttttatatagttccccctagtcatttaacaaggtatttttaatatggtttgttgctgcaattgtatttcattctccttacaggaactgaagggggctgacttcttgttatatacacttgtgtgtagtgagttaggcaagttcattgcatgttgtctaaatcttgagttttcattcatcattctagatgttttggagacatttcagtttatgtaatgttaagctttgccatcttagatagcaagcatttatacaactcttctccattcagaaagatgattctagctgggcttggtggtgtgcatggtagtcccagctacttagaaagctgaggtgggaggatcactggagaccaggactacgaagctagggtgcaccctgatcacaccactgcccttaaacctgggaaacatgatgggacacctgtctcttgaaaaaaaaaatttttttttaattattctaattggcaaaatacacaacctattctacgttggtagagtgggctctttttaaaatttctaagtgatttgtgcctcagaaaattatgtttgctttgagacagttgaaatgagttcctagttttagactatttttttaaaacagcaccaactatgtaaaccccttttcatatttaatcattgtatgatctctactcagttccatggtctgatggatataaagcagcaagtctggtaatcattagaaaagagcattcgtgagattttaaaacacataagactgaggatgtctgccatatatatgtgtacatgtgtatgctgtttgggtttttctcccccttttttctttcattgttagtatttattactagtggttgaatttatttcatactgagccactctttggccaggaaaatctcagtaatctgttactaaccagcaaagtatatttaattattatctcaaagatgcaggagaaatttaaatcacatttcacagatattgaaaaggccatagctttggatttgtcttcccgtttagttgccttttataggaacaaacctaaatttgtcattcaaattttgccatcctttaaacctctttagctgtcaggctttgttaataacccagtcaggtcacaaatatacagtgagatgattatggaaaataataagcacaatttgcctaagtacatttcaggaaaaagagctagaggtccgtagcagctgagcggatactgctgtcaagcaagttttctgattcctgctgcacctctgtaataataaagccctatttcacttgatgatgagaaatacagctagagaaaaacctaatatgaacaaattaataatcaattcaccacccctctcacagtacactggctaaaagccataaatgttgaaagttgggagagactgagtaagatcctggaaaccatgttattacctgcaaagtggccactgaggtgagtgcaccaggtgactttcatttggtggcataaagcaagaggaaacaatatgtaacaaaaatacataatatcatcatgtgcttttcactttccccttgatcatgcattggccatatttacttacgggtaagtagatatgttcaaattaaagtgcctatcttaattccatacccttgaggcaggatctgcaatcagggtattaggaaactttattactgagatccatccacaagtctctgctcataacattgtttgatagagggacttcagcgggattttttaaactttggtttgaatatcatacttgctacctctaccaatgcaaaggacatttcctagtgcttgatctttttccttctatctaggacctatgaggtattactagactcaaatcttgatcaattatggaataactaggatcttgagttctcatttcaagatactgtccttgtaattcacttaatttgaggagaaaaaaagacaaaatagcctttataacttcattagcctcagccttgctctatatccttgctctagggaaaaagacaagcctgataagcccaaaaagtgctgggcataattaaggattggtttctgctctcaaggagctaggagagtcttgttaaagagttgtgtaatgtacaaggtctgttggtttaaatattatatttactacctataccagtggtaagtttaaatatcatacttactacctaaaccaagtctagtttgctagtaagttttaaataccaataccatattttaaactttggtttaaatatcatacttactacctataccaatgcaaaggacatttggttggcctaaatatcatacttactacgtaaaccaagtctgttggttttcctactcgatcactttcctgtgtgtcagcaggtgaccacttgtagcaggaaaaaggagaggcagatggtaaacactaagggttgtgggtagctaggaaatctaagccccctccgactgtttgtatgcttgttctgagtttaagaattgagtgaagcagactcactgtaagagtgtgtgattgaatcagaaagatatgttgtattttactcactgaccgtaagaactttgtaacatctgccttttgcagaatccgtggaaattgtaccaaatcttggtaccaaatgatgatgctattgcgggtagttaattttcttgactacatacatcctgctttgctagtttgatgagttagcactcattgctttctgcagctctatcccataactctccagctctttcccacaacacatacacataaaagtaccaattttacccatctttcaagacccacttccaccatatgccttacttgatcttctaattataagtaatgtgtaatcagacaatttaactgtgcctctcctttggctcctgtgacttgccatggtagttatctgtgtacatcatacaactctctaacaagactcctagctccttgagtacagaaaccaatccttttttcatctgcataccccagctcaccaagcattccataccctccccccaacatttagcacatagaatattctttaatggcaaagtagctgatgatatttcaagtctgaactactcagataactaagtattaaatgtaataatgagtaattaacttgtatccacccaaagtttgcccagagtgctttctaggaaacccccctcaatatacataagtagatacaaatctccttttaaggtctacagttcccactgtaagagggggaagaaaaatggaattgtattgtcttactggtccagtaggagctaacatgtctgacaagtggcctgtattgtcccaccttcagtccctcctgtttttaatgaaagttataaactagtgtctctctcgaccctcattgaaaactaacacctatgagtcagtctcaggaagtctgttgaatttgtttccccagtattcttgcttaaagaaaagttccctaggctgaagtaagccagagatttaaattaaaaaaaaaatagctatgtcagttaattttctttttcaatataatttctgcatggaaaagtctcatagtaaacttataatgaattttaaatttgctttagatatgtaatctgatcatttacctttctagaagcatttataactgctgaaagcctggattcttcattaaaatagtttctaacacagcctacatgtcatggtatctgtgtctcaactggtgctgactttgctttccgtgctgtagtcatttaagagaaggccacatggcaagaccaagaggccagatttatagccagttctcctttctctactctaaaaggcagcagggcatatgggatgcaggggcatataggtctgcagaaaccaattcagctctaaattcttgggcaaagcaagtttcaggtgtgaccatgtgtgaacagagtatttcccaggacagaatttaactccagaatatgtagtaaaaggaaaacacacacacatacacattcatatttgggaatcacatacttttctttctttccttcttttttcctgtaaactcttctgacttaatcacctcaccaggagagagtgctgatttctggtctttactatggtctgttttctctttgccattgtacttttgaggtcagtcagcacataaccattattttaaaaccttctgcaaagaatttcattcagcagtaattactgaatgagaacaagtctaaggagccattatttctgttcaaataatttcttttttctttcccaaatagaggatagaacagggcagaggaggtgaggcatcttcatttgtctcaggtacagtcatcagcaacctaggtttcacccagattcaggttctgtatgcttatattagcagtggtttcattaacgacgtttcccaagaatcctctgacagtaggacagtagtttgtttctccatttcagagtaaaaaatcctagacacagaaatgtaaattgatttgcccaagtttgtacagtaaggctgcagccaaggcaggatttgaatttataccatggaagtgttcctcttggtaaaaggtctgttagactctgttacaacctctggaggtgaaaatcataaaggtatctattcccagtaaggtctccttttccctcagctatacctgttactctgtgtggtgccaaagtcccacatgtcacctgtagtaaaagcttcctggtaatatttttaagtaattttgtataacagtggtgagcaactgaaagatatatttttgttcacttcatggtattttactacctcttctaaaagacagattatattttactagagataaatatgaaatagtgttattaggtagcttaaattataataaaaggaaacagtcaccatgtgtttctgagctacctatttccaaaagaaatcatttttaaaactgcataattttgagtgcagttgggtagaaaggtaaggagaaaatactatagaaaaagtcactcatatctgttaaaaggatgatgatgtctgtattttccacataggtactttaattgaatatatcggaatgcttcctgtagggtaacctttctgaaaggcagaagaaagtagactgtagagtataatataagcctgttggagcagggatggtaggaaaaccgttagaatattccactgtttcacaaagactacttttctaacatctttgccttaaattttgaattatagctcctattacaaatcagtttattatttatgtcttagaaattagttttataataaattgcatgggaatataacttatatttactgtatgaaaacaaaaagtttggggaagcttcgactgaagcaagattaacaaactagagggggctgagcacagtggctcatgcctataatcccagcactttgggaggccaaagagggcagattgcttgagttcagcagtttgagaccagcttgggcaacatgctgaaaccctgtctctacaaaaattacaaaaattagccaggtgtggtggcgtgcacctgtagtcccagctactcgagaggctgaggtgggaggatggcttgagcctggaaggcagaggctgcagtgagcccacatcatgccactgcactccagcctgggtgacagagcaattctgcctccaaacaaacaaaaaaaactagagggagggagttgttgaacagcaaagaagtaaaagactataggtaacatggtacccatagcctattttcatattgtaaggcagtctgtctattaaaatgtcctttagagagcacagagcctactgtgagactaatttctaagtgtactaaatattttggggcttagatatgctaaggagtttgatctgaattaatcgctgctttcttctaaaagattggtagaaatggactctatactgcccccagcatcccctacatacacgcacacacacacacacacacacacacacacacacacacacaaagttgaaattatgcagatacattgataacttctttttttaattattattattatacttgaagttctgggatacatgtgcagaacatgcaggtttgttacataggtatacatgtgcaacggtggtttgctgcactcatcaacccgtcatctacattaggtatttctcctaatgctgtctctcccctagccaccaccccctgatgtgtgatgttcccctcctgtgtccatgtgttctcattgttcagctcccacttatgagtgagaacatgtggtgtttggttttgtttctgtgttagtttgttgagaatgatggtttccagcttcatccatgtccctgcaaaggttatgaactcatccttttttatggctgcatagtattccatggtgtatatgtgccacattttcttaatccagtctatcattgatgggcatttgggttggttccatgtctttgctgttgtgaatagtactgcagtaaacatacgtgtgcatgtgtctttatagtagaatgatttataatcctttggttatatacccagtaatgggattgctgggtcaaatgatatttctagttctagatccttgaggaatcaccgcattgtcttccacagtggatgaactaatttacgctcccaccaacagtgtaaaagcgttcctatttctccacatcctctccagcatctgttgtttcctgactttttaatgattgccattctaactggcgtgagatggataccctgataacttctaatagcaggttaattgttcatactagagattctgagttggctataactaaaaggccttattttaaaaagattacattgggataacttactattccagtgcagcttttcagggagtcagggctaataataatagcatcttaccatgtgctacgcaatggtctagctctttgcatgtaattctcaacaacctaatgaaatggatattattattaagctcaatttgcagccagtgcagtggcacacgccaggaggctgaagtaagaggatcacttgagcccagcagttcaagtccagcctgggcaacatagtgagacccccatctcttaaaagacaaaaacaaaaaactcactttgtagatgaggaaaacgattcacaaaaaggtaaagtaacttgtcttgcgccaggctgtacccataaccactgctctaatgctcttacaaagttttgatgcctctcaattcatttgtggcatttctttattataactaaccaaaaagcatcctaagttacccaaccaggaatctctaccaatatatgagatttagaaggtaagaattctttttaacaaataagtggttacccaactctaattagaaagtggaaaatactcttctagcaatttgtaaacaattaagatgagaagataggagatcctgagaacttagaatactttgaaaaactgtttagccacatgataaattgtgactttacccgtcaggagactttactttgacaagtatattaaatatgtagttgtttttgcaaacacccttgtaggataggttagtattaattaccctatttatgcaggagatatctaagcatagaaaagaatgttaatatactaggatctcatagtagttccagaatcagaaataccctttttggagttttatacttagttgatagtcttgtagtctcttacttctaagaaaaaccgaactgccaggatttgaattagatgctaaatgctttgcaagcaagtaacagcattaaacacagaaaagtgttttccattttcacctgggacctcgttacctaaagcattttgtttaaatagtgttgttcctttaaagaaaactcatacctctcaaggttagtgtaagtcatagaatctccccatttttgtgtcagcaaaaaataagtcttatgcatagaagatgacttgctactttccaggtatctttccatttttccttctccaatattttcctgtgtttctttcatgagaacatcattccgacctctgccaggaaaacaggcaatatttttccacaaaggcaactttttttagttcccctttgagctggagcagacctatacggtagtctaaagaatggaaattttaagttcttctgaaatacttcacctacccttagaaactggaaggagtaatttttaaaattagataattcaactatcgccaagctacatatgcaaatcacatcaaaaccctaaaccggtctggttttttttgttggttttttgggtgttttgttttgttttgttttgttttgttggagatggaatctcgctctgtcaccaggctggagtgcggtggcgcagtctcggctcgctgcaacctctgcctcccaagttcaagcgattctcctgcctcagcctcccaagtagctgggactaccggcatgtgccaccatgcccagctaatttttgtatttttagtagagacagggtttcaccatgttggccaggatggtctcgatctcttgacctcgtgatccgccttcctcagcctcccaaagtgctggaattacaggcgtgagccaccgcgcctggccaaactggtctgtttttaacagttgagcgtaagaacgttagtattcacaattctactcttaaagcatgtagcttttatgtgatcattttgatgcctacttccaagaaataccctaacataaacctcttactctttttttattcctcctgttctcctcccgattcttcttctcctctccctctgagagatgttggccccaattttgtgaatttgaggacaagacattcttagaatgcacatggcttgcacaagatgtctgagtttgaggtcatgcagaaggagtaatttagcttcagggtcccttgtgcacataatattttataaattacctacaagatattttttcgtattgcataagtttaaaaagatgagaccaattaaatttttactgtgggcagagggtgggagagaaacagaagagaatcaaatgttgagggaggaaatcaacttcagaaaacacagagtttcactgggttccagtcttaaatgtttgtcgtttgcttttataatgttttacacaacatgtatcaatgtgaagaatgctttaatcagcatcattgtcataattatttcctctctgcttttaatagtcgtgcttatttatatcccaattaagaattgtctctgagaagtgtgatgttcttcataataaattatactcaattgggtgtgcagagttggttgatgtcattattctgttttattttaatgctcttatgtttagctcccctgacttaactacacataccagatggtgaaaatagaagtggaggcaaattaacaacctctgtcctgtcataggagaatctggagaaagaaagcaactaccattgctcatggcttctttcccattagccctccatgggcggggacacacacacacacacacacacacacacacacacacacacacacacacacacacacacacacactctcatggcctctttcccattagcccttcatgggtgggcacacacacacaccacattcagtcttttacaagttgtacttttcactgctcccaaacacaaatgagaattcctgtgcctgttgctttgcccaacacattattcttccttgcctagaatgctgccttccctactgatcggcggggggaagcctagaagccttgtaataagataaacctgatccagatctcagatctactacttacttttgactttaggcaagttactttatttcactgagaatcggtttcctcatttctaaaatgaagatgcacatggtttttatgaggataaagtggaggaaaaaatataaagcattcaaaaaatatttcttccatttcatgtagttccccttttataagtcctgcctattctttaaaattcgagttctaactactcaaagcttattctctgaagcacttatttggaacaagtattctttgctgtcttgtatttactgtctccccaagttgtttgtcgatttcttgagagctaaaactcttaaaacaaagaatcctcaatttctgacatagtcttgttaaatatggtagcctccaatgtataatagtgtaaaagtggaaaatggaaaatgactctctaagcatgtggtccccttactctaaagtcattaagttggaaaaggttttgagtccattacattttcttggcacagtaagggagatggcattagaagtacttccttaaattgtgaaatctgaaagagagccatcagtcaagaaagagacatcttgtgtttccactcatgtggagagagcttgatttggtgaatctgtacacacagataagatgatagatagatagatagatagatagatagatagatagatagatagatagatagatcggtctatctttgagacaacattctctaaaaattaaacatagaatgtgtttgaatgttctggtaaaggagaacagctacttacacactcttaaccaaagaattgtcctctaacaggaaagttgtgattctccaatgaaaatgcattttcattgacaatgtccatggaacacaagggggaaagaggacacctgttcagcttgccagatcagctagaactaatcaagggtagtcaaaggagggacagatgtcagccagattgctgccatgttagatataactatctggtaacatactcccctacccagagaatgaccatcaggtatagctgaatagtgggggtttgggttcatattaacacaaaactcttaataggatcaaaatcctttgactcacaggtaaaagtcgccatagaggtcattcccactatacatgccgaaagttatttttattgatatgaccagaacctgttttccaaaagaaacattgcaaaacatttccaaaagttatattgcagccttaattgttgactttctgccatcatccccctttaattctttggcttttaatttttaataattcctcaccttttggtatatctcattttaagccatgatgcaaaaatagtatttttctctgctataatttatctcagacttatccaggtattaacctgtcatttctcacaaatagaaggaaagctttttgatgatatttctaacttcaagaaaatatttcatggccattatgaatggaacaaggtcttggggcttgatctttgttgttacagttgtttttctcctcctaaatacttgacaatagcctacagctgaaacttgaacttcagcgcaaaatcttgaatcacagtaatgatctggctttgggtgctgcagctcactgatttttgtgtgttctgctgaagaaaaaccggcattgtcacatttttgctcttcttgatattttaggaccttgtactgtagtactacacgagagatatttctaatgtgctatatctgtgtctcttgtcattgaggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtaagttgatttgacctgagctgtgcttctggggaaaaatcaactctcaagctttaagcttaggcttttctctacttttaagaatttgttttcttctttaacaatcattatattgtagcatcatgagggtgacccctaggtggtgaggcagaagacaagctttagtgtgaaagtgttcacacctcagtgtcttctgttgctagaacaaatctgatttgtttatgtatcagtcttcttaatgttactggtatattgagtaaatcattataaaaggaagataagttgcttttacattaaacccagtaaaatatgaagatttggaatagtgggcttacctattacgccctctcctaagattccattttatgacccacattttgagctatattgtactaaacagttcttgctaagattatcagaattgccaaaacgcatgacttctttttagtattcacccacttgaccactttactctatctggaaccatgcataactcatccccacttcttgaaactctctcctttcctcttggcttctggaatatcacttgctcttagctttcttctatccacacatcatcttttaaaatttctttcacttacactttattctgccctttatttgttgggttatccaggatcctaactttgaccttctattctcatccttctatgtattatctcttggtgattcaaatacccttgactacaccaatgtctccagacctatatttcagctaagacattctctacaactccagatcttatttctactttttttttttagcgtactctttatctggatgtgccataggcacttaaatgtagcatatccaaaattgaactcttcttcatattggccctattttctgaaatgcttctaatttctgtattcctgatctctcttaagaacatcacaactcacccaggcaccactgtatccagtcagtctctcagacctgttgcatctatatctcttcatttattcccactgccactgcttgaattcagactttcttcatttctgcctacactattgcagtagcgtcttaatttggctctctaaatctagtcttttattttagtctgtatgtgaagaaagagaatacatgtaatcaatacagaattttaaaggcggaaacaaccactgttaactaactttttgtgcgtccaaagagttgtttctaaaatgtaaatctgatcagatttgcaagttacttaatcttcctgagcctttcttacctcatttatttaaaaacaaaccaacaaaaatgctgtatagagtggttttgagtatttaaatgaaataactttgggaagcatttattttagtgcctggtactcagaacccagtaaatgttctacaaatgtagatataattgcatcttcaggagtcaaagtctttacaaacacatacacatagtacatgatcagtaaacatctgttcagttcaagggagccataatacatttgcacaagaattgttacaggaaagattccctgtttgcttttctgggttatctactcagagttcccagttttctcttgctatagtgacccagctaaaaaaaggaagaacgccactggtggcaacaaatacttatgattattgttttctgctcagaagagaatgatttccctacctaccttaatccgaatgatttaatctaagccttttgcgctttctgattactggcttgaaattttatgtcattgtttatatgttaaattgtaagcatatctgcagctttccaatctgacttcaaatcagatcactgccttttaaagagaaccctaggactgaagacagaattgcccaaggccctatggtggtaatctttttttgaggagtctcactctgtcacccaggctggagtgcaatggcacgatctcggctcactgcaacctccacttcccgtgttcaagcaattctcctgcctcagccttccaagtaactgggattacaggtgcatgccaccacacccagctaatttttttgtattttagtgcagatggggtttcactgtgttgcccaggctggtctcaaagtcctgagctcaggcaatccacccaccttggcctcccaaatgcatgagccacagcgcccggctgtatggtggtaatcttaatttggaatcaagtttgtctaattccttagaatactctttctcttttgtgagacaaagggacatattccttctacagtattgttattaaagatagtatgtgccttacttgccttcagaagccacaatcttaagtactctggcacccattgatattactcatgcaagactttctggaggaagatgttgtcggtcagattttgttggccatctctttgaatttgtgttctttacctctttctatggctgtgtttacttctgtcttgttttgaatctagcactcatctttccatcctctgctccctaaactccttgaaacttctcttccaagattgttaatgttgtttcttatcaaatatagtcaccttctgttaattggcttctgatattccactccctctcaatagtgtcctctgcagccattaactggcttctgtttctactccaggtatgatgatcccagtttcttcccggataaccattgtcatttgatccaaaagtctttcctaatattgagcctctcatttctagttttgtcttatgaggctaacagcatcagtcttgtttctcattaatagcacattcccttaggcgttgaagatggttattgttcctgcctaccttcctttcctatgtctttgcttctcttcagttaaatgtcctcacttccttgaataacttatgttatggcatctagtctcttcattgtctttgaagtaatctctttggaatttttcaaaatcttttcaagcccgaatttttggtgcaatatatcagctactcttcctgccactggatccccgtcgacttcttcagtctgtcttcatttaatgtggttttgagtacttttgccaagtatattttctgtgaatgtgctctgctttggatatctcttaaagtgaggtgcacagacttaaacatgaatctccagatgtgtgtggaacattacaagcttctttttgttttcaacaggactacatatgcatagcttcatgtcttgtttttttttggtttttttttttttttgagatggagtcttgctgtgtcgcccaggctggagtacagtggcgcaatctcagctcactgcaagctctgcctcctgggttcatgccattctcctgcctcagcctcccgaggtggctgggactataggtgcccaccaccacccctgggctaatttttgtattttttaatagagacagggtttcaccatgttggccaggctggtctcgaactcctgacctcaggtgatcctcccgtctcgacctcccaaagtgctgggattacaggcgtgagccaccgcacccagcccgtagcttcatctcttaacacttctcctagtccctgtgattcttgatagtacctaatatggctcagatacaagtataaaccttcccactaccctggaataggcttcatctcagtaaaggatgtgaactcatataaacctcactgtggatgctcacattctctccaacttcacaatatttattcttcttcccagtgtgaaaatggtgcttggtaacgaaaatcaagaaaaaataggctctgttttcagtttatatcataccatctgtcctacaagcagcaagcctaagatttacttattcctcttgcttcaagcataatttgaaaccttctgagatctctctacaatccagacctttcaccaaaccagaattcggtattttcagctgtataggacagttgtgtaggacagtgttctatataggacaatatctgaagatacattcctccatccattcttgtctagactgtaagttccatgggttgttacaaccccagccctcagcacattgctagatacagcaacaaacattttcatgaattaatgacaagtgtctacaattccaactctttatcctgttgccctttcctaactccattgtctttataaatatcattctgtttacatattcacagattctaaacctatagtcatatattaaaaatcccagtttttcacattagactgaaaaatcttgaaatcacctttgagcctatcctattactaatttttctccattaacatttccttgtatacctctttaccctctcttttttaaagattccttttccctttaccttaagacaacctacttctgtaactcttataaagattattcaatacctttctaattggtctctttgtcttctgtcttctctttccttgtccaacaccccagttccgatacacaaactgatttactactctaagactttaacctttgtaattattatggccctcatcctgttattcttctgtttaagaaacaagaggctccctttacaacaaatcctcttcgtgactttcccacacatttgtaacatcacctaccttttcctcagtatcttatttgttactatcccctgtatacattctttattctaattaatttgaaattggtaatgccctcacatgtgcctttactatccctgtatgtatgtgtgtagacaaatgagtctatgcatacatgctttaaaaaaaaaaaattgttaactctggaaggctggatgcagtagctcacacctgaatccaagcacttagagagcctgaggtgggcggatcacctgagaccaggagttcaagaccagcctggccaacatagcaaaaccccatctctacaaaaatacaaaaaaagtagccaggtgtggtggcctgcgcctataatcccagctacctgggaggctgaggcaggagaatcacttgatcccaggaggcagaggtttaagtgagctgagatcacaccactgcattgcgctccagcctgggcaacagaacaagactctatctcaaaaaaaaaaaaaaagtccctatggggagtgacctccctgaccctctactcttatctgtttaaatcctgtctcaggtagtccgcctttctctaagaagcattttgtgattacatgcaaatattttttccctctaaaaaaaaattaatttttctcttattatttcatgtatgtagttgtctgtctccaacttgattataaattcattatatttcatttcttaaggttagaaactttccatttttttttgttcccacctacagcttacagagatagacatatagtaggctgtcaataaagtttggtttattttttgctaactcagagcacacttataatctacttattcttcacctgtgaggagaaaatataaaaatatgtacatatttagtgttgtttttttaggaattgctttcgccccaaccccagcagcctttagaaaagcttaatggctaccagcaacagaagccttcagcaagctccatattctctcttcatttgaatatcagtttccattaatgaaagcccctctctctcagaatttttaaataacgataaatattaccatatggtaggagcacaaggaagcaatcaccttgggttactgggtttgcagaactcttcgtagctaaacagcatgaattttttccaatgtgttgcttaacgacagggatatgttctaggaaatgcgtccttgggtgattttgccgtcgtgggaacatcatagagtgtactgtacttacttacacaaagctaggtggtatagcctactgcactcccgcgttatattgtgtagcttcttgctcctaggctacaaacctctacagcatgtttatgtactgcaataccgtaggcaagcgtaacacaatggtaaatatttgtgtctctaaacatatttaaatgcagaaaaggtacaggggaaatacagtattataattttatggcaccaccatggtatatgcagttcatcattgaccagaacttcattatgtggtgcatggctataataccatgttctaaatccctgaacaagccagaattaccaactgaagattattgcactagaataatgaaactggcattttgtgaggtatcaacccagagctctcaggttttcctgtgggtacatgttacaaaaggagacattttgttatttgttcttgtaccctatctacttcctaaagggactagggatgactttcatggaatgcacagtgtaacatccagccaattcaaaataaacaggaaaagttaagtagtgaagaattttttaaaagaaagccttctattaagaaactcgggctaattttgcctgagcttccttgttattcaagcttagaggagaactcaagagggctgtgtaaccttcattggataataaaggaaacatactgagttctcaggagagagaatttttgctaggccattacactgagagtcttccataggagtctttatgtaagagacttgagccacctaaataatatcttggtaatcattttagaaagaaattattgtagtatattgctatttcttatatcagccatttagtgaaaaatgggagccttcatgtagaattaggatagttttccattaaacaaatcatttttcaattaaggcaattaagccagctatatggtctggacacacagctatgtccagatacttgaataaaccttgaagaatcccatatattaaataacataataagcttcatccttgccatctatgttttgaatgtagagcaagtggatcttttttaaaaaatagtgtatcacatacctgtccccatgctcgctaataacagaatctctgactgcctgctctctagctgccactgttctcagccaggcttttggcaaacgctagatgacaaagttggtattttattatgtattttgaagatgctgaatggaatttttattacattgggctatagtagtgcctctaagcagagccaaaacgtttctccaaaagcagggttggagtcacccaaggtcttgaatgagtactgtgtaccttttactaacgtgctggcccttgaatttcaggtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatgggtaagtttgccaacttaattctcacaaaattgtagcccatgcctttcaggggatcctaatatgcaaagtgggaagtttctgttggatatgtggcactacttggctatgcactccaggacagccttcacattggaattttattgggaggaagcatttcatgttacttatgtattgctggctcttctggaaggcaggaggaaatgggatgggtgtgaagccactgtcagagcctgcagacttggaactgtccagttcagacatctttcttttcggtttcttctatacattcttcgagactaggttattttgttcatttcactaaccattttttatttaggtctttaagaattaaactcaaggagagaacttaacctgagcacagtacttggttattcttaaactagtattcacaaatcattgacagatttgatcactggtctcatttgtccctaacatgtttctgtttcccagattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggtaaatttgaatgtttaatatgccagtttcttgttttagatgtcactatctcatttctcacaaaggttgtatttgtaacttgaaatagttcagatgagatgataaaggggcaaagtgtggtcaagaaaccagtctatcttctgtatcaatgaaaaaaatgttcaaactctaaaacattatggaaatgcaaattccagtggatttaacattatgtgtaataaatcataaaggaagaaaaattaggtgaatatttacatgctctttccatgtggaaagaactttctaaggcagagagagggaaagaaaataataattctgacactggaaagtaccacaaaataagacaaaggactgaagcaaagtttttttgtagattatttttgtatatatttacagaatatatgataagcagagggtatcaatatcatttaaagagcacctacaaatcaatatgaaacatacagtatttcagtaaaatacgtgcagcgtacataggcagttcaccaaatacatacacacacacacacacacacacacacacacacacacagatggccgctaaacttgagaagatattcaacctcatcagcaatcagaggagcgcagacataaacagtaagataccagttttgattatcaaattgtttttaaatgtgtaacacacattttatttaactgaagtgaattttgcggcagtctgactagacgcatcagaaaatttaaaaatataccagttattctacttctagtaatttaccctaagtaaatcatcttacaagtgccatagatgtaagtagaaagattattgatcatgggattgcttataataaaaatttgtaaacaacataaatgttgtaattgcctaaataaatcataacacatctatgctgcataatatgcactcaagatattggtaatatagtaagtaaagaaaagcaatttataaagtagtaaatgtagagaataccttaatcattatgctatatttcatcaactacatttttttcacatttcaatatctctgaaattggaatacatcttacagttgatagtatcttatataataattgccactgtttttctttcttaaatcctgtaaaataatgtatgtttacagttggcagcatcttagatttgatgaaatatggtataataaacaagcacatagaaacaaaactagcatgaaatacatcaaaatgttataaacggtcatctctgggtgctaacagagctataggtgatttttattttcttctgtatgacttttccattttctaaatattttacaataagcctatattacttttataaacaaaaaactaaaaatttattataaaagtgaaaactaaagccgaatatggttgagatgatacgagagcacttaagcagttttaaatgtattcaagttggtgggcccaagtagggcattgaatgtacttgcaaatgagattatggaactacttattggcattaaagtgaaaagctctaaagcatagaggacagaaatactagagagattcaaaaacccaattttcaaattagtatggattctattcactgctaactaatcagcttcatgatgaatcctaaccaagttataaagcaaagtattaaatagtttgtgagcccatgggggaaaaatggagatcattaagagccattgtagattttctaagaactaataataatgcttaactaatttcatttccttttttggttagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatgaaattattaaatgtaaaagaaaattaagattttttgtgaaaattatggcttatttaagttattaatttaaacagagttaatttgaaactcttccaaaactgttcctttctgttttgttaaaatctcaatctaaacccctgcctgtacctcaaacagttttctactgttcgtaaattcctataatataaaaagcgctatacagaactaaagttctccttcctgcctattccattataactccttcagaaaacccttcccagacaagacagttctgctcttttcttggggatttgatgtaagtaaagggcccacacccaaaaggtggtacttacgaaggatattaataaacagagctttaaatttttttgtagctttaaatagcttgttgattgggaacatacacgttagagtcaaacagactcctagctctgccagttgctagccaggtgacctggacaagtcacttagtctctctgagtctctgttttctcatctgagaaatgagggttaaaacctacttcaggccagatgcagtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagagataaatgtttctactaagttggagttgtctttataaaatcaaaatacagaggggcaaaaattaagtttggtaagaatgttaacattgaagaatgccttaaccccttatttcatgttgatcaatcttaaatctagcaaaggactcatttattcttacttctccacctatctttactcagagatgatctttagttccattgcataatgacgagattttaattagatcatagatgggggaaatgttaaagactacaggaatgactagcacctccaaatacaccaatccaggtgaagtaatcaccagggcataaggccctttgggttctcttcctttgcaattgtgtggattcatggcatactttccttccaggaaaaaaacgtgactaccagcgtctgggatggcccagcccggacgaatgcctcaaactccgctgggtagagctgactgccatcgtgagtacctggcttgcagtttcttcaaaaaacattgagtaagtatgttaagcctctccctcctttatggcatttgagtcccattgaacccagctgactttaaggatcccctcttagcagctagtagaagagttatcctttctagagctgaattttcaaaggatgaccatgctgaccatggcccccaggtggacccaacccattgtagcaaagcagtgagtgtgccccccttcccggtgccttcacctgtcctttgtaagctatctagcagccatgtataacctgcttagtttgaattgaagactggatcctctctatagaagcacaaaacccatggtttgtcatgaatatcatgcagttgtaagggagccagagcaaatccagatttgcaaacacctaccaagacatagtagatgcctctgataactgctttttcctcactggacactcgctctcttttgctgaccccttttctaccctttaagtgttggagttccccaggatttaccactaagccttcttattttgtaatcacttctagtcagactgatctactcccaaaattccaatcaacacaaagatgtactaacagctcccaaacttgaatctccagaccagatctttttacaatgcgttcaactcatttgtctgtctccctgacctgtctgtctagattgcactcaggcaacccatgctcgggaaaactaaagtcataattttcttgcccactctccatattaaaaaattattgtttttttttgttttgttttttcttttcctatttttagtaaatagctccagtaatgcttaggccaaaaacctgggagttatccttaatgattttcctcccttgctcttcaaattcagcctgttaccaattcttagcacttttactccctgagtatttttcaaaaccacctacttttctccatccccattgctgcctcctcaaaccagagcataaccatccctacgtcggttcatccagtacttcctagctggtcctcttgctctgttcactcttgcctctgttcaatctattctctccacagtactcagaattcttcaaatataagtcaaatcattcttaaagcactctaggaaattcttaatgctatttaaagtggaccataaagcctttcttgatctgctccctgcctgttttttcatcctctcttttgccctctctcctgccagggctgtcacacgtggtgtctcctttgtctgtggcattgttctcactgtgggttctcagctggttaattcatactaaaccttctggcctcaacttaatcttacctccacagaatccttcactagctaccctcctccaccagtgcagaggcaacatatatcctcctggagtgtattatcattgcaccatattttatcttttataacttaccacatgtaataaatgaatcactcacaagagaatgaacatggtaacagcagggactaactatgttgttttactcattattatagtccttgtatctgacatgtaataggctctaaataaataatgagtgaatgtttgcctaataattgttagactttttaaatagctgcaagtaaaacatggcagtgccaatttgtcatattagtgcatatgatagtctataatagtaagcttgtatatggtgggaaaatgaaaggaagtacttagtcttacacctaaatacaatgtacggctgtatctctataagatttactgtctaagctttaggtaactttttctgtggggaggaatgtgctgctgtgcataaaagaaaactaaaagatataactagttgtgggtatttatcaccacttatatcttggaagaagaaatcctagaagaaaacttacttcgtttaaaatcaggggatagcatgttgaagctatgatgagctgattgttaatgctgtctctccttgattgttaatgctgtctctcttctcttcccacccactcaaaaatttcccatagctaatgtggtaatctccatttttcagcatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtgagtgctcggctttgttcaggctgttttttagcctcacagttaggatgcacattgatactacatagaaagcccaggtgaccgggccttttaaaaaaaaataggggcttttttcagttaggcatcacctaggtgggtttgggccaagcctgatttctttcaggccctgggactgagcttattattctttttttctttatgaccatggaattttaattctgatttacccctcaaggggggtagttctgccttgccatcaaataccaactcttgagaaaaatgtatggggcagttaattctcctgttgacatttttaagaaggaagggtaaggaaagcagacccaatatatacctagcaaagcatatacctagaagaattggaaaaacacatcacaagtatccaacagtagaggattggttaaataaattttggttagatgtaagatagtatacagtggcaccattagaaaatatatagaaatattcttattgacctgaataaattttcacaatatataatgtgaaaacataggtaacagtatacagtgtaattcaatattttgtgagaaaaaaatgtacatagaaaaatatctgaaagacatataaaggtattaaaagtggttgttaatacctctctatatgtctttacatgtctgaatgacaagattacacatagtttatttcatttactctgtgttctagtgttgctataatgaatgtgttttacattctgtaatttttgttaaatgtgggagagctgaggggatgataaaacagccttaaatgtgtcttccatagattaccttaccaataggaccacagcatgtatcccagaaaaacagtttgcctctgtggtacagtgcccaactcagcattagcagtatcatctagatcctgcatcgttttcattcttctaatctactatcttccttccttccaggtattacaaaatctcggcaaagaccaatatccacaacagtcgcttgaacagattggcacccgaattgccaaagttttggaaaaggtaagtcaccccacagaaaagctggaaacaattgccctccttctaacttcttttctaagttatttgctcctaagtgtctgtaacctcttctgttagttacttagcacttggtggctaaaaggataatgtgaaataactcccctcagaatgtttcagtcgctttttctatcacttgggtaatattcttttctgtctctttgcctgctttctgtggtgaaacttacctagtcagttttctcttctttaccccagtatgtgtgtatagaggtggtagtattggaaaccatggaatctaggtatatgaaataagtcagatattcttctgatggtgaagaatatttggtattttggatgatggatgggaaacacactttgaaatgtcttttctcttgaaatcatgaaacaaaatatttaccaaattgcattttcgtagagcctacagaaaatatcattgagaggttctaagactccttttcttcctctgtgtgatatttgtgtaaagaggaggggttttttaatttaattttattactttatggctaagaatctctctactttattactgtataatattaaagagctaatttaacatagtcatttaaacaatcaacccaacttcaagtatgaatgcgacactgtgagatagcaacttccttcatcttccgagtatcgcacatggaaaaatcatcagcagactccagttataatgaaactagggcaaacacatgatccccagacttcaaaaaaagtaaggattgccaaaagtggttatgatccacacaaaaaacatacaggatgaattgtagcagaattcaggcagggttagcaatttcagaaaacgtcagcaaaattctactacctgaaggaactttctacaggtagcccaaccaggaaaatcctgagtaataaaaacagagcagacacagcactgatacaaaaataaaagaaaaccggtcgggcccggtggctcacacctgtaatcccagcactttggaaggccaaggcaggtggatcacttgaggacaggggttcaagaccagcctggccaacatggtgaaaccccatctctactaaaaatacaaaaatcagccgggtgcggtggcacgcacctgtaatcccagctacttgagagagtgaggcaggagaatcagtgctaacccaggaggcggaggttgcagtgagccaagatcgcgccactgcactccagcctgggtgacagagtgagactctgtctcaataaataatgaatgaatgaatgaatgaatgagtgaatgaatgaaaaccataggaaaaagcagcaaaacttactaaagaacacacagcaggaaaatattgtaatggaacacattataattcagactgaacttttctccatggattaaaatattaggccaggcacagtggctcatgcctgtaatcccagcactttggtggacaaggcaggaggatcatttgagcccaggagtttgagccagcctgggcaacatagcgagaccctatctctacaaaaaaattaaaatgctcacacacacctgtagtctcagctacttgagagattgaggtggaaggatcgcttgagcccagaaagttgaggttgcagtaagctatgatcatgccactgcactccagcctgggcaacagagtgagaccctgtctcaaaaagaaaaaaaaattcgcctgcataaataaagatcacaaagcaaaaatataaaaacacaggagaaagattagcaatggatataaaaacaggagatagaaaactgaaatatattaaacttgagtgccaggccaaacaggtcagtagtagaaaaattttgtcacagaactgacgacaaaattggaaggagcagcaagaggaatacatcacaaacacagaaagggacatagaggacagaagtgacaagtgacgaaaataagagagttaaagaaaaattgaagataacatgttagaaacatattttaagctctagattcaaataaataagatttgagtcttattctatttctataaaatatattttgttaaaagggtgcactgtgtgccatagaaaactgatccagaacagtcaacagcagtgcttattgaagcaaaattactccatcttggaagaaaaaaaaaagagagaaagaaagaaaatataatcagatttttcaacagcaactcttgattccagaagacaatggagtaacatatttagaatacttaaagaataaaaaaagaggagctatggattttatatgctaccaaactgaccatcaatatagagtccacagacaaattgccattaacatgtaacaaatattgtttccatgagccccttcttgagaagactgtctagagataagcttcagacagccaaaatgaccagagcagcattggtataagggactagtagcaagcattatatatttgtctatagagccaagactgaataatggctctaagagaggcaagacagtatcgtatgttatggaagctcctcagcttaccatggggttacatcctgataaaccattgttaagttgaaaataccataggtcgaaatgcatttagtacacctaacctaccaaacattatagcttagcctagccttttttaaatgtgttcagaacacttatattagcctacagttgggtaaaatcatctggcagcacagtatattatagagtatcagctgtttacccttgtgatcatgtggctgactggcagctacagctcgcaagagtgttgtactgctttctactgtatacccattgctttcacattgtcataaagttgaaaaatcctaagttggggattgtttgagctctgaaaatgtaggtatagtacaattatcaaaaaatggtgagagaataggagaatatatgaaaggtaaaataagctcactgattacttaatagatactggttgggaattaaagaatggtacttcaaattaaatgctggtggagaggaaaggtagaaatgtaagaaaaggttatcaggtaatttccatactgttcatagtaggggaccaacagaatatagcccaaaaaaagtatgaaggaagggagagtaatggtattatataaaggccttactctatagatacaatacaagccttcctaaataccaaaagataacctgaaaatagtatgcaaataagatagacaatatagtaaaagaatacacatgtacacatattaaacagatggattcaagggaccaaggacaaacaattatatccataattgcaaatgttcttaccttaactattaaaagaacaatattttcaaattgtttaacaaagcatagccaaacattatgctgtattcgagaaatatccaaataaaatttaacaagatttaagataaaaataaaagaatggataaagcatacaaggcaaatgcaaataagagagcaaagtttatgatctccatacctaacaaggaaaaacttagatcaaaaagcttgacatgacaaagaaatatactttaaaatgctaaagactacagtttacaataaatttgtaataataattagtatttatgtatccagaaacaaatgtcataaagcagagactcagggagattcagagaaacagattaaaatataccacataataccagacaaaaaattaataaggatataaagacctaaatagcataatcagtaaggtagatcttattagatatatcaaactctgaactttgattatagaaaatacatctttttgtcatttgaacatagaatattcattcatgaaaattatatcagagcagtgaacaaattccaaggaagaaaataaaagtagcattttctggccagaatgcaaaaaataataataataataataataactaacaatataaaagccctcctacctggaaattctaaaacatgtcatttaaacagctgagtcaaagagaaaataagaaatttagaatttcttgaagatacatgaaaacaaaataacagtctgtagaacagactaaaacagttttcagagaaatttgcatagcattaagtactgtgtcagtaaaaatgaaaaataagaagaaaagatataaacacccaaaaccaggatgaaaaaataaactaaaagcaaaagaattaacaaagaaaaaggatgcattaattatacagaaaatcagtagaaacaatgcatccaaaagttgagtttgaggtatatatcaataaaatggatacatcattagctaacctaataaaggaaaaggagattgccaaaataaaattcgaaaggcagggggacatgaccataaaaataggaagcttagagaatcagactactttaaccaaaacatataatttattcaaataggtttgaaaacttaggtgaaataatattttttagaaaactacaatgcagaaaaaatgctgcactgtagttttctaaaaatattatttctcagtagaaacagcatctaaatcagaaagattgccatagaagaaatggaaaaaatagttaattccaaccaaaaagcacactaggcccagatacttcacagaggacttttacaaaccgttaaagaccaaaaatttccaatgctgctatatttcagagtatcaaaaaaagaaaatgtattttacaaagaaaacatatcattgttccccaaatctgaaaaaaatgacaccaaaaaataaaactactaacctatttctcttgttaacaattcaaaagtagtaaaatagtagcaaacataatctaacagcatattttgaaaaatacatcatgactaaaaggctattctaggaatactgaattgatttactatttggaaaccgttaatatccttcatattgatagaggggaaaaaatcatataattatatccagacttgtgcaaacattggatatattcagtaccaacttagtttaagaaccctaagaattgatacttttcttagcacaataacacacacacacacacacacacacacacacacaccacttagcagaaaagccaggaccttactaggcgccttctaaatgcttttccactgaagtcaagaaccagacaagaatgtccactctatctactactactcaacatgagtttgaatgtattaatatagacaaaggcattcagactgcctactgtatctaataaaatcatatgtctggaaaacccaaaagaatccatggaaaagcaactacaaagaatacaagaatttagtcaaataacattaaaagttaatacacctgtaaaagtaatattccagttaggatgtagtaggtcaaggcaggtcagtgcattacagtaacttgaatgaaccagataaacttctaaaatcatgtttttaaagctatcacaaaactaggcaagcaacaagatatgaaagaactaaattgctagtgacagaagaacctttccaaagtgagctggtgattgccagctgtgtctccctgcctatgcccccagcacttgttgattcagggtgtgagctaagaactggccttagcgtagggagaaagccattactgaggaaaaagagaaagaagtaaagcttttagcagttgttccaggtggaattaacagattggaaatcaaacacatgaccagttttttttccaaggagcatttcgattagaactaaggccacacaggagtctgggggattaggctcaaaacttaggaacggtagagtgaaatctctccatctcacactgcttaggaaataaggagatgctgggtaacagagccagccataagcatatggctttttcccctcaggactttcatcttaatactacttggatgggagactgaagtgagctggggatctctaacaggaaaaagtcttttgggctgaggagacaaacacctacctactagacacctgaggtcattcctgttcctcagttgtggcactctggggattctgattagatctagattagttccttatctagcattaggtctagattagttcctaatcagaattcctggagtgccacagcagaggaacaggaatgacccagacagattgagtcttgccaaactgtatgccccaacttaacattatcaggcaggaatgagttgatcagtcttacgacctctttgcctaatagaattaagggaaaaactgccctgatgaagtataatatctggagccgctgtgattcttttatacagaaagaccagaatacaatttttagaaaaaaatactagatatgcaaagaagcaagaatgtatggttgataataaggcaaagtgcagacaataggagtagatttacagataatagagatattatactcagtggacaaggactttaagataactacaattaatatattcacaaaaataagggaaaagatgaagaaagtagatgaaaaaagtaccttttcaccagagaactaaaaactactttaaaaatcagataagcattctagaacttaaaagtacagtaatgaaaactcattgaatgggtttaataacagattgaacagagcacagcccagaattggtgaactagaaaaatatacagacagaaccacagagaaaataagggagtgtggggattgataagagcataagaaacgtgatggaaaaactccaaagatctaacatacatataattagggtctgggagatagagaagtaacagaatcgggcagaagtgatatttgaagaaatgggctagaatgttccaaaatggatgaaaggtagcctacagattctagaagctcagcagaccccaagcagaataggtacaatgaaaagcacatctaggaaaattaaaagcttaagagccaggaggaaaaatattatttctgtatcagttacctattgttacaaacaaacaaatggctgtttactattacagaacttaacagccacttatttgtttgtaattctgctgtctgggctgggctcagccgggcacttcttctgctgatctcacgtgaagtcacttatgttgctggggctacacacacaagagctcttgactctcatgtttggtgcctctggggaagcctggaagagtgggagctgtccaggctccatctctacatggtctcttaagtaccatgtgatccctccaagtccatctggtctctccagctccccatggtctctctggcacagtaataagcacgtgatgggtcagggcttcagaagggtgaaaaacagaatctgcctggcttctcaaagcctagaaactcatagagcatcatttcaactgcattcttgttggtcagagccagtcatcacaaagccagctgagattcaaggaaacagatagaacttcacttcttgataagacatgggtgaagaggagggcagatagaattttagggcatctctcatttgcctgagtcttcctactggctcacattgcttaaattcctccgacatgcaaaatgacacccaccccaagaaccccacagtcccatccaattatggcatcaggctcagagtctacttgtgtacagtagttccccctcaactgtggtttcgctttccacagttttcagttacccacagtcaactgaggttcaaaaatagatgagtacagtattaataagacattttgaggtagagaaagatgcagaccacatccacacaacttctattacagtgtattattttaattgttctgttttattattattaatctcttactgtgtctaatttataaattaaactttatcatgggtatgtatataggaaaaaataatagtttgtataaggttcgaatagtttgtataaggttcggtactatccacagtttcaggcatacaccgggggtcttggaacatattcccctcagataagagagaattcctgtgtatggaagagactcctcagatacagcttctcttcaactgtaaacctatgaattaaaaaaaagttattggtcctatccacccccgcacatacaacctacattgttatggcaaggatacgatgtcacatgaattgactaagtttacaagagaggaaattgaaggcatgtagcaatcccatggcagttgtgaaatccatctgcctatatgtcaccaattcccccaattccaggggtagggaacatttgattagtctactttggttctctgaagttggctcccttttctttttctcagttcttgacttttttctttgagctgtctttccttttccatgagaaatgtcctctttttgtagctttctcagcctgcttctaggctctgtcccaactggcacagttatccacactggcacaacttctttaaaaagctttgtggactttcaaattataaaccactcactccaccagagagaagccacacccacaaatttcttcaagaagtcctctatgtactttgaatgtcaatcagggaatgataccctttagagtcatatatgtcttttgtctacctgagagcgtcagctagacactggcttaaatctttctgaagtacaggtggtcgtccacttatgatggttcaacttagaattcttttactttaggatggtatgaaagctatatgcattcagtagcaaccatacttcaagtacccatacaaccattctattttttacattcagtacagtattcagtaaatcatgaaatattcagcacttcattataaaataggctttgtgttagattactttgttcaatataacataatgcaagtgttctgagcacatttaagcaatgacaggttaagctatgatgtatggtaggttacgtgtactattcaacttaatattttcagcttacgatgggtttatcaagacataaccccattgtaagtcagggagcatctgtagtagtaacaaggttgtattgcatgtgctttattttatcttgatcctcagaccataatcttacagttaacaccctggatttttttttttttaacttcagaaccttttgctgaagaagctggtaacgagaaagttttattttgtaaccctgcaagtcccaggttgaaagtattttcctctaaattctgcttgaaactgagcagttccttgtttagttcttctctcttttaatacctttctacaggtgttttttgaaaaattgcttatcactttcagcatttttcctggaaaccttagccagatctataacttcaataggtactttttctatcttccaagatactgtctcacttgttttgtcagtagattacatggcttctgtccagcctgaaataccaatttcctcagtggttttccagcctccgttagtagtctctttgctgctcttccaccaaatgtctataacccagtccccaaactagtgctacatgtcttaagtttctgtcatggcaatgccctgtttaaataccaaatactatttcagttatctttttctgcctaacaaatcaccccaaaatttactaccttaaaacaaaactattctttgcttaagattctactgtctgaactggactcagctgggcatttcttctggtctcacctggagtcatttatgcaactgcagacatgtggggactccaccaaagatggctttactcaaatgtctggggcctcaactggggtggctgcattagctctggcacagctgcagttccctctccagcagggtcctgggccatttcacatgatgactgagggctccaagagggtgaaagcagaagcatctgggctaggcctcttagagcctgtgcataaaactgaaacagcactacttcatccatgctgcctttcaaagcaagtcccggggcctgctcaaaattacaggcagggaaaatatcctctacctgatggtagtgacaaagaatatgtgtcccatcgttaattcaccagttgccttcacagttgcaacaatgagactgttagcttttaaacagaaatgataaaaactagaagccggccgggcgcggtggctcacgcctgtaatcccagcactttgggaggccgaggcgggtggatcaggaggtcaggagattgagaccgtcctggctaacaaggtgaaaccccgcctctactaaaaatacaaaaaattagccgggcgcagtggcgggcgcctgtagtcccggctactcgggaggctgaggcaggagaatggcgtgaacccgggaagcggagcttgcagtgagccgagattgcgccactgcagtccgcagtccggcctgggcgacagagcgaaactccgtctcaaaaaaaaaaaaaaaaaaaaaaaaaactagaagccattgtaacaacatgtttaaagtgctagaataagaaaactgcaggcttagaattctaaaccagccaaaatgttcttaaaagattaaggcaaaacaaatatgtgttcaaacaaacaaaaacagagacaatttggcaccagtaggcctgcactgaaaaagtaaaggaagtttatcaggaaaataatccaagatagaaatatggacttggaagaaagaatgaagaacactgggaaacatatgtaaatgaatagtaactgtacaaaataataatggtacaccctgaggagtttcaattttatgtactgtatatctaaaattcatggtagcaataacttaaatgatgagagggaagcaaatagagtttaaaagtcctaaggcttaattggtatcagccaagtagtaaaagtaataatttgcattggccttaataagtaaaaaagcatgttttaaactctaggctaacaactaaaaattatttttaaatgtaacttaatagaaggaaaatggaatcatgtagaacatttgattaatccaaaggaagtcaagggaagataaaggtacataaaagtagagcacaaatagtacaatggcgaatatagacccaagcacatcagtagttacatggaggaagactgtgtaacttaagaattaaatgtaggctagattaaaaaaaaaaaaaaaacggctatataactatacccttgtcagaaaaagtaaactttataataagaagcattactggagttaaagtggaatattttataacactaaagggatctgtggcaggctgaatagtgcccccctacaaagatatccacgttctaatccctggaacctgtgaaaactatatacatacacagtatggaaagaagaggactttgcagataaaattgaggatctggagatggagcgattatcctggattatccagttgggtcctaaagccaatcacatgtattcttataaagaaggagacagagacttaatcctgaagagtagaaggctgtgtgacaatagaggcagagttatgcagccacaagccaaggaatgccagcagccacgagaaaccagaagagggaagtaacagattctctagatcctctgaagggagcacagccctgctgacacattgactttgacccaatgatattgattttggacctcctgccttaagagctgtgaaggaatagatttttattgttttaaaccaccaagtatgtgttaatttgtcacagtagctataggaaagtaatatagatttaattcacaaggtaggtatgttctgtaaactgtatgcaccaaagaacataatctaaaatatataaggtaaacattgacataactggcagaagaaatagacatattcccaatcaaagtagatttgaataaaattataataactgatagcagttattattgtagcagaccaaaaacaccacaattacaaactgaacctagctgccatatgtaagcactgaatccagcagtgacaaaattcttttttttttttgagacagagtctcactctattgcccaggctgaagtgcagtggtgctatcttggctcactgcaacctctgcctcccaggttcaagtgattctcctgcctcagcctcccaagtagctgggactacaggcgtgcgccaccacacccaggaatttttgtatgttttaatagagacggggtttcaccatattggccaggctggtctcaaactcctgacctcatgatccacccgcctcagcctcacaaattgctgggattacagctgtaagccaccgtgcccggcccaaaattcattcttttacatgcacaaggaaggaacatttatcatatgtgaacacttaacatatgactgagccataaaaaaggccttaacaaatttccaaagatttaaatttcttagcatggaaatggatattgaccaatacagattaagccagaaatcatacaaaataaaaatagcttacaaaataaaaatagcatacaaaataaaaatatcatacaaaaataaatagctttcatatatacaatttaaaaaaacagaagttgtaagagaattttaaaagaaaataccttaggcaattttttttttaatctccaaaatttaaaactcttctgaaaaatacaaaactaggcttgaacaaatggaaagacttaaccatgttcttgcatgtgaagtctcagcatcatataatatcagttctcttaagttagtttgtcattttaatgcaataacaataaaaatgccatgttattttctggtgccaggcaagctattaataattgtttaagtttatctcaaagaagaaacaatcaagaataattagagaaactgaaaaaaagaacagtgggagaagaggaggatttaacctagaagacattaaacatacatgaagcctttaattaatgtagtttgatattgctgcatgaatgcacaaaccaatgggaaagaataaaagactaattgcatatggcaatttcgaatactgtaaaggcagcatctcatcagtgaaaggaaatgtatgttttaatgctaaataggggaaaagataaaattatatccattccacggggcgtggtggctcctgcctataatcccagcactttgggaggctgaggcgggtggatcacctgaggtcaggagttcaagaccagcctggccaacatgatgaaactccatctgtactaaaaatacaaaaaaaaattagctgggcgtggtggtgcacgcctgtaatgccgggtactcgggagggtggggcagaagaatcgcttgaacctgggaggcagaggttgcagtgagctgagatcatgctgctgcactccagcttgggcgatagagtgagactccatctcaaaaaaaaaaaaaaaattacatccattccttctactacacaccaagataaattttaagtggatcagagattaaaataaatgtaacaaaatgacttcatacaagtacaaataaaatgcatgggaatttccctgtaacttggatgtagggaaaatttcctaatagactcaaaattcatacacactaaggaaaaagatgaataactaactttttttaaaaaaacttgcatttcaaacaggcgcaatgaacaaaatgaaaagctgggaacagtattttcaaattatattacagataaagggattttaaacctaatttctaaggagcttttacagggaaggaagaaggtcaacaatcttagaaaaatggactagatgcagcagaaaagaaaatgaaagcagaaaattatggaaaattgtcaaacggaattataaagaggaaaaaaatggaaatgcaagcttttttttttaaagagagaatgatctgctacaatacaggaggctgatctgggcagagaaaccaacagcctttaaaagtcatgcagggctagagaaataagattggatactagaaaggctaaggtcctgctgagaagggaaggacagagatgtgagcctagtacccttcacaatacattggcaaattctgaagctacaaagcacaagagaccagaaagccaagtagaaagctatgaaaaaccatttttaggaagctagtattagagttcaagacccagcagtgaggacaagaggcttttggtgactgtctggggatttcatttggaaagtctggagattggtgccttttaagaagggacaaaactaagggtaagtgaactttggttctaggaatggcaagaccagcaagaagatcaccattgccaactgtagcctttacacaatgtcatagcagcccaaattcagtcagctattgaattaagtttattgtctacttgccaagctaaagaatgtatgaatgctgtctttagaagataacatcatatggaggttctacaacttcttagacacaatgtcaagcttttagtaaaattatactagacattcaagagatgggattgaaaaccaagagaaagggcagacaatagaaatatactcacagatgattcaggcagtggagttaagaccaggacttgaaataacaatgataattgttcaagaaaatagaagacagggagaaaataaataaaagggaaatttccccccagataattggaacttgtgggggataaaaagaatcaaatggatattctagagctgagaattgcaataactgaaattaagaactcaattgatgggtataaaatcaaattagacaatggcgagcccaaaaataaaccctcatgtatataatcaaataattttccacacgggtaccaagaccattcaatggggaaaagatggtctcttcaaaaagtggtgttagggaaactgtatattcatatgcaaaagaatgaagttggacccttaccttatatcataggcaaaagttaactcaaaatggtccaaagacctaagtgtaagacctaaaactgtacaactcttggaagaaaacagaggaaaaaagcattaagacaatatatgtatttcttggatatgacaccaaaagcacaggcaacaaatgtaaaaatagacaaagtggactatattaaagtttaaaacttctgggcatcagaggacacaattaacagagtgaaaagacagcctacagactaggagaaaatatttgcaagtcatacatctaataaagggttaatatttccaaattatataaacaacttgtacaaattaaaaacaaaataacccaattaaaaaatatacaaaggacttgaatggtcatttctccaaagatgatatgcaaacagccaacaagcatatgcaaatatgctcaataccacaaatcatcaggaaaatgcaaatcaaaccacaacgagatatcatgtcacaccaattaggatggccactattaaaaacataaaattaataagcattggcaaggatgtagaaattagaacacctgtgcactgttggtgggaatataaaatgatgcagctggctttgcagacactgctgtcccccaacaccccctgtcactaggccatggtcatcccgactgtgcccttcaacatcaccatcaacagcaagcccttaggacacatctcctttcagctatttgcagacaaatttccaaagacaggagaaaactttcacactctgaacaataaagacaaaggatttggttcctgctttcacagaattattccggagtttatatgccagggtgatgacttcacaccccataatggcattggtggcaagtccatctacggggataaatttgatgataagaactttattgtgaagcatacaggtcttggcatcttgtccatggcaaatgctgcacccaaaacaaatgagtcccagtttttcatctgcactgccatggccaaatggtgggatggcaagcatgtgatctttggcagggtgaaagagggcatgaatattgtggaagccatggaatgctttgggtccaggaatggcaagacaagcaagatcgccattgccaactgcagacaactctgataaatttgacttgtgttttatcttaaccaccagacctttccttttgtagctcaggagagcaccgttccaccccattcgctcacaatatcctataatatttgtgctctcactgcagttctttgagttctatattttcattatgtccctccacgtatagctggattgcagagttaagtttatgattatgaaataaaaactaacaaaaaaaaatgatgcagccactatggaaaacagtatcacagtttctcaaataattaaacattgaattactatatgattcagcagttccactcctggatatatatccaaaagaattgaaagcagaattccaaagaaatatttgcacatccatgttcatagctataccattcacagtagccaagaggtggaagccatctgtgtgcccatccacagatgaatggataaacaaaatatgggatatacacactatgaatacagccttaaaaaggaaggaaattccaacacatgctacaacatggaggaatcttgaggaattaacggtaagtgaaataagccagtcacaaaaaggccaatactgaatgattccacttatgtgaggtatctagagtagtcatattcatagagacagaaaatagaatgattgttgccagcaactgggaggaagggggtgtgaaaagttgtttaatggatattgagtttgttttcccagacgaagaagttctgaaggttggttacatgatgtgaatatactaaacactactgaactgtgtacttagaatggttaagataaattttatgcgttttcactacaataacaagtagaacagtagaacagatgattagtcacagcagaaaagatgaaagataggtcaaaacaggttattagaaaatatccaaactgaagatgaagaagaaaatcatttttagtagaaaatatccaaactgatatataaagacataaaggaatttgtggaggcagaggggagataaggcaataaaggacatgtgggacacatccaaaaaaaaaaaaaatccaacatacagaatcccaggagaagaggagagagaacaaggcaggagcaaggtttgaagaggtaatggctcagaatttatttcctaagaattatgaaagacattatttcacagactcaaagtgtgtgatccacagatttaaatacaaagaagccttactagaatatcatagcaaattgccaaaaacaaaagacagagaatagaatcttaaaagatagagaaaagaactcactttcaaatgtccaagactgacagctgacttctcagcaggagcaatggaaccagaagacaacaaagtgacatttcaattgctggaagaaaacagcaccaacctagacctctgtaccctgcaaatatcctttaaaaatgaagcaaataaagtaatcattatgtatgttattggcaaaatgatagaccaatagaacagtggaacaaaagagagaggccaagaataaacctttacatagatggtcaaatgattttctcaaagggcacgacagcatttgaatgaagtaaaatctctgtaataagtatgtctggaatgcatggatatgcatatagaagaaaaaacccatacctcacatcatccagaaaaatcaacttgagataaattatagacataaaagtaaagctaaagcaataaagctaccagagcaaaacataagatgttctctttaagttcttggtgtaggcagagacttcttagaaaacatgaactatacaagaaaaaaaaattggtaagttggacttcattaaaatttctcagctgggcatggtggctgacacctccaatcccatcaccttgggaggccaaaacagaaggattacttgaagccaggagttcaagaccaaccagggcaacatagcaagaccccatctctacaaaaaatttaaaaatcagccagcaacgcctgtagtcctagctacacaggaggctgagttgggaggattgcttgagcccaggactttgaggatgtaatgagctatgattgtgccactgcactccagcttaaaaaaaaataaaatgtatcttcaacagacacttaagaaaatagacacagacttaaagaaaatattcacaatacgtatatatgatggacttgagttcaaaatatataaagaactacaatttagtaatttttaaaaagacaacgcaattttttaaaggtgagttttgtgaatagatgtttcacaaaacacaatatatgtgtagtaattacattttaaaagtacccagtgtattagtcatctagaaatgaaaaacaaaaccccagtgaaataccagttcataccctgtagaagggctagacagtgaaaaagactgataatgacaaatgttggagaggatgtggagcaactggaaccctcatatgttgctagtgggagtagaaaataatatgattattttggaaaacagtttgtcagtttattaaagagttacatatatatacatgacccagtaattttgctgctagaaatgtatcaaagagacatgaaaacatatgaccacaaaatacttggaaaaaaaatatttacagcagctttattcataatagccaataaaactggtaacagtgaggtgcccatcaatagaagaataggtaaacagtggtctattgagatggtggatactgttcagcaaaaaagaaccaacatccacaacattgacgaatctcaatattattctcacaaaagaagttggtaacaaaaaaatgcatagttaagattctaactatatgaaattccagaatagggggaaataacatatagggatagaaatcagatcagtgattacttcgtgggggaaggtattgactggaataccgcatgaaagaactttctggagtgttggatatttctgtgtctttgttacttaattgtcgaaagtgaatgttacacttaggatctgagcatttgtttatgtaagttatacctcactttttaaaaatgaaagttaaataaagattttagaccactaaaagctggaagatgcttttaccaacagattgtactaaaaaatcagtaaaggattttttcaggcagaaggaaaactatcccacatggaggctcagaaatataggaaagaacaaaaagccacagaaagggtaaatgttcgaggagacagagaaatgaggatggctttacaaaatatggacggtaacatcttccaaagtaaaaatgtatgacaacaataataaaacaataaaaggcagatgggaactgaaataaaaatgaaatatcattgataataaaacaataaaaggcagaagggaactgtactgaccacgttagatagtcctaggaccagttagacatttcacattcatgccgctgcagcagcatcagaggtatacctccagagtgagccctcacatagttcgcaccttagtccaggggccattctctgcccacccgcattttctgccaagtgtcagttcagatagaagggaacaaatcaatttattaattgtgggaactaccctagtttagataccctaagttccaataaagaatcaatatcttttgtaatagcctcatgagcatagagtcctggagagggacatggcttggctataagaaccgtgacactcagaagctcaaagctgtggcttttcatcaggtatttgtagtttatttacaatcatctcagtccagataggtttaccaaccagtgttattttttaccatatgttacctgtaacagatattagatatttagggaaataaagctagaagtttcatccaacattgttttccattttaggctcacggacggacttccacgaccttgagttaaaactttagggtagataggaattacctggaggccttgttaaaacacaaattgttggtgccctatgacttacttcctagctcagtagctttagggtgaggcttgagaatttacatatctaataagttcccaggtgatactgggtgatactgctgacctgaggaccccacgttaaaaccaatgccttattcaatggcagtgataacaaagtaaaagtgcccctttcctgtttactaaagggtccccatgttcttttagcttcagcctttaaaatactagtcattatttattatttcttcaaaagcccatctctaattgtctccttagggagtttttgagttcacattgacattaattgtcactaactgtcagcagttggcattaaccagactctattttaggattaaatccacctgatccacctgcactatcagaacattcaggacgcgactcaggctgcagctcagagggctccaccggtggccctagacttgcatcaagctgctgccattgccactgcaccagcttgtatgccaggttaccacatagtcctatgtaaccatgtgggctgctgtagagtaattcccctacttttgtcccccacttcctcaggtagaggctcgtagacattacattggatgagcaggcagctcagcttggtcagagccagccgtctgctccacccactttgtcctatcacagacccagtcgcagacataaattctcaagctcatgtgcttgtctccttcccacccccagcccgtcatcaatgcctagtttggcctaatgcatcagctgcaccaaggcaaaatcatttttgccaaccagcccagctgcagtttggtttctggtcaagtccaatttatggacagcggagaggagtggacagcttctctcagcataagtttgtctccagctttcatcccttcccacgggggaagatttcgaagccaaaaggttaacatgagatcaacttcccatgagtattcacggataaagtgctaggttttagcattatcaagaaagtaatgaaattaaagtaataatacgtattttcagtgtgtaataggttgaagatgcaagttgcaatctctaggctaaccacttaagagcaaaacatgtataattaaaggaaaaggagtaataaacatttgatcaatttttaaaaagagacaaaggaggacaaaaggaatgtgtgaaatggaaggcaaatagtaaaatgacagataaacctaatatatcagtaagcagaataaatataaaaggactaagtacttcaggtactggagtactgacattatcaactgggttttcaaatatgaaccaaattgtgtgcttttaaatataaaatatacaacagttaaaattaaacaaattttaaaaagatatatcagccaggcacagtggatcatgcctgtaatcccagcattttgggaggctaagacaggaggattgcttgagaccaggagtttgagaatagcctgaacaacagagaccatctctactaaaaaaagcaaacaaaccaacctagccaagcatagtagcatacctactctggaggctgaggcaggagaatcctgagcctaggagtttgaggctgcagtgagctatgattgtaccatttccctccagcctgggtgacaaagtgagaccctgtttcagaaaagaaaaaagatatatcatgcaaatacaagtaaaaaggaagttggtgtagttatactaatatcagataatatggaatttaaggtaagaagcattactacagttaaagacagacatttcataatgataaaatgatcactagggatatagaaagttgtaaatttatatgtaactaatagcatagttttaagttctataacaaatattaaacataaatctgcagtcttagtggaattttacatacctctcaataggtgatagaattaagcagacaaaaaaatcagtaaaaatataaatcatcttactaaaaagcaaacttgacctaactgatatttctataatgttgatatcaactgtgacaaactactcatttttaaaaagccacatggaacatttaccatcttgatcataacctgagtcataaattaagcctcagttaaattttaacacatttaaatcatttacagtatgtgttctcaccatagtggaattaagctaaaaaaaaaaaaaaaaagatcagaaacaaaagaagagatagtaaatctccagtctgggtgcggtggctcaagcttgtaatcccagcactttgggaggccaagacctgcagatcacctgaggtcaggagatcgagaccagcctggccaacatgatgaaaccccatctctactaaaaatacaaaaattaaccatgtgcggtggtgcgtgcctgtaatcccagctacttgggaggctgaggcaggagaattgcttgaacctgggaagcagaggttgcagtgagctgtgatcactccactgcactccagcctgagcgacagggcgagactccatctaaaaaaaaaaaaagaaagaaaatcttcacctgttttggtaacattaagcactacacctctaaataatccatgggtcaatgaaaaaagcacaaagggaattagaaaatattttgaaatgaatgatacagtgtaaaagatatggtatatcagcacatgtgggatgcagttaaagcaatacttgagggaagtttgtatcctaaatggatatattagtttaaaacagaaaggggagaggagatgaacgtcagtgatctatgcttctatctcaaaaagctagaaaaagaacaaatcaaaaccacactacattgagatatttttcacccatcacactggcaaaaattcagaagttttataagactaaaacctcttagactgtggggaaacacactgccatacattgctaatgaaaatgtgaaatgggccgggcacagtagctcacgcctgtaatcttaccactttgggaagccaaggcaggtggatcacttgaggtcaggagttctaaaccagcctggctaacatggtgaaaccccatcttcattaaaaataaaaaaataaaaataattagctaggcttggtggcaagcacctgtaatcccagctacttgagaggctgaggcaggagaatcacttgaactgggaggcggaggtttcagtgagccaagattgcacccctgcacttcagcctgggcaacagaatgagactctgtctcaaaaaaaaaaaaaaaaagaaagaaagaaatggatgacctttacagggaagaaactgactatatctagcaaaattatacattcatttacccttttagccagcaattctacttttagtaactattcccaaaaatgcattggcaaaaacattaaaacaaaaatacttttgaatgaggctgtttattgtaacctgatttgtagcaaattggaaacaacccaaatgcccagcagtagcggagtgattaaatgaaaagttccctgtggatgtacattatgtgtgaacatccacacagtggaggcttccacacagtggaggcttctgcagctgtcaaaaagaacaaggaccatttcagtggaataaaatctccaggatatcaagtggaggagaaaaagtggaaaaaaataatatcttaggatactatttatcttttttaaaaaatggcaagggaagagtggatatatgtagagaaaaagatattttaaaatgaaagactaaatcttaaaaatatttttaaatggttttccatagaggaaagaaaatggggtggagaggacaaggaatgaagctaggttccttgaatctacattattttttcaatttgactttgaaaccaagtaaatattttgcacaattacacaaaatttttaataaagcagtttctacttaaaattaaatgagcctatgtattcagttggtagcataaccataccaaggggaattatcaagaggaattattccaaatgactttaaaacacaattacagttgacccttgaacagcatggaagttaggggtgccaactccctacacagtttaaaatccacatataacttttgactcctcaaaaacttaactactaatagcccactattgactggcagccttatgataacataaacagttggttaatacatattttatatatgtattttatattgtattcttataatctatagaaaagaaaatgttaagaaaatcacaaggaagagaaaatatatttactgttcattaagtggaagtggatcatcttgaaggtcttcattctcaccatcttcatgttaagtaggctgaggagtaggaacggaagaagaggggttggtcttgctgtttcaggggtattagaggcacaagaagtgaaggagatggaaggggaggcaggagaggcaagcacgcttggtcttttattgaaaaaaatccgtgtgtaagtgaacctgcactgttcaaacctgtgttgttcaagggtcaactgtatttgactatacatccctaatgagatttaccctaagaaccaaaggaaaccttgtacagattgattatcctttatccaagatgcttgggaccagaagtgctttgaatttcagatggggtttttttttgaacttaagagagatgatttagggtatctggtggaagaaatttctaagcagcaaagcattcaagaggtgacttgggtgctgttaaaggcattcagttttataaggaaagcagtcgcccaggctaaaggtgcagtggcgtgatcaccactcactacagcctcaacctcccaggttaaagcaatccttccacctcagcctcccaagcagctgggactacaggcatgtgccaccatgcccagctaatttttaaattttttaaatagagacaaggtcttccctgtgttgcccaggttcctggactcaagcagtccacccacctccacctccaaaagtgctgggattacagatgtgagccaccacacctggcctcaatttcagatatttctggatttttgaatatttgcattattctgcttgagcattccaaatctgaaagtccaaaatgttccaatgagcatttcagttatcacgttggtgctcaaaaagtttgggattttggagcatatcaaatttgggattttcagattaggtatactcaacctgtactattttcaataatgttgttaatgatattgatagtgttcttctgagattctaagtgtatgtattgtgaaatgaatgagttcttttttggtgttgagaactagaatttttggtagagatgaaaggagatacagatgtgagaatgatggcgttaacacctgtggtcctgaattggaaatattggtacaaattctgatgtgttttatcagttttaaaatacaaagttcctagctttatttgctgaaaaaactagaggtaatgacagatccagtactaataagcacctttagtctctagattgtggactttagcttccattttagtggaaagtggtacctaaaggtcacaatctaggtgaaccagttttccttggagaaatagcttctaccaagtatttgaaccagtattctttggagaaaaagcttctaccaagtctgggaaagcaaggaagctcgcaatgacaacaggttgtatcaaaagaatttggaatgaacttgaataagctcccattggccaaacataagacagtttgagcaacaggaggataataactgcaatgaatgaaatgcatcacctacaattaaactactgaatttgcagtgataattgtgccttggagaatgcatggtgtattcgttcgttttcttgctgctgataaagacatacctgaaactgggagcaaaaagaggtttaattggactttccgtacatcttctgaaatctaggtggaggttcccaaacttcaattcttgacttctgtgcacccacaggctcaacaccacatggaagcttccaaggcttggggcttccaccctctgaagccacagcccaagctgtatgttggcctctttcagccatggctggagcagctgggacggaaggcaccaagtctctaggctgcacgcagcacggggaccctgggcccagcccacaaaaccactttttcctcctgggcctctgggcctgtgatgggaggggctgccgtgaagttctctgatgtggcctggagacatcttccccatggtctcagggattaacattagactccttgctacttatgcagatttctgcagctggcttgaatttctccccagaaaatgggtttttcttttctatcgcatagtcaggctgcaaattttctaaacttttatgttctgcttcccctataaaactgaatgcctttaacagcacccaagtcacctcttaaatgctttgctgcttaggaatttcttccaccagataccctaaatcatctctctcaagttcaaagttccacaaatctctaggacaggggcaaaatgccaccagtctctttgctaaaacataacaagagtcacctttgctccagttcccaacaagttccccatctgcatctgagaccacctcagcctgaattttattgtccatattgctatcagcatttttggcaaagctactccacaagtctctaggaagttccagactttcccacattttcctgtcttcttctgagcccttcaaactgttctaatctctgcctgttactcagttccaaagtcacttccacattttcaggtatcttttcagcagtgccccactctgctagtaccaatttactgtattagcttgttttcatgctactgataaagacatacccaaaaccaggaacaaaaaggtttaattggtcttacagttccacatggctggggaggcctcagaatcatggcaggaggcaaaagatacttcttacatggtggtggcaagagaaaaatgaggaagaagcaaaagcagaaacccctgataaacccatcagatctcatgagacttattcactatcacgagaatagcatgggaaagaccggcccccatgattcaattacttcctcctgggtccttcccacaacacgtgggaattctgggaaatacaattcgagatgtgggtggggacacagccaaaccatatcacatgggaatagttttttttcaatgtagatataattaaaagtaaaaagcatgtgtccttccttttctaaattaattttttttgggggataagcaattgatgagggaaagtctctctaggaatattacgattaataaactgaaagtgataataacatcagtatattacagttttgtagcccttaatgaatatcagcagtgatcatcacttgctgctaacatctgagacacccagacagtatgtgtgtatcattagaagtacacacctataaagtagttttgtcccactcttcccccaaaagttaaatctaaaccagtcacttctgtaattacaatttgtgagaaataacagggaacaaaggagcatgttaaatggtaccatgaggatgcaatatcagagtctaatgctggaaaccaacaggacagataaccctatttcttctacaaaaataaatttgtaaagaaaaaactaatgaagatggaccccagagatcacaacagatttaaggagaaagcagccaattaaaatgtatggcgctcatttagattgtgattcaaactgtaaaagcaaaatgaaacttctgtaagacacttggggtacataggaacaaccaactgaatacttgatgatattaaagaatcattttcacttctttaggcataatgtacataagcttatgttctaaacatgagtttttatcttttagaggcacacactaaagaatttacccatgaaattgtatgaaatctggaatttgcttcacattaacatggatgagggtatagatgaaacaacatggccatgagttgataagtgttgaagctgaatgatgagcacatgagggttcattatattgttttatttatttatttatgtaatttaaagtgacagggtctccatctgtcacccaggcgagagtgcagtgacacagtcttagctcgctgcagcctcaaactcctgtgctcaagtgattctcctgcctcatcctccctgccccatcccgcaacccccaaagtagttaggacgacaggcacggaccatgccaagctaatttttaaatttttttcataaaaatgtagtctcgctatgttgcccagactggtctcaaactcctggcctcaagcaatcctcccaccttggcttcccaaattactgagataacaaggtgtgagccaccgcacccagccaggagtgcagcttttaaaagagtagttccaggccgggcgtggtggctcacgcctgtattcccagtgctttgggaggctgaagcaggtggatcaccaagtcaggagttcgagactagcctggtcaacatggtgaaaccctgtctctactaagaatacaaaaaattagcaaggtgtgatggctcacacctgtaatcccagctactctggaggctgaggcaggagaatagcttgaacccgggaggcagaggttgcagtgagccaagatcacgccactgcactccagcctgggtgacagagcgagactccatctcaaaaaaagaaaaaaaaaagttcctttatttttgtatatacttgaaatttttcattataaaacatttaaatgatgtgattacaaagatgagaaacaaatagcatcagaaatgagtaggtaaatttaaaaagcaaattagccatcttaaactaaaataaattgtgtaagtcagatattcagttgatgggttacatgaattagacataattaaatagtgaattgcaagctttgtaaaaaatttacctgaaatattatagagacaaggagacaaatgaatcaacagacttaggaagtaccatgtattccaagctggaaaagtaaaaagaaatccatacctacatacattatagtagaactacaaaatagcaaaggcaaaggtatcttaaagcatccatttcagtcagggtactgtcaggaaaacagaaataacactaggtatttcagaaaagcaaatttgatttagagaattgatgacgttgtagagggctgaaagagaaaaaggaaacaaggaagtaaactaaagataactgtagggaacagctcccacctctaggtgtggaaaagggcagcaagtgattagggttttcagaatttagaagtttacaggagaaactgaggagctggagctcttgcttccacagagagggacagccttgtggcagaagggtgcagtgagcctgggtctgggagtgcttaaagaacctggagactagagtgctgttgctggaataacactgacaggagcagcatgcaaataggaagaaagaagtcccttctccctcttgccttccaatcttctagtgcacatgtttgctgaacctaacaagaagcctgttaacaaaggagaaatgtggtttgcagagtgccagcagttatcgcaaagcagatttggacctgaaagacaatagctcaataagtatcacagtagccatgtattcattcactcattcatttattcattcattcagcaaatggttagtagaagcttactatatgccatttactttttaaatggttgggataaatcagtgaaaaacaactcaaaagatctctgccctcatggagacagaaagaaaggacagatcacctacaaggaatgatggctaaaatgacaacctatttaatagccactattaaggccagatgaattgtgaaaggataccagaccccctagaattgtgtgacctacaatgaagaaagaataaagatatttaaagataagcaaagagctagaaaaatttactaccaagagtgccgttctaaagaaaattttttatatgatggctgcagaagaattatctgagacccaagaagatttgctaagcaaataaaatgacaaaatgctaagcaaataagatacaaacccaaacattgtggaaaataataatttgtgggattttaaaagaaatgactgaaatactgtacaaagtagaacgtatatttaagagtgggatgatcagatcttaggttttcaaaagcccttttattatgcaggagaagagagttataatacattgtttagactttgttaaatttttacagtaaaatttaagggtatcattaaaagaatacacaaatctaaaacctgtgaggataaaataatgaagtaagaagaggatgagccaaaaaaaatcaatacaagaaaatgcaaaaaaaaaaaaaagcattcaagaatctggacaaatataaaatgatctataatacagcagtgacaataatgtgaaatcagaaaacttttaaaggaactgcatatttttatgactacatctaaaacaaaaaagttggaaaagaaataccaggtacaaactaataaaaaggaggtagtaggcatagttatattaattacctgaaaaacatatatttcaaaacaataattattaggagtagagagaatgactacataatgataaaatgtttcattcaccagaaagatataccagttctaaacttacacatattcagtaaaataccctcaaaatatgtaaagcaaacaaaagaaagatagatgtacagttagaaattgcaaatctgtcaacataaacactcttctccattatgcataagtcagtcagtttgtacctgtgtttatgttcatgagggatattggtctgtggttttttttattatgtttttgtgaagttttggtatcaggataataatgaccttgtttaatgagttggaggtgtttccttcactttagttttctgaaaaagtctgtagagaattccttaatatttgatagaatttgccagtgaagccatctggtcctagagttctctttgtgggaggtttttaattatagctctaatatctttaatagatctagggctattcaaattatctctttcttctctggtgatctttggtaattgtgtctttcaagggatttgtttatttcatctaaattgtttattggcagaaagttcttcatattattttcttatcatccttttactatctgtaggatctgtagtaatggaccctctcttaatcctgatattggtactttgtatcttatctctttttttctgatcagactcgctagaagtttatgaattttattgattttttttgttgttggggaatagggggacagagtctcgctctgtcgcccaggctggagtgcagtggtgcgatctcagctcagtgcagcctctgcctcctgggttcaagtgattctcgtgcctcagccttctgagtagctggggttacaggcttgcaccaccatgcctggctaatttttgtatttttagtagagatgaggtttcaccatgttgcccaggtcagtctcaaactcctgagctccagtgatccacccacctcggcctcccaaagtgctgggattacagccaccatgcttggccattttattgatcttaaataatcagtttgaggatccactgactttccaccatctttttgttttctctttcatttatgtctgctcttatctttgtaatttccttgtcttccgcttgcttaggatttaatttgcttttcattttttaggtttttaatagttttttttttttaggcttttaatataagcttgtattattgacttgatccctgtcttcttttctaatgtagatgttcaatgctaaaagtttcctgtaaatttatgacaaatttaacttgtcatattttcattttcattcaattcaaagtactttataattttccttctaatttttttgacccatgagttatttaggagtatgatatttagtttccaactatttgggtgttttctagatatctttctttaattgatagctagtttaactccattgtagtaaatgaacatactttgtatgatttgaattcttttcagcttattcaagcttgttttatgggccagaatgtggcctatcttggttaatgcttcatgtgcactagaaaggaatattgtcttctgcttttgttaggtagagcattttagaaatatcagttaggttaagctcctgatagtattgtttatattttctttactgatttttctggtcttctataagttattgagaggctaattcaactatattaataattatgaatttgcttgtatcttattttagtcctgtaagttttcgatttgtgtatttctaagttctgttactagatgtagaaatcaatgaaatagaaaacaaagatataatagagaagatgaacaatccaaaagttgtttctttgaaacaagtagtaaaataaacttttggcaaaattaagataaaaagaaagtacaaattctcaatatcaagaaaaagggcaaaacaaaactatggttatatcaaattaagggataagaaaagcatataattgcaactttatgccaataaatttgaaaacaggtagacaatttcttagaaaaatgtaatgtattaaactgattcaagaacaaaaagaaaacctgaagaatctcataattctcaaataaattaagtagtaagtttttaaaaaatcttctcacaaagattacaacaaggtctgttgattttgcaagtgtgaattctacaaacttttgagaaatacctcatcctaatataaacagacttccagacattagaataaggaatgacataccagttaattccttgagacgggtataaactttaaaacaaaaccagacattatgagaaagaaaaataatatatatttatatatgttgtcatatataatttttaagttagcactaatctcactcatgaacttaggtatcaaaatcaaaatcataagcaaaatgttaacagactgaatccagcagcacatttctttaaaaagagatataccttgaccaaattgggtttatcccagaaatactgaaaatggtctaactctaggaaaacgcaaaatttgagtcaccaaattaaaggaaaaaaactatgaaatcatttcagtagattgcatttgatacaattcatacccatttataatgtaaaacttagtaaattccttaatgtggtgaaaataatcaacaaaacatctacttcaaagatgattcttactgaggaaatatgaaaaataattacttgaaatcaagaaaaagaatgcagactatcaccacttcttttcaaccttgtactgaaactcctagcaagtatagtaaatcaataaaaagaaattaggctgggcgcagtggctcacgcctgtaatcccagcattttgggaggccgaagtgggcagatcacttgaaatcaggatttcaggaccagcctggtcaacacagtgaaacctcctccctactaaaaatgcaaaaattagccaggcgtggtggtgcagccctgtaatcccagctattcaggaggctgaggcagaagaatcacttgaacccaggaggcggaggttgcagtgagccgagattgtgtcactgtactccagcctgggcgagagagcgagactccatctcaaaaaaagaaagaaataaattaatggcataagtgtaaagaagaaaaaacaaaatgtcattcagaggtgatatgattatctgtatagtaaaccccaaagactccacagttttttagaaataatatttttctcaaagtggcttcccgtaaactcaataaataaaaagttgcatttctgtacagcagcacaaaatttaaaagtgtaatttttaaaaatatacatcgttataaaaatataaagttctcaataaatcttacaaaagttatcaagacctccgtgcagcaagagataaaacttctattaaaaaccattttaaacaatctaaataaatagatatataatgttcatggataagaagacacatgttataaacatgtcagttttcctcaatttgatttatagagtcaatgctattataatcaaagtaccagcagggtttttttatggcacttgaaaagcaggtctttatatggaaaggtaaatcatgaagaatagacctgacactcttgaaaagaaaaataaagtgagagttgccttacttttttgataaaacaagacattatgctgtttgctcaagcataaataaaaatggctaggaagactaaataggaaggccagaaatagactcgaatacaggggtccaactcccaggccacggatgggtactggtctgtggcctgttaggaattgggctacacagcagaaggtgagtggcaggtgaacttcatctctatttacagccactccccatcgctcgcattactgcctgagctgtacatgcgagggatctaggttgcacggaagttccttatgagaatctaatgcctgatgatctgtcactgtctcccatcactcccagatgggaccatctagttgcaggaaaacaagctcagggctcccactgattctacattatggtgagttgtataattatttcacagtgtaataataatagaaataaagtgcacgataaatgtaatgcactcgaatcatcccaaaaccaccccctaccccatccatggtaaatttgtcttccatgaaactggtccctggtgccaaaaaggttggggacctctgctctaacatacagaactgtgatatattaaaaaagtaatattgaaaattggtgggaagagaagggactattcaggaactgtactggggcaattgcttacttaatttcaatcttcatatcttacacaaaaattcaattccacatgaattaagggctcaagtatcaaaaacaaaatgttaaaacttagagtaaaatgtaggagatgacctttctggctatggagtaaggaaagttttcttcttaaaggagacacaaaataactataaaagaaaatgttaatgaattaaagtatattaaagtttaattgttttaattaaagaaaggcaggccagggagaaaacatgtgcaacacatttaatctacaaaagattaatatacaaaacatataaattgatgaaaagtaataaaatagaaaaatgcattaaagatattaacaggcatttcacagaagtgatatgtgtgatgaataaatatgagaaacaattctcaatctcactagtgatcaggaaatgcaaagtaataccacaggaagatgccattttcccctcaccaacagtacctagggttaggaaggacatggatcaagaggtccttttaaacaatgtgaatggggttgtatgttggcatggcacctttgggaaacaatttggcaatctcttggttttttgttttttttttttttttttttgaacatatgcatatcccgtggcccagaaattctactccttggtatctactctagactataacaggagacaaccaggaagcaatctaaatgcccatctacagaaaatggataaataccatgtagtatattcaacttaatgagcatttaattgtgcagcaaggaaactgaataaacacaacatgaatgaatcttagaaatataatgttgaataaaaagccccaagtttgtcaagtctgcatacaatacgccatagtcccccccttatttgcagcttcattttccacggtttcagttatccacagtctattatggtccaaaaatattaaatggaaaattccaaaaataaatataagtttttaagttgtccaccattctgagtagcatgatgaaaccacctgctgttgggctcagtccacacgggatgtgaatcatcgtgtagaagctccctgcctgtcattatcagattgaaaaaaaatagtagatgtaaaactggatgctatccatggtttcaggcatccaccgcgggtcttggaatgtatccctatcaggtaggagggactactataccattttcataaagtacaggaagaagtaaactaatgtatattgttgagtcaagtatacatgtatgtcagagatagaactatgtttaaaaggtgaaatggaataataaagataacatttagaatagtgtgtgaggatagaatggtgtaagaacacgtaagtaaatacaagttccatttttcagtaaggtggtcgtttctggaatattcattgtatgttttacagcatgaatatgttttacatagttatatacctaatatttaactatgttatataattatatatttacttggcacggtgactcattctgataatcctaacactttgggagactgaggcaggaggatcactttagcccaggagttcaagaccagcctggacaacatggcaaaatcacatctctacaaaaaatttaaaaattagccaagcatggtggtgcatgcctgtagtcccagctactcaggaggctgaggtaggaggctgagacaggaggatcacttgagcccaggagttcaaggctacagtgagctatgatcacaccactgcactccagcctgggagacagagcaagagctgcctcagaaaaaagaagaaattatatattatatgtgtatttaattatttatgttcttttgtgtgtcagatattagcattaaagaaataacttttttgtttgtttgtttatttgtttgttttgagacagaatctcactctgtcacccaggctggagtgtagtggcgcaatcttggttctctgcaacctcctcctcccgggttcaagtgattctcctgcctcagcttcctgagtagctgggattacacacacctgccaccacaccaggctaatttttgtatttttagtatagacgggttttcagtgtgttggccaggctggtttcgaactcctgacctcacgtgatctgccttctttggcctcccaaagtggtgagattacaggtgtgggccaccacacctggcctaagatcattttatttaaaatccttttggaataccagtcaaaaagaacaaatcatttaacaaggagaaacaagttgggctagcttcagatttctctgcagcagcattccacagcaagaggcaatagagaaatgctgacacattatttgaggaaagaataagctgtggttttaaatccaaccaagctgtcttttagctctgaaagcaccagacagaagtttttcaacatatatgagtgtattagtttgctagggccactagaacaaaatgccacagacagggtggcttaaacagcagaaatttattttatcactggtctgggggctggaagcctgagatcaaagtgctggcagggttggtctcccctgagacctctctcttcggcttgcagttggcctcttgctgcctcttcacatggttgtccctctgtgcacacaggaccctggtgtgtctgtccttcttctagctccttcatataaatccagtcatttagagttagggccccactctaatagccttattttaacttaatcattgctttaaagacctccacatacagttacattctgaggtacaggggattgggacttaaaaatatgaattttgggggaacatagttcaacccatagcagtgatctcaaagaatattgttcccatgagccgttcttgaggaaactattagaagatgagctttagccaaccaggagatgattgggaaaaccacacaaaagtaatgtcagtgaccactgattatattcagctgtaaaaccaatactaaaaggtgaggcatagagtgataggtcagaatgtaaatactatacgccctgaaaatgtagaattataaaattaacaaaaatgttattgaaaacacaaatcagacaagcagttaagttttctgagtgcctcttctgtaatggctgggagtcagagatcatcaaccaaaagttgcaaatgaaatagattttaaaaatccaaagttagacctaaattcaaaattcaacctaaattaaatactgtatttatatatagtataatatatatattactttatatatagtaaaggtagtatctcagtggggagagaggtgaattattaattaaattttgagacaaattagtagctatctggagaaaaattaagttggagccatatcttttactttacagcagattaaatttcaaatggatcaaatatttaaatgtaaaaaatgaaattataaaaattctgtaggggaaatggtgaaatatttatttcttttgctttttaagagacagggtctcactctgtctcctgcaggctgaagtgcactaagtggtgtgatcatagctcactgcaacctcaaactcctgggctcaagcgatcctcctgcctcagcctcctaagtagttgagactacaggtgcacaccatcatgcccagctgtattttttattttttgtagagacaggatcttgctgtgttgcccaggctgatctcctcttgccttggcctcccaatgcactaaaattacagccgtgagccaccaagcctggcccagtaaaatttctttatatccttggaatgaggtagggcttcctaactacaactgaaaatccagaagtcattgaagatcactaaaaaaccaaattctgtagcaatcaaaatctacatcacacaaagtaccataagtccaaagacagacttcaaactcgggaagcttatctgtaaatcataggcaaggatgatctccctaaaatataaagaactttttaccaacagacaagacaaaaacctcacagaacaattaacaaaatatgaatgcaaatagtttacagaaaagacgttcaaaaggctaacaaatatggaagaatggtcaactctactcataagaaaggaaatgcagattaaaaccacatttctcacccatcagattgtcaggggcctaagagtttagtaacaaactctgtgatggggctataaggaaatggtgatacttagatatttctggcaggagattaaattgttataatccgggtgggcatggtggcttatgcctgtaatcccagcactttgggaggccgaagtgtgcagatcacctgaggtcatgagttcgagaccagcctggccaacatggtgaaactctatctctactaaaaatacaaaaattagacaggcgtggtggtgcactcctctaatcccagctactcgggaggctgagacagaagaatcgcttgaacctgggagatgaaggttgcagtgagctgagatcattccactgcactccagcctgggcgacagcgagactctgtctcaaaaaaaaaaggacaaaggaaaggaggggggaggggggaggtgaggggaggaaattctagaaggaaacgtaaaaaattaaaaataatgtttacttgtctaccatagagacgaggatgggagagagacttcatggtataactttgtatacttcctggtttttgaaacgtgtgactgtgttacctattcagaaagttaaataaaatagaacatagatatgagatatagttctgctattcagtagttgagtgaacttgggcaagacacttaagctctctgagtcatagttttctcatttatagaagggctgtaatagtagtatcaagctcacaggattgttctaaggattaatgaaggacaggtggaacagaaagtgctgagcagagtgccagcacttagtaaatactcagttgaatggtcatgacttgtgttactgaacttaatcttggtaataaatgagtatgttcttgaaaggacaccagccttggctaacattcctttgcagaaccagacgtcctgggtcctctccagcatggcagccctctactggagggtgaaaggccaaggaaagaaggcaatcgactgcctccgccaggctctgcactatgcgccacaccagatgaaggtgagtgggactcagaaggtgggaacttctgcccctttgtcctttccattccccatggtttattctgccctttgaaccagcctccctcatgctcagccagtgaggacatattccaaggagagaatggggcaggagaccttctgactgggcttgtgccccagcaagcctatgaactatccctgctgccttcccagcttcagcaggttggaacgtggggaaggccttccagatcactgtaagacagtactgcatttagtcccctttctgctgtgttcagagccacccaacatacagcaaatgcactggcctaagtgggctgacacatagaagtcaatctgaatttagcttgtcatcaggggcctggtgacctcttagacttgttttgcttatcctcttggcttgagcttgcttccaagcacagagatagaagcaaatttccatttattcatgtacattggccagttcctggtccttgtctgacttctactttttccacaaaaaaaaaaaaaaaaaaaaaaaaaaaaccggctaaccctgtgtgacaccagacttttccagaagaccggttattgttatgatggatgagaaaatacagtgttttatcagcacatttgtattcatgtgttctgagttctgcattaatccagatcttatgctttttaaagacatggctggtgtcttctttgttcgtcaaggcaatgtatggaatgatggaaggaacacaggatttattgtcaggcattgctgagttttaaacacagctctacctcttactagctttgtgaatttgggcaccttattgaacttcaatgagctcatctagagtcatgcattctatggctgtcacaaagatgggtcctttctgtttcttctgtgtctgctacagaacccaatatggcatgatacaggtaacagttgctcaagttagacatttaaagggaatgatatttgtgatgatagcaatcttgctacttgttccatccatcattttgtactctatactgttaggcaatagggaagggctgaggctctacctctgggagtcagcaaacttcccgaaaagggcaagagaataaaacacttggactctggaggccagacagcctctggtgcacctacttaattctagcattgtagtatgaaaacagccacagaaatacgtagaggactgggaatgattgtgtcctaataaaacttttttcaaaataggcaggagactaggtttggcctatgggccaaagtttgccaacccgtaatgatataatggttcttgcagaaattattttggctttctgacagcatgactctaagtgtggtctgtggacagtacacagactttttattagcagtctgcaatgagacaaggagcttcaccagaagaaaccaactacattattcagcagattgtttacttcagctgacattttgttgtgtttgttttcgaagcaagacttcgccaatgaaagaagtaattgatttatattctggtacaagcaccttatctatcacagaccagtagcaaacagcacaaaagcactttgagtggcactgttctaatcattcaccaggaaacacagactgtattctttatgatcaccaaaaacaagaatgaaagctcaaaacccaattttcccttctcaccattctccttcttctcccaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggtgagatgggggtgtgagcagtatgtaccaactctgccaaacagtagcacatctttgatttcaaaacctctttgaatatgtcattgcccaccaatttcctgtaagcttgtctaaaattgctggttccaccaatgttatattttatggataagggttcgagaggttttttaaaacataatacatgaaattcttctaagtatttgcaactacgtagttcctcaacatgagttgaacattaacagcagagtcagatttacctacagtttcctggagacaccacctgttccagaaaacctctcctaacactccatgtagacacacatacatgctctcttgcttccaggttgggctaaggtacctgtcatcgcactcatgacaccctttgcatatttttcttgctggattttcactttgttttataattttttgtttaagtatttgtctttccctctagcctacgggctcattggggacaagactcctcttcacctccctgttcccagtgcctcacagtgtttttggcacatggtaggtgctcaccaagtagttaatgaatgaagaaattccgctagtttcatggaataccatttacagagaaaatggcaaagtcatccagatccctcattctgatcagaaacaagaactgctttcagaactgaaaatcccagggggaccccctaaaagctgtcataacccaatttagcatgagaatcatgccattcgctttcatctaaaatgtggcatcacacatagggctagtcccaagatgatctcagtaatggcttatagagtgagcagccctgggctaccagcttcatgtatcgttcttgacttcagaggcgagaagtattttgccagggaggtattgccgaatatgcagatttccctctgcttcttgaagaatctgttgttgctcccagtaaatgtgaagtttgctactatgaacgaggacttatgtctctcatttggctagaagaagtcattaaaccagtagatttgggctcttcttttagagtgtaactctaagtaaaagattaaccttcaatatggcagggatcatttcccaatctttgttggcatctttaaatgttaaagagaattttaaaactcttcaaaatgtacaagtccagttgagataccggacttagtttccgtctttccagctacattagaaaatttaggcagatgcataatgggcatttgtcaggcacggttctggaggtttctgtgaggattaaatggaaggatttcataaagcacctagcacagcctggcacacttcaggcactcaggaatgttaggtctcattattaccacaattattactgttgctgggtttgtaaaagctgctctaccccttttccttttgttcttgggctctgccgtagtttcctttgttcatcccatacctcattcccatacctcgggaatgaaggcagctgtttcctcccagaggaacctcagagttttccacaaagacttagatccgttgagcaaatgctgcgggattgtccctagtacagaggtgcttcttgagaaaaaagaggtcacagtatatatttagtctgctggtgccatcccctcacatttctctccttggccctcacaggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaata

SEQ ID NO: 373 - DNA, 321124 bp, Homo sapiens
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaagtaagttgagtgcgagggagccaggccgggagccagcggcggcgccgggccggagctgtcaccgggcgcccgccccgcggcctccgcgccccggcgccccccggcggggtgggggcggggcgggcccgcgggcggtggcggctcccggccccggccccgcgcccctcggtagccgcccgcgcccggcctcccccgctccgcgccgcccgcccgggctcccgccggcgcccggctccgcacactttacttttcagtcgggccttttcactgggtcttctccgcgactcttcttttggagaaatttctcgtagccgcgtcttggcctagctggatcattgagaaaacaagcccggagcgcgcccaggtagtccccggacggactccgggcgaaccgccgagccgtcggcgctcgggaaactctcggagctgtcaaaacgcccgggccaggtggtctcggggcgcgggctgggggcgagaagaaagcggccgggcgagtgcagcttttgtttgtcagcgacttgctcctggaacttttcctggtcccaaacctgtgttttcttcttttgatgatatattaggaagccatttgacttcttcctcccccctcccccaacacccagcaccgcactcccgggctccgaaagcacaagtcctgtgggatcccccagcttcggggaacggcctgcctaagttttggagacgtagccagcgtcccctcgtaaggcagaataccaagagcacttattcggagagagtgcagatgtaaatgtcgcttccctcgtaagtcttagctgtaaggggcttgggaatagggtcgcctgcctttgagcgtacagtagggctggaccccagcttattagaggaccagaaatgtcttcttacagaacggttatttgacggctttgcttgtaaattaagacaccgttttagtgccagcgaactgctcggcttctgtggctctcgcgtgtgccgtggaagaactgtgaatgtctctcgaagttgtagaatggcgtgtgtgcttactcatttcgtgagatgatattctcattgaactgtcgggagtggaagggtgcgctgggacgtgaaggaagccagcacgtttatggataggctgtttctttggttcgggtgcattcacttagtaatagtattgttgtttggtgatttgtagtaaaaatagtagcgtgaactgaggcatagcagagctgggttgtgggaacccattgagctcttgacttgaatgtgctcttttcttgccccgctgtccttttactatgaaaatgattcagggccttcaacttgcctccatattttattgccagctgttacctagctatgataatcgtgagggaagcaagtacaggatgtgtgtacattattacattagcttgttcgtgatacaaagttaggacttatttattatgccacttgcgttgtaatacagtggcaagtataaaatgcccttattctgtattaactgaaatttgtagaaggaagtggaggtttaagtaatttttagacatgtaagccacttttttttgcatcctttaaagcaactcaggacaagccatattggggttttaccttgattgcctcccatttcactatttgcaaagcatttcttcatctcttactgaacattaatttgcaagtattgttttaaatttgcatttgaattcttactccagaaagattagatctatgttgtcacaccccacaccccatactcctgtaagggcgtgcttgtgcacgcgcacacgcgcacactcacacgcacgcgcacactcgcacacaccctacttttgaaatgagctcatttgtattagtgcagctcctgagtgcactggacgattagggtattgccactttattattttaattctgaatctcatgaagaaataggcagcctttggagaagataaaaaatttctgctgaataacagtataatctaactatgaaaaatcaaaacttttggaaatatttagaacaaatgtaagtctgtagagagctttttcttttagatttgaaaactagtactgctttctttataggaaattaaagtctactggtaaatttgacgggtctaaactttttagagcgttttttttgaaattgtgtcttttgaagggaatggaatctccagttgtttttagcaacatgtaaatggaaactaacatatgaattggaaagcaaagaggtttttgaattgtgtatctctatactgtataagaatccatgcagaaaagaccctgtagttggacagtaaagaccctgaaagtgaaacttatgtgtaaccagtgtaaattaggtttgtaaccagtgaaattatgtgaaattgcaaataattcacctgagaaatgaaaattaatcttctttgctaaatctcatagagatattttaagttgctaatgttacttagatgttcattaacttagtgagttacattaagtagagaagatgccttttttttttttttctggacgaagtcttgctctgtagcccaggctgtagtgcagtggtatgatctcggctcaccgcaacctctgcctcgtgtattcaagcgattctccttcctcagcctccagagtagctgggattacaggtgtgcgccatcgcacctagctaattttttgtatttttagtagacacagggtttcaccatgttggccaggctggtcttgaacccccgacctcaggtaatccactctcctcagcctcccaaagtgccaggattacaggcgtgagccaccgcaccccgctgagaagatgccttttgacaatgaagtggatttatgtatttatctttggcttaaaaaaacatgcaccaccaattacactttcctcaagtttaaatttttaataattaggtaaataaagcattttcttgtcttatagtgttagctagattgtttttgtgtattttgtcatgaataaaaagcatagctatatagttactgcttttacattaactataaatatcttaaaattttactacctaaaatcaagaaacttgaactgaagctattaatcttagagttggaaaagtaaatacatagaggtttcctattgtacaaatgtcaagtggcacagtgaaatttacattcatttgaaagttttccttaactgtaaaaagtatcaaattatttgataatttggagtagttcatcatctttatcagaggcacaggtcttaaccattggcaggcctctgtcagaatatgcacatattaaagatctcattatttttgtgttaatgttaaaaaatttttctgaagcttttttcttattttttccatccttacactgtaaattcacattaccaagttgggaagccaaagaaacattctactctactatgtttcttaccagttcatgaaagttgatgttagaaatgggtgtgggtgtgggggatgggggtggttgtacagaagcagcaggtggtaggtataggatttctgaagcactatccttggccttttttgagtaaactctttataccctgaaccactttcttttcagagggcaattgctattattagagagccaccttaagcattattgttgtagaaaaattaggcacaaccagtgattgtcattacaaggaccagcaaaaatggctaggttgctactctgtatttgtaacgcccttcccccaacaaaatttctccttttcatagctgtgaatttgaaataagtgatagaaaactgtactgcattacaatatataccatttaataaaacaagtttatagttgagagacagcactattattcatgctttttgagataatgcaaatttgtaatttttatgacagcaattcttaataatttattgtccaagagatctgataaaatttttgatattattggtctctgggactcaataggcactgaaatgttttaattcagttgaaaagttgactcaggattgctaccctctcttacctgttaggaggttgttgtttaacctgacctgaaattcccatgaataagaacctgttttttttctttttttttttttttgacagagtcttgctctgccgcccaggctggagtgcagtggtgcgatcttggctcgctgcaacttccgcctcccaggttcaagtgattctcctgtctcagcctcccaagtagctggagtagctgggactgcaggcacgtactaccatgcctgactaatttttgtatttttagtagagacggggtttcaccctgttagccaggatggtctcaatctcttgacctcatgatctgcctgcctgggcctcccaaagtgctgggattacagacatgaaacaccgcacctggcccagggaatttctaatatttgagaagatgttatttttagtctattatacaaatttatatattgtttactaatatataaatttacatattagttactaatatgtaaacttaccaatttacatattggttactaatatgtaaacttgataaacatggatttccatggaaatataaaagtatcacaacaatttgttttcccattctgacacttgtgatttattacattttcgtactatttcagttaattccataatgccagaattgttgttaatctgccaagtgacaagccacactgcttcatctcattcctctgttccgcaaaactgcaaagtttcccagaccacagtcaggtttctctgggtagatagtggttgtccaactctgtaaacttaagtcactttaagtttatgatggaggggcttcgtgaaacttcattgaccttccaaggtgaaaattggtcagtttccagttataaaggacattaaggatgggtgtggtggctgatatatgtaatcccagcacttttgggagactgagtcaggaggatcacttaatcctcatttaaaaggagtttgagaccagcctgggcaacaaagtgaggccttgtctctacaaaaaaattagctgggtgtggtggtaggcacctgtagtcccaactactctggagactgagctgagagaagattgtgtgaggcttggaggttgaggctgcagtgaacggacatcacaccactacactctagtcaggtgacagagcaagactctctaaataaataggaacattagatggtctctctgcactcttgcctggtggggacgtgttagataccctcgttaggttgtgatttagtttttaatctgtgagatgtttgggccaaacaacttttagctgccatggaataaactttacagtcagcgtgtgagtttgtgtttgcctttacttttttttttctatattgttttggtccatttttatcttttaatttcagaaagctgattaatctcttccttttctctttaaaaattttctttatcatgtttgtgctacagtggttattttgagaacttgttggcaggataagtggcaaaagttacgaagtagaatagagatgatttctgtttttttttttttttcttttttttgagacagtctcactctcttgcctaggctggagtgcagtggcgtgatcctggctcactgtggctgccgccctccggattcaagcgattcgcctgactcagcctcccaaaaagctgggattacaggcgcatgccaccacacccagctaatttttgtgtttttagtagagatgggtgttcaccatgttggccaggctggtctcagactcctgacctcaggtgatctgcctgcctcggcactcccaaagtgctgggattacagacgtgagccaccacgcccggctgagattatttctttttttattatagctattgcttgtagatatatgctggtggttatctgtgaaaatgtaatagaaaggctgggcacggtggctcacacctgtaatcccagcactttgggaggctgaggtgggcggatcacaaggtcaggagtgggagaccagcctggccaatatggtgaaaccccgtctctaccaaaaatacaaaaattagctgggcgtggtggcaggcacctatagtcccagtgactcgggaggctgaggcaggagaatcgcttgaacccaggaggcagaggttgcagtgagctgagatcatgctattgcacaccagcctgggcgacagagtgagactctgtctcaaaaagaaaaaaaaaaaagtaatagaccaatcttggatttataattggaagtgttgatccctttatttgcagaatttgaaggacttaagagcacaagttgagagaaacaaatgacacagctctttttgcactttgtaatattctagaaaaagcctcaggtaaaaggaaaattgtttcactttgtttctgctgttaattttgtgatggcagtaactacatatgatctacaagtgtaaaattgtttaacaagtcttaagttttctatacttctatgtaactttttagatctttcatttggtacatgttatttaaagagctacaaagtgctaaatatgtcctgggatgaacagtcaaccctggaagatttattgtggcctagaggggtgctcaaagatttggaggaagtagtatttgaattagaccttgaaggattggtgggatttagccaagtagaatgacaagaaaatgagtgtgtgagggagcaatgtgaatgaaattattgagggaaggaggtgtaaaaggtggggtggcttctgactgtgtgactagaacagaggctgtgtgtagtggtgaggccaagctgtgatagttcttgaatgccagactcatgagtttgggctttatcctgtagtccaggagttataaactgtttacagggagcaggtaagcaatttaaatgaacagtaggctgcttctaagaatctgaatgacaactgacactttagaccttgggttggggagaaaatgggaaataataacagccttggggaagtctaggagtccttatgccctgcttaaggtgaaactgatacagaattctggctgatggttgctatttgagatgctgtttctagatttttcaagagggcggaaatttggatttttatgatttttttttttcttttttgagatggagttttactcttgttgcccaggctagagtgcaatggtgtgatctcggctcactgcaacctctgcctcccgggtacaagtgattctccttccttagcctcctgagtagccaggattacaggcacccaccaccatgcccggctagtttttttttttttttttttttttgtatttttagtagagacggggtttcaccatgttggccaggctggtctcgaactcctgacctcaggtgatccacctgcctcagcctcccaaaatgatgggattacaggcatgagccaccgcacccagccctttttatgatttttaaacttggattttaagtgtttttcattaattagaatctaaaacggtatttgcgcctatactttgtaggctaggtttaatctgcggaccaccaggggactacaggtctcaatctctgctttatgcccagttattttattttttaaatgaaagttttcaaagcaggtatttacagtattcttgaggataggaaccttactaaattactttgtattctgtttagcatttatgcatttgaatgtaggcactcaaatacttggtgatttaatgatgcctattattaaaaaaacactgtggtaataatatggagacaggagttacctggaggcagagataataggctgttacaatagttgtagtgtgagagatcaagccaaagcatagaatgttggtagtgcgaatggggaggaagattccagtcactgcaaaggaggaattcggcagtttctggcatagatgttgtagcaggcatccaaatagattggatgcctgctaagcattcggggaagtaggactggagttgaggaatcgattaggataagtatttaaagatgtgacttaacatgtaatcactgagaatatggcgtatgggaattagtaaaggattaggatgctttgttgcccttaggagataggggaccagttatacccggaaaaacaagaaaggaaatcagaatatattctcatgacaaatggacaacatatacatacaagatgctcatggcagcagtattagtagtagagaaaagttggcaacaacaaaatatgcatcaatggactaccatgcagttttaaatcaagacatagagatagatctgtgggccctgaagtgggagaatgtctatgatacattgttgaactagagaaaaacctttccaaaagttgtaaagcagtaagtttagcagtaactttattttgtgaaaagcacataaacccaaactgtgtgtatattttgtgcatataaaaagattgggaagaatacataataaatattaatactctgggggccgggcgcagtggctaacgcctgtaatcccagcactttgggaggccaggagggtgagtcacgaggtcaggagttcaagaccagcctggccaagatggtgaaaccccgtctctactaaaactacaaaaattagccagtcatggtggcaggcgcctgtaatcccagctactcgggaggctgaggcaggagaattgcttgaacctgggtggcagagtttgcagtgagctgaaatcgtgccattgcactccagcctgggcgacagagtgagactctgtctcaaaaacaaaacaaaacaaaacaaaaaaaaactctggggagtatattctttcagtatacatttatgcatttaaaaaaagaaaaaagcttaatacttcagaaatggtaaatcatttgacaaatgagaaaaccaaattctgggggcatcactgattatagagcctagaccttctggattcaagtctaggttgtactacatattagctgtttgaccttgggcaagttacttaaattttttgtgctatggttgcctcacctgtagagaggacgtaataatacacctaatttaggattgttatgaatttatatatatgtgtagaatttagaacagtttctggcatagactaagtcctattaagaggtgctgttgtaaggatttaactactgttgttactgtcattgccactaatcatcaattatcaatcagttgcctgttataaactatttagagacagaagtgattagaaaccaaactcactccaaaaatgccatgatataaggctgggtatgttggctcacacctgtaatcccagtgctttgggaagcaaaggtgggaggattgcttaagtctaggcgttagagaccagcctgggcaacatagtgagatccccatctctacaaaaaattaaaaatagctggatgcggtggtatgcacttgtagctccagttacttgggaggctgagatgggaggattgcttgagcccaggagttggaggctacagtgagctgtgatcatgccactgcactccagcctgggtgacagagcgagaccctatctcccaaaaaaaaaaaaaaaaaaaaaaactatgacataaaataatgcagttgttattggaggcggggatagtggggtggcaaagattttctttgtacgcagatgtccccaatatatagaagaaagatttttaaaaagctaggtcagcagaaatctctatgaaatgtttttcattatgagcaatacacgaaaaacagtcaaagcaattccctaggagttgtatatgtagtaatattattccaaagttttttattgctcaaacttttaaatgttgttagagtagatttttacatattataactctactggctagggttttattagtaggcctccctcagtgagacttgttttaggtggttttaaaatgatttcttacatcttttatccttggtcactttaaatctttacaccttattgtaatcgatttacattagaagcagcatacttgatggtctcagtgaagtctgtgtggtggtgttcttttagtggagcctagcaaaaaaagaatttccttgatttcctgatctttgggattctagtcatatggaccacatttggaataagcacatagttgaatataaaatgacaaaatgaaacataaccatattcttaaagttctcattgaattgttctaccatagttgaagtgtttggtcagtatggccaagtgtttgtttgtttttgagacggagtttcgctcttgtcaccctggctggagtgcagtggcacgatctcggcttactgcaacctatgcctccctggttccagcgattctccttcctcagaccccggagtagctgagagtacaggcgcccctccaccacgcctggctaatttttctatttttaatggagatggggtttcaccatgttggccaggctggtctcgaacttctgacctcaggtgatccacccaccttggccttccaaagtgcagggattactggtgtgagccactgtgcctggccctaagtgtttcttatattagactttcatacttatagagttgtagaatattagaactattaatagatgagaattcaagaagattgagtctaacccctcattttatagataactgagccccagagagattatggaatactagaagtcatatattaaggtgttacttttacagtaaataaaggagatggtagtctactgtattggtgtagacccatagtaaatcatgcctatgggtattcatgctattgtatagtcatctctctttgtatctcgcctagccctgtgactcactttaaccagtagaacatagcaaaaatgacactttgctatttttgggtacaagccttgagcatgtcaggcagcttctacttttgtactcttgggagctctgagttgctgccgtgcaagaagctgtcataccttgctggagagatgatgtggagaggaagagattccaggactatatggaaagagggaggcttaactatctcagtgtcctagctgccttcagcccttagttgacttgcctgttgaatacagacacaaaagtgattagtaagattagcgaaggggccggcgtgggggcttatgactgtgcagtcccagcactctgggaggccaaggcatgtggaacacttgagcccaggagttcaagaccagcccgggcaatatagcaagacactgtctctacaaaaaaatacagaaattagctgagtgtggtggcatgtctctgtagtcctagctacttaggaggctgaggtgggaggattggtcaagcccaggagggtgaggctgcagtgaaccattatcttgccattgcactcaagcctgggcgacagagtgaaaccttgtttctctctctcacacacaaaaaaaagattaacagaggaaccacctagctaagctcagtccaggttacgaaatcataaataagtaaaatgctggttgttttaatctgttttgctggaagcagatagttttctgaattaagggacgctaagaacaaagagtatttggagctgggtgtggtagtacatgcctttagtcccagctacttaggaggttgaggtgggaggatcacttgagcagaggagttggaggctgcagtgagctatgatcctgcaactgcaccccacccagcctgggtgacagaacaatacccggtctcagaaaaaaaaaatgcatttgggatacgagtgataaaaatcattattttccatcctcttttactgaaatagttaaatgaagtttctccttaaccttaccctttatttttctaaagtattttgaaatacagatttttattattgaggactttaaatagtatttaaaaatggaattgtcacagtgtagattgggctatagttaggtcatacagaatagaaagataaaacaattatgaatatcaaccctaaaaaggatatagtttatttatttatttatttttgttgacttgtacagagatctttatatatttgagcatcctggactcttgacagaagaactgatttctatttctgggccaattcttaacagccgggtatatcagtaaggactaggtttgtctttatgtgattgaaaaccccgtaataataatgacttgaacaggagtgtttatttctgtttcacttcaaaatctggagggtaggtactgaggctggtattgtccctctacactgcaaagtcatcaggagtgtctccctttatctaacttctcagacatttctaggttgtggcctttgccctaagattccttgatggctactaaagtcccaattacattacatgcatgtcccatgaagcaaaatacagaaaggagtccaagggcacacagcctcctcctttgaagaaatattgtatgttttctcttacatataattggctagaactatcacagagttcacatggctacctgtagctgcaagggaggctgggaatgtagtttgtttgttttctgagacagagtctcgctctgtcatgcaggctggagtgcaatgacatgattttggctcactgcaacctccgcctcccgagttcaagcgattctcctgccttagcctcccaagtagctgggattacaggcatgcaccaccaagcctggctaatttttgtatttttagtagagacagggtttcaccatgttggtcaggttggtacgaactcctgacctctggtgatccacctgctttggcctcccaaagttttggaattacaggcgtgagccaccgcacccggctgggaatgtagtttttttttctttttttctttttttttttttgagatgagagtctcgctctgttgcccaggctggagtgcattggtgtgatcttggctcactgtaagctccgcctcccgggttcatgccattctcctgcctccacctcctgagtagctgggactacaggccaccatgcctggctaattttttgtatttttattagagacggggtttcaccgtgttagccaggttgatcttgatctcctgacctcgtgatctgcctgccttggccttccaaagtgctgagattacaggcgtgagccactgcgcctggttgggaatgtagtttttttagatgagtaccttgctacttagaataggttcaaagtctggttactgatggtgggaataaatattacagaaatagctagtaaatagtctttaccactttgagcaattggtttatcaccataggcctaattttctcatgtgtgagaattatgatactgaagttcttgcgatggcagataatttcatgttgaggcccggttgattggtagtgactgctttcaacaatgctttgttgaatcctgagcccccagggttttctttttttttctttttgagacagagtcttgctctgtcgcgtggctggagtgcagtgatgcgatcttggctcactgcaacctccgcctcctgggttcaagcgattctcgtgcctcagcctccctagtagctgtgattacaggcatctgccaccacgcctggctaatttttttttttttttttttttagtagagactgggttttgccgtgttggccaggctggtctcgaaatactgacctcaggtgatccacttgccttgtcctcccaaagtgctgggattacaggtgtgagccactgcgcccagccctaagcctccagtttttgacctcagcatggtgaggaagtagtagaagtatgtattttgggtgaagaggagagtaaaagcatgctcccatttatatgctaacgctgtgctttttaaaaatgtggttacttcaacttttgtaatcttttcattgaaaacatttggttattctgctaacctttgactattctctttaaaaatgtcctacattcattccatattttaaagttttctaataaacctgagttcccacttgttttttttccttccagcttttattttaggttcaggggttacatgcacagatttgttaacatgggcacattgcgtgtcgctgaggcttagagcacaaatcattttgtcactcagatagtgagcatagtacccagtaggtagtttttggatcctcaacttcctcccagcctccaccctcgagtaagccttggtgtctcttggtcccctctgtgtccacatgtacttagtgtttagctcccacttggaagttagaacacacagtatttggctttctgttaattaattcgcttacgaataatggcctccaactgcatccatgctgttgcaaaggatcatttcattctttttttatggctgcacagtattctgtctcgtatatgtaccatgttttctttatccagtccgctgttgatgggcagttaggttgattccatgtctttgctgttgtgcaaagtcctgtgatgaacatatgtgtatgtgtgtctttatggtagaacgatttctattaatttgggtatatatccagtaatgggatacctggattgaatggtagttctcagttctttgagaaatccccaaagtgcttttgacagtggctgaactaattaacattcccactagcagtgtataagccttcccttttctctacaaccttgccaacatgttttttttgtgtgtgactttttaatcatagccattctgacttgtgtgagatggtatctcattgtggttttgatttgcatttctctaatgataagtgatgttgagcattttttcatatgcttgttggccacatatgtcttcttttgagaagtgtctgttcatgccctttgcccatttttaaatggggttgttttttgcttgttttttttttattataaactatttttttattatactttaaattctagggtacatgtgcacaacttgcaggtttgttacatatgtatacaaggtgccatgttggtgtgctgcacccattaacttgtcatttacattaagtatatctcctaatgctagttttttgcttgttgatttaagttccttacagattctgtatattaggcctttttttttttgagatggagtctctttctgttacagtctggagtgcagtggtgcgatctcagctcactgcaacctgtgcctcccgggttcaagcaattctcctgcctcagcttcccgagtagctgggactacaggcgtgcaccaccgcacccagctaatttttgtatttttagtagagatggggtttcaccatgttggccagaatggtctcgatctcctgaccttgtgatccacccacctcggcctcccaaagttctgggattacaggtgtgagccactgagccaggccaggcctttgttgaatgcatagtttgcagatattttctcccgttctgtaggttgtctgtttactctgttgataatctcttttgctgtgcagaagttcccgctttgtgcagaacattccaaacactggagatagggatgatgcagataaatactaaactcctttaatgtgtatatcagaatatacagaatatgttacggtgacaaaggatcccaattcttagtggcatcagtcacaaaggttcatttcttgctcatgctatgtgttcatcacagatcggtgtgggtgttagattataggtgacttaaaatctcttcctttcaaagtacatttctgaagcatggtttattcttagtcagatttgcttttcctatttgttctctgttaatcacccaaggaggatgttaggcaaaatcaaatactgagaatctgctgtgtattatacagtggagagaccaaaataaggcaagatccctaccttcaatttctggtaactcagtgcaaagtataatgcaaatgacacattttacaatagatttcagaaagtgctgaggaagcttagagaaggaagaacttatctcagaggaactgaagaaagaagacatctttgttgagtgtttaaaaatgaaaacagactttaccgaagagaaaaaggggagtgagaaactagtacctggctattatgtgttaggcactactagtgcttaccagaagttacctttttgataattactgatcacatggggttgaatcattagtacgttttacaaatgaaagatgaatttttatatagcttgtaagtgattgagtcaggatttgaatccaggtgtgtctgaccctgacctttgctttttaagagactacagtccaatatgggaggaaatgaggaagggaaagtaaattgggcattttgaatattaactgtaaacaatagggagccattgaagatgttaaacagaggtatgacattgtatctgtgttagaaaaataaccggcaacaactgtaaaactggaactaatgattttttgcatgtgattaagtatcaaatgaagtataatttctgatctcctttaatttgtttgtagtattttataattttcaatgcacaggtcttgtactttttttgttaaattgattcctaagtatttcattgtttttgatgttgttataaatgtaaatgttttctttcccccacttttttttttggagacagagtctcgctctgttgcccaggctggagcccagtggcatgatctcggctcactgcaatctccgcctcccgagttcaagtgattctcctgcctcagcctcctgagtagctgggattacaggcgtctgccaccatgcccggctaattttttgtatttttagtagagatgggcttccaccatgttggccaggctggtctcaaactcctgaccttgtgatccacctgccttggcctcccaaaatgctgggattacagacatgagccaccatgcccagtctattttttttcttttaaatgaaaaacaaatctttttatgtagggacagtcgtctcactatgtcacccaggctggtctcaaactcctaggctcaagtgatcctcccaccttggcctttcaaagtgccgaaattatagacatcagctaccacacccagcctgacctattctctttcaaacttttttcatatacacagtttttttttttttgtgatactacttatgtacatttagagttttgtaacctactttcccttgtaacatgtaaaagaaaatttccgtattgttaatcttttataacatttttgaagggtgcttaattttccattgagtaaaactgagggctgagtgctgtcgctcacgactgtaatcccagccctttgggaggctgaggcaggcatatcacaaggtcaggagttcgagaccagcctggccaacatagtgaaaccccctctgtactaaaaatacaaaaattagccaggtgtggtggcatgcgcctgtagtcttcagctgctcaggaggctgaggcaggagaatcgctggaatccgggaggtggaggttgcagtgagccaagaccacaccattgcactccagcctgggcgacagagcgagactctgtctcaaaacaacaacaaaaaactgagtaaccacactataatttatgtaaccatacagctgtctccccttttcctcttctcaccctactgccttttgttactatgtgtaatgctctggctgacctttttgtagataaagcctttttcatattttggttatttttataggacagattaccataggcaggataattaggttaaaaaataagcatttggccgggcatggtggctcacgcctgtaatcccagcactttgggaggctgaggtgggtggatcatctgaggtcaggagtttgacaccagcctggccaacatggtgaatccccatctctactaagatacaaaaattagctgggcgtggtggcgcacacctgtagtcccagctacttgggaagctaaggaaggagtatcgaggcaaaggttgcagtgagccgagattgtgccacttcactccagcctaggtgacagagtgagactccatctttttttttttttttttttttaaaagaaagagggtgggcgcggtggctcatgcctgtaatcccagcactttgggaggccgaggtgggtggatgacgaggtgaagagattgagaccatcctggctaacgtggtgaaaccccgtctctactaaaagatacaaaaaattagctgggtgtggtggcaggcgcctctagtcccagctactcaggaggttgaagcaggaggatggcgtgaacccaggaggcggagcttgcagtgagccgagatcatgccactacactccagcctgggcgacagagcaagactccgtctcaacaacaacaacaacaaaaaagcattttttgattcttcatagatattcagaagcatataggctctaatgtctatttgcttattgtcaaattctggtcttatcactttctagttgttggactttgtataagctgttcaatctgtatctgtttgttacctataaaatagggatgataataacatctttgtcacaggattattaaaagatttaaagagggtatatgtgttaagaaagccgctagaggccaggtgcagtggctcatgcctgtaattctagcactttgggaggccgaggtggatggatcacctgaggtcaggagttcgagaccagcctgaccaacatggtgaaacccatctctagtaaaaatacaaaaattagccagacatggtggtgggcacctgtaatcccagctacttgggaggctgtggcaggagagtcgcttgaacctgggaggaagtggttgcagtgagctgtgcctattacttagtaagttcttagtaaatacgaactttttaaaattttttccttcttatatttgatgccttagcaagcaataaatataaactctttttttgagataaatataaactcttttttttttttttttttttgagatgatgtctcactgtgtcacccaggctagagtgcagtggtgccatctcggctctccacaacctctgcctcccaggttcaagggattctcatgtgtcagcgccctgaatagctgggattacaggcgtgtgccaccatgcctggctaattttttgattttagtagagacaaggtttaccatgttggccaggctagtcttgaactcctgtctcaagtgacctgcctgctttagcctcccaaagtcctgggattacaggtgtgagccaccgtgcccggcttgatctcttatttttttaaattacattgaattttttttttttttttgatacagagtcttgttctgtcacccaggctggagtgcagtggcatgatctccgcttactgcaacctccgcctcctgagatcaagcggttctcctgtcttagcctcccaagtagctgggattacaggcgcgctaccatgcctggctaattttttgttgttgttgtttgtttttttttgagatgagtcttgctctgtcgcccaggctggagtgtaatggcgtgatctcggctcactgcaaactccgcctcctgggttcacgccattctcctgcctcagcctccctcccgagtagctgggactacaggtgcctgccaccatgcccggctaattttttgtagttttaatagagatggggtttcaccgtgttagctaggatggtctcgatctcctaacctcgtgatctgcccgcctcggcctcccaaagtgctgggattacaggtgtgagccatcgcgcctggcctacgcctgactaatttttgtatttttagtagaatactaaaaatacagggtttcgccatgttggccaggctggtcttgaactcctgacctcaagtgatctcccctgccttggcctcccagaatgcttggattacaggcataagccaccatgcccagccctgatctcttatttttattaaagttttgaaatgccactccctaaaaaggttgcatcaatttgtaatgtcattagcaatgtgtgataggtctagttttatcaaacctttgtcatgtatgatatattaaaatctttatcttaacaacagaaaaaaagtagttctaagcttttacttacttgattagtaggactaatgaatattttgaatttctttttcttttttctttgagacctgagtcttacactgttgcccaggctggagtgccgtggcacgatcttggcttactgcaaccttcgcgtcccaggttcaagcagttctcctgcctcagcctcccaagtagctgggattacaggcatccaccaccacgcccagctatttttttgtatttttagtagaaatgggttttcactatgttggccaggctggtctcgagcacctgatctcatgatccacccgcctcggcctcccaaagcgttgggattacaggcatgagccaccgcgtcagcctttttttgaattttattacttgtatttcttgcgaattgcccagtcgtgttttgtccatggtttattggggtgggggcattctaactgtttcgtatcattaatttaagcttgttgtatgacatatttgctctaagaatttcacctcatttcattgtataggtaattatcttttgtgtagtgaaaagtcccattatttcttttagttcatttaagattttattcaattatttatagaagtagtaagataaatatttgtagataggtaaacaaagcattagaatttttgacttttagaaagtaaaatcatttgatttaatgtctatttttgttcattcctatttcctatctaattaatagaacacagtactgggaggaggaacaaaattttaatcatgatattgctgtttttcataataatctaggactagtaataagtcctctctttcatccagaaaatattgaaggccggatgccatcacctgtaatcccagcacttgaggctgaggcaggctgatagcttgagctcaggatttcaaaatcagtctgggcaaaatggtgagatcctgtctctacaaaaaaataaaaaattagctgcatgtggtatgcacctgttgcctcagctgtttgggagactgaggagggaggatcgcttgagccttggagattgaggctgtagtgagctgtgatcatgccactgcactctagcctggtagcagagcaagaccctgtctcaaaaagaaaaaaaaaaagaaagaaagtattgagaagttaacttatttcattaccttaatgaaaaatagttaaggccaggtgcagtggctcacgcctgtaatcccagcactttgggatgctgaggtgggtggatcacctgaggtctagaatttgagatcggcctgaccaacatggtgaaacctcttccctactaaaaatacaaaaatgagccaggcatgatgccgggcgcctgtaatcccagctaaaaaaaaaaaaagattttttccaaatacagtatttttattaaatcttattgagtagttttcacattggcaactctgtgtgtttctttctttttttgagacagagtttcgtgcttgttgcccaggctggagtgtgatggcacaatctcggctcatggcaaccttcgcctcccaggttcaaacgatactcctgcctcagcctcctgagtagctgggattacatgcatgcgccaccatgcccggctaatttgtatttttagtagagatggggtttctccatgttggtcaggctggtctcgaactcctgacctcaggtgatccgcacccccttggcctcccaaaatgctgggattacaggtgtgagccagccaccacacccagctttttgtgtttcatatgcatttttttttttttttgaaacagagtctcactatgtcgcccaggctggagtgcagtggcacagtattagctcactgcaacctctgcctcctgggttcaagcaattctcctgcctcagtctcctgagtagctgggatcacaggcgtgcgacaccacgcccagctaaattttgtatttttagtagagacagggtttcaccatgttggtcaggctggtctcgaatttctgacctagtggtccgcccgccttggcctcccagagagttgggattacaggcatgagccatcgcgtctggcctcatacattttctaaatgacttttgtaaatttttttttttttttgagacggagttttgctcttgtcacccggactggagtgcagtggtgcgatctcggctcactgcaacctccgcctcctgggttcaagcgattttcctgcctcagcctcccaagtagctgggattacaggcgcccgccaccacacctggctaatttttgtatttttagtatagatggggttttgctatgttggctaggctggtctcgaactcctgacctcaggtgatccacctgcctcggcctcccaaagtgctgggattacaggcgtgagccaccatgcccggccagtttttgtaattttaaagagaacaaaaatcctgagatggaaacttatgtagaattttattcatagttgaagttagttacagtggaaataaaaactagaaagttgcattgtatcttctaaacatatgtatttaacataatttcacatttcattatagatggttctttggaatgatatttaaaaattttgtggctgggcgcagtggcttacacctgtaatcttagcactttaggaggctgaggcaggcggattgcttcagctcaggagctcaactagtctgggcagcataacaaaaccctgtctctacaaaaaatacgtaaattatccagctatggtggcccgcgttagtagtcccagctactcgggaggctgaggtgggaagatgacgtgaacccaggaggtcgaggctgcagtgaggtaaaatcgcaccactgcactccagcctggacaaagtgagaccctgtctccgaaaaaagaaattgttataatgaatgaatagatttacattgttagtttagttttgttttttttctcagaagtgtagagtttgttcttagtctgtccatctgtatacaagcatgaactgtacagtcaactgccttgtagaggggctggtttttggttatgtcttaaatcttaactccttttaattattctgaattttagtgggattcctatatcattgtagatttggaaagtattgagtaggagatgataatctataatcaggattctgagttggtaagattttatagatctgaaaaaagtaatttcttgaccttggcctcaataagaaagtcagaacttgacccttatttaccagcaccatcccccccaccacaatatttaaagtgtttaaatcatttattttgaaattcttatgtgatccaagaccactgtgcatttaagctagtttatttgtttattaaaacaaaagaagtagactgcagttacgttgtttctttttctgttgtttggtgtcaggagtagaatacatttggccagcttcatgagaggattagaaagttggagaaggaaaaatagaattgtttacggagccaggagaataattgtctataattatagatgcttgttttgaggtttggaaaaggtggtttaaaaaacttttaagaaaaaacatgataaacatctataaatatgaggaagaaaaattggttgcaacattaaaaaaatttttttttgagagggagtcttgctctgtcgcccaggctggagtgcagtggcaggatctcagctcactgcaacctccgcctcccgggttcaagccattctcctgcctcagcctcctgagtagctgggattacaggttcctgccacgatgcccggctaatttttggatttttagtagagatcgggtttcaccatgttggccagactggtctcaaactcttgcctcaagtgatcagcctgccttggcctcctaaactgctgggattacaggcatgagccaccgctcttggccaggttgcaacatcttcattagacttgtttaaatgagaattttcctttgttaaatggaagaaaataggctctgtttgggagagtgaggcccaagtaggacatccttgatacacattgaagatctatttatttatttatttaaattttttgctctgcaaaattgaccaaagaatgaagatcattttagttggttaatatttcagttttgacttcctggccagagatagtagattggaaaggatttagagatttactgagggagttaacccaagattttaacattgtgatgcaaaatgatgttaaaacgcgttcgtttcccttttattatttaaagaaatcctagatttctttaaataatacaaagtaattaaatggacctgttgggttatttgaaattaagcagtagacaggggaagttcttgtaagtggttactaaagcgttaacattagaggcattctccactggctggctgtagcagagtccctgatctgggctttggagaaatccatcccacctttttttaggtgcctgctttacgtcggatctactttctctactcgtgccttttcttccaccttcttccccctcctctttctcatagatggtgtggaggtgggagagagggagggagagggagatcaactgattattgtgtgttgagggggtggggggtcagagattctctgggccataaaagttgcacgaaataaaatgctcttttttttcttgtgtgggccctgccatgagatcaggttgtcggacttgattgggagccacggatcccgccctactgaaaacattgttgcaggatgggatgggatgaagctgaaagtcttatcaagtggtattatatctggcacaacaaaaggccagaaccccaaaatatcctaaggataaaaagtttttgtttcttttcataggatatttttgtatctggtttggaaggatgacttgacttggattgtactgttaaagacaaaatgaactattgtatttattatgtatttaaccttattaaagcattaagtatgacagcactagttatagagaattgtgtgtgtatgcacacatatacacacatatacatatatacacacaccatatatatattttttttgagacttggtctcgctctgtcatccaggctgaagtgcaggagtgagatcttggctcactgcagcctcgaccttccaaccccagtgatccttccacctcagcctcccaagtagctggggccgtggggatgtgccatcaccaccagctaatttttttatcttttattttttgtagagacggcgtctctcgatgttgcccaggctgacctcgagctcctgggttcaagtgatccacctacctcaacctcccaaaatgctgggattataggcgtgagtcactgggcccggctgagatgtatatattatatatacatctcatatacatatacatatatacataatctcatatataaaaattatacattatatataatatttataatataatatatataaattaaaacttaaaaaaaattttattttatttgagatggagtcttgctctgtcgcccaggctggagtgcagtggcgctgtctcggctcactgcagcctccacctcccaggttcaagcgattctgctgcctcagcctcctgagtagctgggattacaggggtgtgcttccacacctggctaatttttttttttttttttgagacagggtcttcctccgtcgcccaagctggagtgcgagggcgcgatcttgactcagtgcaagctccgcctcctgggttcacgccattcttctgcctcagcctcccgagtagctgggattacaggtgccagccactatgcccagctaatttttttgtgtttttagtagagacggggtttcaccatgttggtcaggctggtcttgaattgctgacctcgtgatctgtctaccttggcctcccaaagtgctaggattaccggcatgagccaccgtgcccggcctatatttttaataatgaaatcagaactaggtttgtaaacagggaaagaacaaataatcataaaagttttatattctggatttggaagttggttgatttaagagtaatgagaataaataatatcccctccccctttagttctcaaggttttccacttagtttaagtagttttattagctatagtagagtaactcagcattttgaaatatttgtataatttgaaaagtctctgaaagaacactgtgattcgggtatagcattgcaagtttgaggggtttcaacagatttcttcatgtgtgtttaattccatgatgatttaaaaaaaaacccaagaaataaaacctctggtcacttaaccagcattttattttatttatttttattttattttattttttttgagacggagtcttgctctgtcacccaggctggagtgcagtggcgtgatctcagctcactgcaagctccgcctcctgggttcaagcgattctcctgcctcagcctcccaagaagctgggactacaggcgcccgccaccacacctggctaattttttttttttttttttgtatttttagcagacatggggtttcactgtgtggtagccaggatggtctcgatctcctgacctcctgatgcacctgcctcggcctcccaaaatgctgggattacaggcgtgagccactgcacctggcccacttaaccagcattttaacatatttcttctgaaaatctgattaccagaatttaattacattagaagaaattttttaaaaagctcataactattacgtagcaaatatgttttcaaagaacttgttttaaggtgggtcttggtggctcacacctctaatcccagcactttgggaggctgaggcaggtggatcactcgaggtaaggcgttcaagaccagcctggacaacatagtgagaccctgaccctaaaaaaaatacaaaaattagccaggtgtgatggcacattcttgtgtgatcccagctaatcgggaggctgaggtggaaggatcaggttgagctccggaggtcaagactgcagtgagttgagatggcgccactgcacttaagcctgggtaacactaagcctgggtaacagagggaaactctgtctcaaaaaaaaaagagagagaaacccacccagtttgatgaattagatgcatgttaagtgaaacagttttttagatagtgtagaattaacttcattatgttcacagttaaattcatattagactgttacctattctaagatatttgatattaaccctcaagggacattggctacattttttttttttttttttttaacaaaaccttgtagtttatgttagtggtctccaaactttttggcaccagggactagttttgtggaagagagttttttccacagaccccagggggagcacggagtggatggttttcgggtgaaactcttccaccttagatcatcaggcattagttaggttagttagattctcataagaagcatgcagcctaggtcccttgcttgtgcagttcacaatagggtttgtgcttctatgagaatctaatgccgctgctgatctagaggaggccgagctcaggttaatgctggcttgcctgccgctcacctgctgtgtggcctggttcccaacaggctaccgagtggtattggtctgcagctataggtggggggaaccctgagtacgataaactatcttctagaataatttttttaatatattgaagcagtagtgcctagtttataagtagacatatgtatagtataaactatatagtttatattcagagtacaaaatccaccttggccactatttttttttttctttttttgagatggagtctcactctgtcacccaggctggagtgcagtggcacgattttggctcactgcaacctctacctccctggattcagcgattctcatgcctcagcctcccaggtggctgggattacaggcacacgtcaccacacccacctaatttttgtatttttagtagaaacggggtttcgccatattggccaggctggtctcgaactcctgaccttgtgatctgcccacctcggcctcccagagtgctgggattacaggcgtgagccaccccacccggccaccttggccactattacaaaagtaaagctaaataatactgaagtatatgttccatattttgtaaggactgttgatttggaaacagtgtattctaacaagataaattttaaatgtaactaatagtatatgtttctgaataaatagttgctgcttctaatataaagtgtcatatttgttttaaaatcattgctcaagttgtatagttgttttgggcacgtattttcaacttctagaccaatacaaaatgtaaaataagtaaaagacgtgatatagttgtatcctttctaaacactgacctattttttttttttcctttgctaccttttttttttttttgagacagagtctcgctgtgtcgcccaggctagagtgcagtggtgcgatgttggcttactgcagccttcgcccctcgggttcaagtgagtctccggcctcagcctcccaagtagctgggattacaggcgtgtgccaccatgcctggttaagtttttgtatttttagtagagaccggttttatcatgttggccaggctggtttcgaactcctgacctcaagtgatctgcctgtcttggcctcccaaagtgataggattacaggcgtgagcctccgtgcccggcccctttgctacattttaatgataatgaaaatgtaatccaagtgtcagattattcagtagcttcctgtcttttggtttgtgggaagtttgatacgttattttttaatgtttcttagtcctttgttatatttcatggatagtggggaagtgagtctgtgacttgattgaaatatattgtacaatgcattcatctgcatcataggcacttggcttttaatggtaaagtggaaactaaacttctccttaggaacaatttgcactaatttatttaactgatattgatgatgctccataaagataaaaatgtcattgcatggaggcttacttgtgatgtaatttgtactttggagaagtaaatcatagtatgattttagatgttttattaacatctaaaatgtttcagtttctgtagtagaatattgttaaataaaatggtaaacactgtaaaccttaatactccttcccaagaagaaaccattaccaccactacctcttctccctccaaaacagaaaccattaccacctccacctctaacaacagaaaaaaaaaaccaaaaaataaaaaaacccttttttggccccacaccttttttggctcacacctgtaatcccagcactttggaaggccaaggcgggatcctcttgagaccaggagttcgagcccagcctgggcaacatcaggagacctcatctctactaagaaaaaaaaatggctgtgtgtcgtgatacacctatagtcccagttatttgggaggctgaggcaggaggatcacttgagcctaggagttcaaggctgcagtgagccatgattgtactactgcactccagcttgggcagcccaggaagactgtgtctcaaaaaacaaacaagaacacctttttaatctgttaactcatggtttgtttaagattttcttttagccatttttgatgccttttttttttttgagacaggttctcactctgtctctcaggcgggagtacagtggtgtgatcatggctcattgcaccctggacttcccagaatcagatgattctcctacctcagcctcccaagtagctgggactacaggcacacaccaccatgtccagctaatttttgtattttttgtagagactgggttttgccatgttgcccagagtggtcttgaactcctgggctcaagtgatccacccaccttggcctgccagagtgctgggattataggcatacgccagctgcacccagcccatttttgatatctcaaatctttcatcatagtttagtcagccatatttttcctagaatttttttaaaaactattttgtcttgctatcaagctattactctgtagttttacatacattctttattttaactaaactgttatgagcaataatttgtgataacttttttttttttctgagacagagttttgcttttgttgcccaggttggagtgcaatggcgcacatgatcttgactcactgcaacctctgcctcccaggttcaagcgattctcctccctcggcctcccgagtagctggaattacagccatgcaccaccatgcctagctaattttttatttttagtagagactgggtttttccaagttggtcaggctggtctcaaactcccaaccttgggtgatctgcccacttcggcctcccaaagtgctgggattacaggcgtgagccaccgcaccctgccaatttgcgataactttttaatctttttgtatcgtgtatttaaacttttaagttcttttccctgtcaatttctgacagattgaaaaataataatctttatattatttaaaagcttcttctaaaaggtacaaaggaaaaaatagaatgcaaagtgaactaggcagcgtgtagtggctcctgcctgtaatcccagcactttgggaggccaaggtgggcagatcacatgagaccaggagtttgagaccagtctggctaacatggcgaaaccccatctctactaaaaatacaaaaattagccaagtgtggtggtgcatgtctataatcccagctacttgggaggctgaggcatgagaatcacttgaccctagaaggtggaggttgcagtgagcagagatcgagccactactccagcctgggcagaaaaaaaaaaaaaaaaaaaaaagtgaagttaaactaaatttagatctgttgagtttgaaatgatggttgtatatacctctaagatcagtaaaacctaaatcaatctagagaacaggtgttaaagatacatttttggtggggtgtggtgcctcatgcctgtaatcctgccattttgggaggccaaggcgggtggcttgcttgagctcaggagtttgagaccagctgggcaatatgaagaaaccccatctctacagaaaatacaaaaattagccaggcacagtgctacacgcttgtggtcccagctcctcagaaggctgaggtgggaggattgcttgagcgtgggaggcagaggttgcagtgagctgagattgtgccactgtactccaaactgggcaacagagggagaccctatctcaaaaaacaaaacaaaacaaaacaaaaaaacaaaaaagattttcatgctctggtaaaataagtattaaaattaggaaactatggatgaattgaatgttttggtctggtcgaagtactgtgcattaaatttttggttacattttactttgataagcagtgacggttcagtaattttgatgatagtctatacatcatgtaacttgacttatttagttgtcaacaaatatcttttttttttgagacctgagtcttgctctgttgcccaggctggagtgcagtgctgcgatcctggctcactgcaacctctgcctcccggattcagattttcctgcctccgccttctgagtagctggattacagatgtgcaccaccacgcctggctaatttttgtatttttagtagagacagggtttcagcatgttgaccaggctggtcttgaactcttgacctcagaagatctgcccacctcggcctcccaaagtgctgtgattacaggcgtcagccaccgcgcccggcctagagataccttttaaggtggttctaaagcctcagaaattatttatcctgaagagaaagattaaagttttattcattgcattatgagggaaagtttaggcagagtatcttatggttttgtttttcattaaaagatcaatgttctttcagattttaagtccatttaaaaactttgcatagtaatatatgtacatggttgaaaaaagtctaatagcccagaatgcttataataaggatcaagaattctgtttcactccttattgccactctccaaacaacttttttgtatcaatttaagggttacaggtgcagttttgttacatgaatacattgcatagtgctgcagtttgggcttttagtgcatccatcatccaaataatgtacgtgtacccattcagtaatttcttgttactcaccctcctcccagcctcccaaccttctgagtctccagtgtcgttattccacactgtgcccacatgtacacattattttgcttcaacttataagtgagaacatggcctccaggtccttccatccttccacgttgctacaaaagacatgatttcattcttcctttatggctgaatagtattcgtgtgtgtgtgtgtgtgtgtgtgtgtgtgtgtgtgtgtgtgtgtatgtgtcccagtttttctttatccagtcgtctgttgatggatatggagattgattccctatctttgctattgtgagtgttgctgtgataaaggtacgagtgcagttatctttttgatataatgatttattttcctttgggtggatacccaatagtgggattgctggattgaatagcagttttattttttatcatttttacttttttgagatggagtttcgctcttgttgcccaggttggagtgcaatgacatgatatcggctcagtgcaacctctgcccaccaggttcaagtgattctcctgcctcagcctcccgagtagctgggattacaggtgcacaccaccacgcccagcaaatttttgtatttttagtagagacagggttttaccatgttggccaggctggtcttgaactcctgacctcaggtgatgcacctgccttggcctcccaaagtgctgggcttacaggcgtgagccaccgtgcctggccagcagttttattttttagtcatttgagaactctttatatggttttccatacaggtggtactaatttacattcccgcccacagtgtgttaagtgttccccattgtctgcatcttccccaacatctgttattattattgtttctttaatagtggccattctgattggtgtaagatgatatgtcattgtggtttttatttgcatttcctcgatgattagtgatgagcatttttttcacatacctgttgactgtttgtatgtcttcttttgagaaatgtctattaatgtcctttgctaactttaaaattcttaaaaattttttattaaaattttttcttaagaccagttaagtgcagtagtgaaaggggagtaaagagtatagaacaaggaatttgatcggtaactgacagtgaaccatcaattgggataactcactaccagttatcagtagtgaggtattcagaacagccctttgcttactttttgatgggattatttgtgttccttgtaaattctggatgttagtaccctgtgagatacatagtttgaaacttttttctcctattctgtaggccatttgttcagtctgctgattcttttgctatgcagaagctttttagcttaagtctcatttgtctatttttgttttttttttttttgcttgtgcttttgaggtcttagtcatgaattctttaaattcatgaattcttagtcatgaattgtatagatcagtgtccaggagagtttttcctaggttttcttctaatggtttttatagtttcaggtctttggatgaagtctttaatccttcttgagttgatttttgtatatggtgaaagataggggtccaatttccaaaggaaactttcaaattatttcttcctgtggtattgtcgtgactatataatatacatatgttatgatttatgattgatttctgctctgataaaggaggatttggcttctttacatctgcttccccaatagattttttaaaaatcacttttaatttctctgctagttatctctgcagtttatatcagaactttccttcatgttatatagactgttgatcttgatgtaccaagcagtaacttttgtttgtttgtttgtttttttgagacggagtttcactcttgttgcccaggctggagtgcaatggcgcgatctcggcttgctgcaacctctgccgcccgggttcaagcgattctcctgtctcagcctcccgagtagctaggattacaggcaggcgccaccatgcctggctaattttgtatttttagtagagatgaggtttcaccgtgttggtcaggctggtcttgaactcccaacctcaggtgatccacctgcctcagcctcccagagtgctgggattataggtgtgagccaccacgcccggctgcaactcttctttttacctttccttttccctttatgtgcttacatctgtcatttctgacattgacattgtcaaggttgagaacagttatgcgctgtattgtactccttactactttgtttgtttatttatttatttttttgagacagtcttgctctgttgcccaggcttgagtgcagtggtgcgatcttggttcactgcaacctccgcttcctaggttcaagctattctcctacctcagccttccaagtagctgggactacaggtgcgtaccaccgtgcttggcaaatttttgtatttttagtagagacggggcttctccatgttggccaggctggtctttaactcctgacctcaactgatccacttgcctcggcctctcaaagtgctgggattacaggtgtgagccactgcacctggccggtatgactttaatacttgaaagttaatgggctggacgtggtggctcacacctgtaatcccagcacttcgggaggctgaggcgggctgatcacctgagggcgggaggccgagaccagtctggccaacatggtgaaaccccgtctctactaaaaatacaaaaattcgtggtggcgtatgcctgttatcccggctacttgggaggctgaggcagggagaattgcttgaaccccggaggcggaggttgcagtgagccgagatggtgccattgcactccagcctgggtgacagagtgaaaaaaaaaaaaaaaaagttaatgaatagtttctacattattatgatcatgtaatatttttcacagcagaggcaagtagtatgtaattacatttctttgtattgtttcttggtttttgaatctgtaactgcatttttcttgtcatattttcacgattcattttatcaatctttttctgtggtttgtcattattacttattttatgcatatcaagtccctcccaccctcccctgctttcccttagtcctatttccttcagtttgggctagaagtatttagacctgttgccttgtttttgtgctgaacttttccttactctttttgcacagtgctactactgttattagagctttatcatttcttgagttactaacttgttttaatgcagtacacccacataaatagctaagaaagaatatgtgagaaataaagttttgaatccttgcttatctgtaaaagtcctcattagcccttacagttgactggtattattttattcaagtgcaattaagctgaaaattgttttccctcagagttttgaagggattgctccagtgtcttctatgtccattgttgttggtgaggaaaagtcggatactgtgtgattcttcttcctttgtgggtgatgtgtttcatattttcatccatccctttagagccttcttttatcctcattaaactgaaatttctcaaagatgtccagatgtgttttcttctccattacaataagcaaaatactttatgtgcttcacttcttgaaagttttcatgttacggctttagtgatctttcttttttttatttttttgagacggagtcttgctctgttgcccaggctggagtgcagtggtaccatcttggcacattgcaacctctgcctcctgggttcaagctattcttcttcagcctcccaggtaactgggactacaggcacctgctaccacacctggctaagtttttgtatttttagtagagagggggtttcaccgtgtttgttagccaggatggttttgatctcctgacctcgtgatccgcccatctcggcctcccaaagtgctgggattacaggcgtgaacccccacgcccggcctctagtgatcttttctttgttttctctatagctgcttttagttggattattagacttactgaattaatcctccccaatatttttgtctgtttgtttgtttgtttttttttggtctggccatctcttctactttatttattcttggaccttttaattttatattggaagttatattttaaatgtttgagatttctccttcatttcctcccccgccaatatcttttctcattttatggattaataatcttcttgagtctctgaaaatgttaataaggtttattttttttttaaattttgttgccctccctcttacctgtcaactctattgtaatttttgttgttatcttagtctcatttatattgtaggcttttaaccaaatatctgctgaccttggatatcactcagctttaagatttagtagaagggttcacaatgagctcttggtgggaattaatggttggcaggcaggctttactttagggttaagctgttaattagtcttttgtattctgacattcaagagtccattgttttaccccaaagtgccaactcccatgctaggttcactagtttcctctctcccagactccagtttctttactttagaagagatctctttccattaattttactttgttttttaataataatttggctttaaatttttttaaactactgtttaaaatggtcttttgctgaagagagataaatgtatatgtttgatctgctatttgagccagagaatctctttcagttctcaaactggactagaccaaaaactaataattatttagatatttatttatccagtgtttcagaatgtgttaggttgtagaaatataatagcagctttaagtggtgtaggaggtgttttgcgtgtttataaaagcgagtactggctgggtgcggtggtgagcgcctgaaatcccagcactttgagaagccaaggtgggtggatcgcttgagctcaggagttggagaccagcctgggcaacatggtgaaaccctacccctaaaaaaatcccacaaaaattagctgggcttggtggtgcgaacctgtagtcctacctactcagaggctgaggtgggaggatcccttgagcccaggaggtggaggttgcattgagtcaagattgtgctgttgcactccagcctgggtgacagagctgaaaccctgtctccaaaacaaaactgagtactcattatgtgtgttaagccttttacagtatgtggaagattagaagatgtcacataaaaagttatgaatgtaatacattctggtaaaaataaagagcacaggagggcataacttaaaaagtaaaaggggctgggtgcagggggctcacgcttataatctcaatacttgggaaggccgaggtaggaggatcacttgaggccaggagtttgaggccagcctgggcaacatgtgtttcactgggtgacagagtgagcctcttatctaaaataaaaaacaaaaaatgtgaaagaccctcttttccctgttttgccccacatttcagagacaattactgtatccttgacttttgttatgggtatacctttgctatttctatgtatgtgtatgtacttatatccatttttatgataatgggatcatttaatttatatcgtgatttgattttgtcactttgtggttgatcttaggcatctttccattttagcttatacacatctatctcattcttttcaaaatttatccaaagatatgaatcacgtgcttaatttgccaaggagtgttttaggtgtaaggattcagtggtgaaccagagagaccaagctcctgcccttatggaacaatatttcaacggtgagaaacacaaaataaatgcatttctcgtaattagtctcaaatactgagaagtgctatgaagaaaataaaatgtggtactgtactgagtgtgtctgttaatggtatgagagagaacgcatgtggctaaggtggtcaggaaggtctgtatgaagtgatggcattgaaacacacgtgaatgatgtggaggcattttaggaagagcaggatttattgtgaagactcaaaacaagaatgagtgttgtattagtgcgtttactgctgataaagacatacccaaggctgggtaatttttaaagaaaaagaagtttaatagactcatagttccatgtgtttggggaggcctcacactcacagcagaaggcatgtcttacgtggtggcaggcaagagagagtgagtaccaagtgaaaggtgtttcctcttacaaaactatcatatctcgtgagatttattcactaccaggagaacagtatggggaaaccacccctatgattcaattctttcccactgtgtccattccacaacacgtgggaattatgggagctttaattcaagatgagatttgggtggggacactgccaaaccatatcaagtgtgttatactcaagggatcctcccatctcccaaaataaacgattggtgttactgtgcaatgaggggaacttaggagaccatatttgagaggcaagcaggagcccaagcagtgcccttcacaccgtggtaagaagctgggattttatccttagtgcagcaaaagcccttagaaggttataaaccagggcacccataaggctgtgaaagtaaccttgacagatatggcttagagtagagtgatggcagaggagaaaggcaatcagaagtgtttggaaagctcaggaggctgaggcaggagagaattgcttgtacctgggaggtggaggttgcagtgagctgacatcaagcccctgcactccaacctgggcaacagagtgagactccatctaaaaaaaaaaaaagcttggaaagttacagcggtaagatctgctaaaggatttgatgagatggatatgagataaagaagaattaaaattgtcttctagatttgtggcttcagtagttgagtggacagaaatgtcatttacttagattagagattgatcttagtggagaaacaggttttaaactagattgaaggccctctgattagttaaaccattcccctactgatggtcatttagttgatttccagttttattatctttgtaaggaatatccttgtacttgtgtatttgtacgtgtggacatattctggaagataaattcctagatgtaaagttctctcatcgaagaggacagtacatatgtttcaagttttgatggatattcattagttgccctccaaaagtgaggtgttggcttggattcccccaacagagtatgcctttttcctggcatcctcactaacaacatacctggtgggagagaaagtaggcagggcctacatttctgaaaatgggagtgggagttctaatagcattttttctttactaaatcactttggcactttgttcctagaatgaaaatcagcaattgtcgttttctttttggtatccctaaagtcataacatgtctctggccatagttttttccagttactaatcatatagctgttggtcagtccttctaggcttagtggtatttatggagcctttcataataattatgagaattacaatgaaaatgaaaactattaattggtttaatgtatgccaagcactatcctaagtgctttacacgtactatattaatttatttaatcctcacaacaacctaaaaagtaattactgttattatctcgatttcttgaagtgagacagaggatgtccaccaatctttgtcttttcatttatgtattttttaattaatttttttctgtcaaaatatcttttgggaagtttggcgctgttacttgaataccttttgtcagtagttgtgggtcagaatccaaacacagaataaatggcaggaaaaggcacattcagtttaggagaatgctctgcttatgggtgatagtgtttgtaatgctttgggttttggttttcagaactgcctatgttcaaatcccagcctcacacttagtagctgtttgatttggggctgatcattgatctatttttgtagctcagtcttctgagctttaaaatgggaaaacaaggttttgtaggttgtaggattgttgcgggcagtaagttacacatgtaaaagtggccagcacaagaggaagcactttatcagcatcaactaatatttttatataattggctaagagtgggcagtcctatctagcactcaaagtgtggggaaaatactggtgataggatatcacactcttactgagttatatatattaatatttaggtataaaacttagaaagtggggtggttcacgcctgaggctgaggcaggcagatcacttgaggtcaggagtttgagaccagcctggccaacatggtgaaaccctgtctctactaaaaatacaaaaattagcctggcatggtggtaggcacctgtaatcccagctactcaggaggctgaagcaggagaatcacttgaacccaggaggcggaggttgcagtgagccaagatggcgccactgcactccagcctgagtgacagagggagactgtctcaaaaacaaaacaaaacaaaacaaaacaaaacttaaaaatggttaggcactgtggctcatgcctataattctagtactttgggaggctaagacaggaggatcacttaagcacaggagttcgagaccagtctgctgggcaacatagtgagacactgtctctaactgggggggggaaagaaaagccaggtgtgcggccacgtgcctgtagtcccagctactcaggagtcgagatgggaggattacttgagcccaaaaggtcgagaatgcagtgagtcatggttgcgccactgcactccagccggtgcaacagagcaagaccctgtctcaacaaacaaaaaacccttaaaatttttttaatgctactattgttgtaatgagtcatattaagtgggattatacatgtaccaaacttttattttttcttgagtgagattatttcatggttattttaattggcatgccttacgattgagttaaattgattatatttgtcacttttttttgcaaactgcctaccagtaccctatttcgggtactttgcagcttcaaataagaaaaattttaattaaaaatgcattaaaccataaataaaatttacctcacatgactggaagtccaggtgtaattcagtggctcaattaaattatcacggacctagatggttttcattttcctgctgttttatactcagcttgttgtcgatagttgctaaattaattcacttaaataatcatttaccacctaaaatgtattaggcagtagtccataagcacgggaaatacagcagtgagcaaaacaaagttcattgccttccttcacgggcttatattttagtggggataagggagaagacagtcaaacaaataggtagaatttatagattgtcagaagatgttaagttttatggaaaaaaataaagccatggaagggacgggaagggctgggttggattgttttaagtggggccatcagagaaggcctcagtgagctgatgtttgaatagaatcttaaaagaaataagaatgcaaaggcagatatttggggaaagagcattgctgatgcggggaacagtgagtgcaaaagccccagaggcaggaatgtgcttagcatgttcatagaactgaaagggccagtgtggcaggagctgagttatggagaaaacatcataagagaagtagcgtggggagtcagattgtgcagggccttgtagaccattgtgagatcttttgacttttactctggattagatgagagtcctttgggggcttttaagtggaggactggctttatctgaccaagactctaaaactctcatgctggctgctgtgttgagactagaatgaaggagatcaaggaagaagcaggcatgttagataatattagcagggtaacagatgatttgaagcatgataggcatcagagaaatgttgaagtaattctgcatatgttgaggcagagccgaaaagatttgttgagggatgtggcatgtgagaaaaagaggattcgtagttcacaccaggttcaatgaccagtaaagatgaagtatatttgttcatgcacatctattttatttggaattaaaaacctttcctggaagcccttagcagattttttttttttttttttttttgagatggagttttgcttcttgttgcccaggctggagtgcaatggcacgatctcggctcactgcactgcatcctctgcctcctgggttcaagcgattctcctgcctcaacctccccagtagctgggattacaggcatgcaccaccatgcccggctaattttgtgtttttagtagagacagggtttctctctattggtcaggcaggtgatctgcctgcttcagcctcccaaagtgttgggattacaggcatgagccaccgcgctcggccaacagatttttttcttaaatcccatcagccgtgattggtatccatccatgtcctagatacaagtgagggtgagagagcaaggatgttccttgcagccatgataatgggaagtggactctgtaaggaacaggttgtgagtggggagtggctattggttaggtaactaatagtctgtttgtcattgcccatttttctgttaagtcgatcatcctttttaaatgatttgtaaataatttttgcatgctaagaaagtaagtatttgttatataattctagattctaaatattttggagctgtaaatgaggttttaaactctgagatcagttttctaattttgaaataaagtgaatctccattgaaatttacaagtaggggctggtgatcgcagagtccaatgcataatttatagtttttcctattctgggtgcagttgtcattttaacctgaatgccaggtagttatctttataaaactatcatgtgtgagttatagaggtagcattggggtggtggaaaaaaacaaaacaccacttttgaggtaggatctcactctgtcacccaggctggagtgcagtgatgcagtcatggctccttgcagcctcaacctccctggctcaagtaatcctccctctactcagcctccagagtagctgggactacaggtgcataccaccacacccggctaatgtttaaatttttagtagagacaagatatcactatgttgccctttcttccttcaaaaaaagctgataaactggcttattatataacaaggaattctcattttattttacttatattgtattattgttctttaatttcagtgatgtgaagcagtgttttttggaggttttgagtgtgagctttctcatcagatactgaagagtttttgagccttaactccattacttaattagctgtgtgacccagaccacttcattgtacagctccgttcttgttgtgctggggagggcattcacacaaaatacaatgaaattgtgcttcctggtggttctgatgtgactttaggcaagttcattaaacactgcgctttcaataagataatgcatgtggaatgctgagcacagtgcctttaagacactgaaggggatatgagaacagttccatagcccttcatttttacttttgattaagagttgtttactaataactaactaggtgagttataaatggggaagtagggtcattgtgaagtggctatgaaacagcatagaggatatattttaaaagctgtatttttactacctattttcaaactgcatatttcattttagtttggagaactttactgaaaaataaagaagtagtagtatgtgagtttggatcatttctgtggttaggtggtggctacactaaggcctttccaattcttggtcctgtgagaggtaggtagggttgtggggggtaggggagaacagataaatgagatacatttatatttttttgcatggtaacttataaggcattgccaagagagggaattcactgcaggcaaagaaaaatataaaacatagtgtatatagggctttgtagcatccgtggtttcaggcatttatgggagccaggcaggggtagggtatggggttgaaatgtatttcctatggataagcacaggactactttatatcacttaatccaagacccttttactggtgaggaatccagcatttaaatttatgtatgtatatgataaagctagaatttttccagatctgagactcaaagctctttgtgttttcgtttatactccagctcttttgaggagctttaaagtctagttacaaagacaggaaaaacaagaacggccacagtggctcacgcctgtaatcccagcactttgggaggctgaggccgagaccagcctggtgaatatagtgaaaccccgtatctactaaaaatacaaaaattagcccggtgtggtggtgtgtgcctgtaatcccagctactcaggaggctgaggtaggagaattgcttgaacctgggaggcagaggttgcagtgagctgtgccactgcactccagcctgtgtgccagagactctgtgtcaaaaaaaaaaaaaaaaaaaaaggccgggcatgcagtggctcatgtctgtaatcccattgctttgggaggccaaggcaggcagattacctaaggtcaggagttcaagaccagcctgttcaacatggcaaaaccctgtctctactaaaaatacaaaaactagctaggcgtggtggcaggcaccataatctcagctactcgggaggctgaggcgggagaatggcttgcacccgggaggcggaggttgcagtgagctgagatggaaccagtcagtgcacttcagcctgggtggcagagcaagactgtctcaaaaacaaaaaaacaaacaaaaaacaaacaacgacaaaaaacctaggaaaaacatacatgcaacagaatgttaaagaggagattttaaggctttttttttttttttttttttttttggagacagtctcactctgtcgcccaggctggagtgcagtggtgcaatctcggctcactgcagcctccgcctccctggttcaagcagttctctgcctcagcctcccaagtagctgggattacaggcgcctgccaccatgactggctaatttttgtagttttagtagagacggggtttcaccatcttagccaggctggtcttgaactcctgacctcgtgatccatctgcctcggcctcccaaagtgctgggattacaggcgtgagccgttgctcctggcagagattctaagttttttgagaatagtgactgtatttcttgggtcatggctctatcttatacatctggcacagtgtgtgtgtgtgtagcaggtgtctaatatttgttaaacacacatggtccttaatatcaaacggcatgggatttaagacatgaacttgggtttgagtctcagcactttcatttcttagttgtatgaccttgaccatttaatctgtttgatcttgaatgtccttatccgaaaaataggggacatactaattaacatctattgtgatgggttgtaatgagaattaaatgataatgtatacaaaatacctaacttgattggatttgtggtactcagtagctataatgaccattttaaccccaatatgagaaggattcactcatcacactgttgtatacttcgtagctattacttctttaatccccaaggacttgtttaacaaagtgttcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggtttgttacatggctagattatgtaatgccgaggtttggcctgctagcgcagccatcatccaaagtgaccctagtacccaataggtagttttcaacctgtgtgcctcctcttctaccttctcttttggaatctctagtctattacttccatctttatgttcacatgtactcattgtttagctcccacttacaaatgagaccatgtggtatttgattttctggttctgagttacttcttttaggatagaggatgaaaaagagtgtagcctccagctccatccatgttgctgcgaaggacatgattccattcttttttatggctgtatatttttacctttttttgcgagggggagaggatttaaatatggaccagcataatgaagaaaatgtctgtaatcccactattcacataacccctgctagtttaaaaaaagttcgtgtaggccgagcatggtggctcacacctgtaatcccagcactttgggagtccaaggctggaggatcacttgagcttaagagtttaagaccagcctgagtaacatagtgaaacctcatgtctacaaaaaaataaaacttagccaggtatggtggtgcatgcctgtagtcccagctacttgggaggattgcttgaggccaagagttcgaggctgcagtaagctgtgattgtgccactgcactccaccaggtatttaaaaaaaaaaaaagtaaataattagaaaatttaaatagtgtaaactagaggcctctcctatcagtttgctagagctaccataacaaaataccacaaactgagtgacgtaagtgacagtattttttttttttttttttttgagacggagtctcactctgtcaccaggctgcacgatctctgctcactgcagtctcggcctcccaggttcaagtgattctcctacctcagcctcccgagtagctgggacttccagtctccagaattgagaaatttaatttcttttaatttaaaaaaattaagagtgacagttggctgggcgcagtggctcatgcctgtaatcccagcactttgggaggctgaggcgggcagatcacgaggccaggaggtcgagactatccttgctaacacggtgaaaccccatctctactaaaaatacaaaaagttggtcgggcgcggtggctcatgcctataatcccagcactttgggagtccgaggtaggcggataacctgaggttgggagtttgagaccagtatgaccaacacggagaaaccctgtctctactaaaaatacaaaattagctgtgcatggtggtgcatgcctgtaatcccagctacttgggaggctgaggcaggagaatcgcttgaacccgggaggcagagattgcagtaacccaagatcacgccattgcactccagcctgagcaacaggagcaaaactccatcccaggaaaaaaaaaaaagtctaagtagtccccaaaacataaaatttgagcctaaaataagaactgttttaaaattttaatatattgtgttttttcgccatacaatcccaggtattcttcaggttagaactcagtttcacaaaaaagggtgtgcttgaaaagcttaccaaaatctcctgattagatacttttttcgtttgtttctgtttttttgagacagtctcgctctgtcgcccaggctggagtgcggtgccacaatctcggcttacgcaacctccgcctcccgggttcaagcgattcttctgcctcagcctcccgagtagctgggactactggcacacaccaccatgcccggctaatttttgtatttttagtagagacggggtttcaccatgtcgacaagtctggtcttgaactcctgacctcaggaggtccacccacctcggcattccaaagtgttgggattacaggcgtgatccaccacgcctggccagagcatacttatttatttagcaggtgtggatatgtgtatttaaacagacttacttgtaaatagatgtataaatgtatacccataatgaatgaaattaatgaaattatatatatttatatattcattataagaggttacaatttttttattttatttttatttatttattttttttttttgaagaggttacattttttccccccagcctagaaagcttcactgcataacatgattatgtgggaatttcagagttggatcactttgcattactgtaaatgatagagctttaaagtattttttattctaaaggtatatgtgcttttcataaattcaaattctaagaaaaggtatacatcacaagttcagttttactccccagaggttatcactggaagctttttttgtatatttttctagatgtttttggtttgtagataagacgtgtatgtatgtagaaaaaaatacagacataggcatatatattctttgaaaacaaatggaattaggccgggcgcggtggctcacgcctgtaatcccagcactttgggaggccgaggcgggcggatcacgaggtcaggagatcgagaccatcctggctaacacggtgaaacccggtctctactaaaaaatacaaaaaattagccgggtatggtggtgggcgcctgtagtcccagctacttgggaggctgaggcaggagaatggcgtgaacccgggaggcagagcttgcagcgagccgagatggcaccactgcactccagcctgggccacagagcgagactccgtctcaaaaaaaaaaaaaaaaaaatggaattatactataaatactgttttgtcacttttttttttggcatactagtatatgttatacatcttttcataggtatattgtgattaatgtaggtgcagttcagtaatgattgaaatgaagttttttcattatattctatttttgaaaaattaccaataactacatatataactgaaatcacatcatgtaactgtcagtataaaggaatggctcagataaaaccaaatagaagttgtatatttaatatttttaataattttaatatttaattaaaaagttaaaacttgtactacatggctgtttattagggtaaggaagtatgatctctttaatgtacatggtatttaaaaaatatcttattctggtgtgtcttcttgattgtaaaaccccacttaacattttgggctcctatttatatctttttactttaaagtaacactattctgtggttattcttatggcatattaaagtgatattttaaggaatacttaacaaaattctatataaaatgtatctactctaagttagaaatcttggtgcccttactggtcttgtgatcttggaagtcacttaagatcccgagctctgtattaagacagtgctggttcaagttctggatctaccattgagtaattgaccatgactttctttatacttcagtttcctcaactgttgaataggaataatggttgttgtgatgagtccataaaaaatacagtcttactgactttatggtggccgaaatttcaagagtaacacagtaacagttaagtcatactgggactcaggctaatcttttctccgttgccctaggcattgatgtccacctggcaaatgagggtgagaagcggtgagggattgcatgggaggtttggggacaaggcctgggagtagtacagaggcatctttcacttttgcccacatttcattgtccagaccagtcatgtgaaagggaagctgggaaatgtagtttagccatatgccaggaggaaaaggaaacgctttggtaaatagccagtttttgccaccagtgctaagcacagttcctggaagatggttttcaagtcattaagcaagtcacttttcacctctccaggtccgtgtttctttctgtaaagtgggaagggggatgataatgaaaacttctatgaagcactgttttgggagaactatatgttataaccatcttaactcacttaattcttacaaaagtcctctgaagtaaagactactattgtccctttttttttttttttcttttttaacagctgaggaagctaaggctcagagtgagtcatggacacaggatttgaacccaggcagtcttttctgtagggtctgtgcttttatttatttttatttttattaattttttttttttgacggagtctcattctgtcactcgggctggagtgcagtggtatgatctcagctcactgcaacctcgcctctcaggttcaagcacttctcctgcctcagcctcccaagtagctggtattataggtgagtgctaccacgccaggctaatttttgtatttttagtagagtcggggtttcactgtgtttgccaggctggtcttgaactcctgacctcaggtgattcacccgcctcagcctcccaaagtgctgggattacaggcatgagccactgcacctggcctcaggcataatgtgatatcgtttataaatattagagaatgtagttctaaaaagtgaaggcttaagaaaaacctaataccaccatcatacttaaaaaaaaattgacagttaaatccataatatcatcatattctatgttcaggtaaacacgtctcaattttttttttttttttttttttttttttttttttttttgagacggagtctcgctctgtcgcccaggctggagtgcagtggcgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacacgtctcaatttttaaaagtatttgaataaggcttacttattgcgattaagtgtcttaatctgtaggataccaccttcctttttattctcacaatttatttgttaaagaaatgggttatttgccctgtagagttcctgtagtcaggattttgctgattcctgagattcaataccaggtttatccccgatgtttctctattttctgtatttccaaatgagtagttagaaccagaggcttggtcagagtcaggttcagtcttattttataagactgcttcttatattgtggtgcattctttcatcaggaggcacaaaatatggttgtctctttttgtgacattagcaactgttggtgactaatgcctagatctgttgattcattaagagttgtaaaatgataatgttctagttgtgttactccttcattttattatctggaatactgttttataaaaagaaaagtttccatcacctcttacttggttgcccagtgtaactgttcatatgggaaaggcagaataaatgtttgcttgtttacctttctttaccagtttccagtgtaatcagtaggttcactgtattttccagctgtgattaataaatttttaaaattattatttttaatgtatctgttactgtataggacagtatctggaaatacccaaagacaagatctctaaaggagtcatcggctagtggtggatcagtgcagcgtggtggtggtggtggtggtggtggtggtggtggtggtggtggtggtggtggtggtggtggtggtgttatgcacatgggggataatatagcagaggcatttagcttgaaatcaggaaagagctctggagttatccttgagctgcattttgaaggttgagtagcagtttgctattggaggaggtagaggttacttttcaggcagagggagcagcatgtgcaaaggctctgagatgtgagagtttgttactgaagaaattcagtagggctggaagctcagtgagcttggtgcgagagagtcaagagatgaggctttagaggtagtatgggttttaagtcattccaaggaatagttttgatttaactctgaaggccatggagagacattgaaaggttttatccaagtgaatgatgtaaggaacaaactgtggaactcttggggcagcactgaggagagtgactcatgatgccccttttctgaactgcttatacagatttctcattcttggcattactcctgattcctccttcatctacatgcacacgcgcctacacacacgcacacacacacagacacacatgtctgcctctcggatctccttctagagtcttagttcttgttttttttttcagaatttgggcaactaacaaggctagaaaggaggccatctaaaaaagtgattggtgttgaaaagttgctgctcctgtcctagcagcacaactcttcacgtcatagtaataggagtaatgacgatgatgagtgtggacaactaatgagcacttaactgtagtaccaggcactattctcagaattcattagtgtgacaaccctctaaggtagggtctgttatccccattatacagatggggcagaaacggcagggagaagttaagtgacttgcttaaggtaataaatgtagtaagaagcagaggtgggattgaacctaaacagtctgcatctagagttcatgctcataacattctatttattgcctttctggttttatgacccccttcttatctaagtgtatgctctgtgccccgcatatacaaactagttcccataacatgtgtaatataatccctcctttcccagggtttcccggcttcctgtccttccccttagctttctatcatcagtttttcctaggatttctggttcagcctatgtcaaagtgagagtcaccaacatagttgatgataaatactgtttgattacaggaatgtaggaagatgtgcaagcattctactaaaaatgcttttcccacagataatgtaaactaaggttgcttaggttttgtaagactgccattcaactataaataggccttatgtatgtttactaaatcagaaaaaatttaatgtagctaaattttaaataatcaacaacagaaaataaaaatattttgccccaccatcttaaggttacaagacttagaggtatattttatttacatgcatgcatacacacacacacacacaaattatatatagatgtgtggaaaatatagaaaagtagaaaaatgtatacaaatatttgaaatacattatgtggaatcatgtttgtatttttcttagcttaggaaagaaagccattaaaagagttacatgtcaataaccatgatactataggattttagtagttgcagagtattacattacttaaataaatgattcatggaatagtctttttttattggacaaggaattttcccctccacctcaatctttgagagttagaaacaatgcagagatgagtgtctttatagttaaacctttgtacattttataatttactcatgataaattttcaagttgaattcctaggccaaagagtatacagattttaaagactttcaatgttggcagatatcactttaggataattataccaatttatactcttaccagtaatatatgagtgtatatatttacctattccttgccagttctggaaattgtgaatttaacagaatcttccaaaaagcattgaaaattggcctgggaatgtaaatatccttttcttccccattcagcttactaatgaatctatcataatctcagctgtctgaatctaaaagagaaccagtaaaattgagatgacaagtttattgcaaaataaatgacctgaaagccacaggcattgggtggggtgggggaagggcaggtaatggtgactgaggtgactctgtgtttgggtttttgaaaagatggtagatttgaaggataaggagttcagagaagtagaaaggcaaataggggccgttataaataaggacagtggcatgagccaacagggttatctctcatgtttatagaacatggctagatctggtttccctataagttgatttcttactgttattctgagttgaatgcgtatcttttgtctcaatgaagcctgaatggcttttgatgtctctgatctggaaaggttgtttatgtatctcagaataagtcattttgctaaaaaaggctactcctgagggagagcagtggaaaaaagagttggaaaagtggattgtagctagttgaaaaaaggatttgaatgtcaagctttaggaattaggttcttatttggtatgttacgggcaaccatatggacttttgagcaggtgaaaaatacagtattaatgggtagggatagcttgggagggaaggagacatggacattgagcttcagaaaaaccagttagtaaaatatttcagatgatacattggtaatagaaaaggatccgttgaaatgtgaggcattcacttggaaagaactggcagaatgtggtaattaactgctataaggaccccaaaataaaaggaataatcaaacatcactcaaagcttttagcacagtttttgataacagtcagtgtcagaaggagaagacaactttgttcctaaaagttatattgtaaaataaatgtagcttatacatttttgaaagtgaaatctcaggattcatggtatctttacttctacttgccaaattattaaaatggtgttatatttcttaagatattttaaagcctctattgtagaacagaaatagtagaaaatggaactaatgtttattaacaattactatggaagagggaatagaaatgtgttgctcttgaacagatttattcagctttggcactgttgacattttggactagctaattccttgtcatgggcagtatctcctgtgtgtaggatgttaagcagcattcctggcctccacccgctagatatagtagcacacccgcacccctccccccctccctgcccccgtgacaaccaaaaatgtctttagacattgccagatgtcccttggggagcaaaaattactccctctccccagttaagaaccattgttctagagtacagaatcaatcccactaaataaatgttattggcgtgtttagaacagtgcctagcacatagctggcactcaaatatttgttgaataaatgagtagtcagattttcattgtgaattaaaaacagaacaaaacttgatgactgaccactcaagttgcttttacaaaagaaatgggatgtccattgaacatctgttttagatctgatttcccaatctggattattaaaatgaggaggctattttttcccagtatataaatgattctaatactttttgctgtaaaacttttggagtctctctgctaaattatgttccagtttcgtagcttgggattcaagtcataaatatactaggtctgtcttacctttcggtgcttttatttgttcccttttgaacatggctgaattttacttttctgtccacctgcccgccattcgtgctacccctccttcctttttccactctcatctttttcccattttccagtctgtaaatcctacctatccttttattttttaaattacaagatctcattctgttacttaggcaggagtgcggtggcacaatcatagttgactgcagcttcgaatttctgggcccaaatgaccctcccatctcagcctcccaagtagctgggaatacaggtgcgcaatactgtgcccggctagtttttttttttttttcttttgagacagagtttcgctcttgttgcccaggctggagtgcaatggtgcgatctcggctcactgcaacctctgcctcccgggttcaagcgactctcctgtctccgcctctcgagtagctgtgactatagtcgcatgcccccatgctcagctaatttttgtgtttttagtagaggtggggtttcatcatagtggtcaggttggccttgaactcctgacctcaggtgatctgcctgcctcggcctcccaaagtgctgggattataggtgtgagccactgtgcccagcctagttttttttgttttgttttttgttttgttttgtttttttttttggagatggagtctcgctctgttgcccatcctggagtgaagtagtgtagtggtgtgatctcagctcactgcaacttctgcctcctgggttcaagtgattctcctgcctcagcctcccaagtagctgggactacaggcacatgctgccacccctggctaagtttttatattttagtagagatggggtttcaccatgttacccagctggtctcgaattcctgagctcaggcaatccgcctgcctcggcctcccaaagtgttaggattacaggtgtgagccaccatgcccagccattcccggctagtttttgtagatactggggtctcgctgtgttgcctaggctggtctcgaacccatgggctcaagtgatcctcccattacagcctcctaaagtgctgggattacaggcatgggccactgtgccctgccctgtcctcctttttgaagtctctctctctctgtcttttatacttattttttctctcttgtcatgtctttgtccttgtcttttttgatggagtcttactctgtcacacaggctggattgcagtggcacagttctagctcactgcagccttgaactcctggggtcaagtgatcctctagctcaagtgatcctcctacttcagcctctgagtagctggggctctatgtgtgcaccaccacgcctggctcctttgtccatttttgtttgtttgttttttggagacagagtcttactctgtcgcctaggctggagtgcagtggcatgatctcggctcactgcaacctccaccttctgggttcaggcgattctcctgcctcagcctcctgagtagctgggattacaggtgcccaccaccacgcctggcttatttttgtatatttagtagagatggggtttcaccatgttgaccaggctggtcttgaactccagacctgtgttctgcctgccttggactcccgaagtgctgggaatacaggcatgagccactgcaccctggccttaactacgtattttttatatctgcacagtgttttggaaaaagtggttcaactgaaagaatgaaaagatgggggcagaatttgctttttaaaaaaataataataatttaaaaaaagggcattgaaaaaagtttcagtggtgttgggagggccttggaacaaggaatgaatggaagatgagggagtggagggaggccatgtatggactctttctacagaccaggctgttgaaggagagagggctaacaggaaatgaagtgcgggggaagttttttgaagatgggagaaagaggacaacttttatatatttcatttcatttgattccttataaatttgtaaggaagatagagcttgtattatttcagtgaagttgaaaatagagtacagaaaaattaagatacagcacccccaaaactgagaacttctgacataatacactgttggaaatacttacttcagagtgaagaaaatattggaagttaggcttgttaattgctctgcatggttcataattactctttcttattaactatttaaggaacatgagaccaggaagttaaatacctgggtatatgcagatatatatctagaattggtaccaaagtaaatacaggcataccttggagatactgtaggttccattatagactaccacaataaagtgagtatcaccataaagcaaggcacacaaatattttggtttaccagtgcatgtaaatattatgtttatattctactgcagtctattaaatgttcagtagcgttatatttaaaaaaccaatgtgcatactttaatttaaaaatactttattgctaaaaaatgctactgatcatctgagctttcagtaaattgtaagattttttgctgatagaggatgttggtggctgctgactgatcccagcagtgattgctgaaggttggggtgcctctggtagtttcttacaataagacaacaatgaagtttgctacattgattgcctgtttctttcatgaaagatttctctgtagcacgtgatgctgtttgatagcattttttacccaaaagtagaacttttttcaaaattggagtcagctcaaacactgctttaacaactaaggttatatagtattctgaatcctttgttgttattcaacaatttcacagcctcttcaccaggagtagattccatctttaagaaaccactttcttggctcatctgtaaggaacaactcctaatctgttcaagttttatcatgagattgcagcaatccagtcacatcttcaggctccacttctaattctcttgctgtttccactacatctgcaatgacttcctccacttgagtcttgaacccctcaaagttatccatgagagttggaatcaacttcttccagacacctgttcatgttgatattttgacttcctctcatgaattatgaatgttcttaatgacatctacggtggtgaatcctttccagaaggttttcagtttactttgcccaaatctactacaggaatcacttttttttttttttttttttgagacggagtctcgctttgtcgccctggctggagtgcagtggtgcgatcttggtttagtgcaacctctgcctcctggttcaagcgattctcctgactcagctcccccgagtatctgggactacaggtgtgtgccaccacgcccggcttatttttgtatttttagtagaaatagggttttgccatgttggccagggtcttcttgaactcctggcttcaagtgatccgcctgccttggcatcccagagtgctgggattacaggcatgagccaccgtacctggccgaaatgtatttcttaaacagtaagacttaaaaattgaaattactcattgatacgtgggctgcaggatagatgtatcgtactggcaggcatgaaagtaacattcttctttctgaacatatccatcaaagccctcgaatgacctggtccattgttagtgagtgctaatattttgaaaggaatgttttttccttagcagtaggtcttgacagtggactgaaaatattcagtaagccaacctctaaacagatgtgctgtcatccaggagactgttgttccatatgtagacagcaagcagattagatatagcataattcttaagagctctaggactttttgagtggcaaatgagcattagcttcaacgtcaagttaccagctgcattagcccctaacaagagagtcagtttttatttatttatttattatttttaaaagagacaagagtctcgccttgttgcccaggctggccttgaactcctgggctcaagcgattctcctaccttggcctctcaaagtgctgggataacaggtgtggccccagcctgacctttgaagcaaggcattgattttccctctctagctgtgaaagtcctagatggcatcttcttctaatggaaggctcttttgtctacataaaacaccttgtttagtatagccacctccagcaatgatcttagttagatattctagataacttgctacagcttccatgtcagcacttgctgcttcactttccacttttatgttatgacgagagcatttttcctcatgaaccaatctctacttgcttccagtttttcttctgcagttttctcacctctctcagccttcatagaattgaagaaggttagagccttgctgtggattaggctttttgcttaagggaatgttatggctggtttaatcttccatatggaccactaaaactttcttcatattagcaacaagattgtttcatgttcactgacatagtgcttttaattttattcaagaatttttcatttacattcacaattggctgagtggtacaagaggtctagccttaggcctttctcactttttgatatgccttccccactaagattaatcatttgtagcttttcagttaaagtgagaggcacatgacttttcctttccctgaattgtttgaggccattgtaggattagggttaactaattggcctaatttcaatatggttgtgtgttggggaaacgggaggtctgaaaagagggagaaagagagatagggaatggctaattggtggagcagtcagaacacacattatatgttagccatcttatgtgggcgtggttcatggtgttccaaaacaattacaatagtaacatcaaagatagcatggtagctcactcctggaatcccagcactttgggaggccaaggcaggaggatcgcttgagtttgagactagcctgagcaacatggtgacaccccatctctataaaaaataaatcagccaggtgtggtggtacatgcctgttgtcccacctaccgatgaggctgagcacttgagtccggaaggttgaggctgcagtgagctgtgattgtgccactgcactccagcctgggtgacagaacaagaccctttctcaaccaaaggaaaaaatatatatatatcactgatcgtagatcactatcacagatataataataatgaaaaagttcaaaatactttgaggattactaaaacgtaacacagagacacaaagtgagtgcatgctgctggaaaatggtgtcagtagatttgttcaggctgggtactatggctcacacctgtaatcccagcacttgggaggctgaggcgggtggatcacctgaggtcaggagtttgagaccagcctggccagcatggtgaaaccctgtctctactaaaaatacaaaaattagctgggcgtggttgtgggcgcctgtaatcccagctacttgggagactgaggcagaagaattgcttgaacctgggagatagaggtttcattgagccaagatcatcccactgcaccccagcctgggcgacagagcaagactccgtctcaaaaaaaaaaagacttgttcagtgcaaggttgacaaaagcctttgctattttaaaaaaaactcgctgggtgtggtggcttacgcctgtaatcccagcactttgggaggccgaggtgggcagatcacctgaggtcaggagtttgagaccagcctggccagcatggtgaaaccctgtctctactaaaaataaaaaatcagctgggtgtggtggcacgtgcctgtagtctcagctactcatgaggctgaggcaggagaaccacttgaacctgggaggcggaggttgcagtaagccgagattgtgccactgcagtccagtttgggcagcagagtgagactgtgtccccaaacaaacaaacaacttattatctgtgacgtgaaataaaatgaggtatgtctgtaagcaaaatggatattcctcttaatgtttgacattattttttaatcgaggagttctgaaaaattgattttgcatggatttttttccttgtgtttttctcttcaatttttttttttttttttgagagacagagtctccctgtgtcactaaggctagagtacaatgctgcgatctcggctcactgcaagctccgcctctcgggttcaagccaccccaagtagctgggattacaggagtgtgccaccatgcctggctaatttttgtatttttagtagggacagagtttcaccatattggccaggctggtctggaactcctgaccttaagtgatccacccaccttggcttcccaaagtgctgggattacaggcatgagccagcacacccggcctgattgttcagtttacactcctactagtgtcgattttcccataacctgactagcagagtgtgttatcactctttgctaatttggtatctgaaatgatactccttgctttcatttccatttctaaaattgtttagttgaatatctcatgtgttcagagactttcactctttcagttgttggactgtatttgttatttttctattgagaatttgtttttctcattcactcattttaaaaattattatttttaaaatttcttttcaatttttattaattattattattattattactattttttgagacagagtcttgctctcttgcccagtctggagtgcaatggtgcaatctcgggtcactgcaacctccacctgccaggttcaagtgattcttgtgcctcagcctcctgagtagctggtactacaggcatgtgccaccatgcctggctaatttttgtatttttagtagagatctcggggtttcaccatattggtcaggctggtcttgaactcctggcctcaagtgatctgcccgctttggcctcccaaagtgctgggattataggcttgagctaccaggcctgaccagtagttttcatttttcatatcattgttcgatttccctgattacttggtaaagttgagcactttatcatattctataggttgattaattgtgtctgaatttcttattcaaaaatgaatttgttgttcatatcctttgtccctttttaaaaaaaattaggtttgtgtctcaggatactttattcttcctttatgttcataagtagagttttatattacttattaaagttattcctagtaactttgttgttgatatctctttctattacagtagaataattatttctactgtatgctgtatagaaaagttattgatgtttatatgttactgtgttgatctgacaatcttaaagaactcttttaacatttcagttgataaacttgtattttctaagtagacattagtgatattttctgctaattatgacactttagcctgttcctttatggtattaaagtgtcttatttcttatcacttagcttaatgacacaacatccagtattaagtggctttgttttaaagtttgattccctgtgaaattttattattttgttcagtgggagacagaactgtaacttgcttttcagaattgttaggctgttatctcaatatttgttattgaatccatatttttgtcctgagttatagaaccatctactctttcaacaaaacatatattgagtgcttatgtttcatctggtgctgttaggtgttgggggtgcagcagtgaatagaacaaatttctagtcttcatggagtatacagctaaagagacagtaataaacaaataatatttttttgatccatagtcatttggatttacagatgcggaacccgtggacatagaagtcttactgcatttatatctgttttttttctgcatttgttgagatgatcatttttccttgatttgtaaatatgacaaccatattaacagattttcccttttgatttctttatgaattttctagctttcttcctatgtcattgatttctagtttcatacaattgttgttagaaagatacttgaaatgatttcattcttcttgaatttgttaaaacttgttttgtggcctaacatatgatctatcctggagaatattctgtgtctgcttaagaagaatgtatattcagctgctgttggctagaatgttctgtatgtgtctgttaggtccatttagtctgtaatgttcaagtctgtgtttccttattaatttttgtctggattatttatccgttgtcgaaagtggggtatttaagttccccactattacggtattgctatttccccctttagttctattgatagtgctttatatatttaggtgctccaaattggggcatgtatatatatttataaatgttacattctcctgatgaattgacctctgatctcttttaacactttttgactcaaagtctattttattttatgtaaggatcctctgctctctttggttaacatgtgtgtggaatatctttttccatctcttcactttcagcctcagtcctttaaagctaaagagagtctcttgtaggcagcatataggtggatcttgtttttaaaaatccgcttggctgggtgcagtggctcacgcttgtattcctagcactttgggaggctgaggtgggtagatcacctgaggtcaggagtttgagaccagcctgaccaacatggtgaaaccccatctttactaaaaatacaaaaattagctgggtgtggtggtgggcgcctgtaatcccagttactcaggaggctgaggcaggtgaatcgcttgaacccaggaggtggaggttgcggtgagctgagatcacaccatcgcagtccagtctgggcgacagagtgagactccgtcttaaacaatcaaaaatccattcaatctgtgtcttattggagagcttaattcttttcatttaaaataattattgataggtaaggagttactactgccattttgtcagtttttctgactcttgtagtttctttgttccagtcttcctctctagccgtcttcctttgtgatttgacgattttttggtagtgatatgcttttgattttctgtttcatgtatcttgtaggcagcatatcattggatcttgtttttaaaaatccactcggccaggcacggtggctcacacctgtaataccagcacttagggaggccaaggcaggtggatcacctgaggtcaggaattcgagaccagcatggccaatatggtgaaattccatgtctactaaaaatacaaaaattagccaggtgtggtggcatgtgtctgtaatcctagctactcaggtggctgaggtgggagaactgcttgaacctgggaggtggggtttccagtgagctgagatcatgccactgcactccagcctgggtgacagagcgagactccatctcaaaaaaaataaaatgaaatgaaaaaattaaaaaaaaaatcactcagccaatctgtgtcttctggagtattaaatttatttccatttaaaataattattgataggcaaggagatgctatcgccattttgtcaatttttctgactcttgtaagtttgtttgtttcagtcttcctctcttgctgtcttcctttgtgatttgatgatttttttgatagtgatatgcgttggttcttttctggtttatgtatctactacagccttttttttgtggttaccatgaagcttacataaaacatcttatagtgttaatagtctattttaagctgacaacctcaacagtataccacaactttacatttaacgtctcctttcacattttgtattattgatttcataatgtatatcttttatatatcatgtatccattaccaaattgttgtatgtatagttaatatttaatacttttgtctctttacatttatactagacttaaatctgatttaggtaccaccattacagtattggagtattctgaatttgaatatattgttatctttatagtgagttttattctttaatatgtttttatgtttttagagttcttttgtttcaatttgaagaactttctttagcatttcttgtaaggcaggtctaatggtggtgacctcccacatttttttctgtaaggggtcacatagtaaatattttaggctttgctggcaatatgctgtctgttgtaactgctgatatctgctattgtagcatgaaagcagatgtagactgtatgtaaacaaatatacatggctatgttccgataaaattattacaaagaccaagtacaggactggatttggcctctggaccgtagtttgctgaccagtgatttagacttctaacatggtagattacattgattgattttttgaatattgaacaagtgtagcattcctgggataaaccctacatggtgtggtatattactcttcttatgttcctgagtttgatttgctaatatattcttgatgatttttgtgtttatgttcacttaggaaattggtctttagttttgcttctttgtactgtctttgcctgattttggctttaggataatgctgacctcattaaatgagtggagaaatgttgttccctcctttttctggaagggattctgtagagttggtgttacatcatcttaaagtgttggttagaaattagttagtgaaagcacctgggcctggagattgttatttcagaaaatttcatactataaattcaatttctttaatagttacagagctgttcaggttacatatttcatcttgggtgagttttggtagtttgtcatttcctatgaattggtccatttcatttaaagatatcaaacttatgtgtgtggagttgttcatactgctcttttattgtcttctttttttttttttgagacggagtctccctccgttgtccaggctggagtgcagttgtgtgatctcggctcactgcaagctctgcctccagggttcacgccattctcctgcctcagcctcctgagtagctgagactacaggtgcccactaccacgcccagctaatttttttgtatttttagtagagacggggtttcaccgtgttagccaggatggtctcgatctcctgacctcatgatctgcccgctgggattacaggcatgagccaccgcacccaaccttattgtcattttaatgtctgtggagtctatagtgaaatcccctttcattcctgttttagttcattttctattgctatagcaaaatacccgagagttggtagtttataaaggaaaaagatttatttggtttatggttctggaggctgagaaatctaagatgggttgccgcatgtggtgagggctttgtgctgtgtcataacatggcagagaagtgcaaggggaagcacatgtttgcaaagagaggccaaacatgagaggcatcctcactttataacaacctactcttgtgggttcacttctccaagagtgagaactcctttcagaacgacattaatccctcttaacaacctaatcacctcttaaaggtaccacctctcaacactgctacattgcagaccaagcttcaacatgagatttggtgaggacaaatgatattcaaaccatagtagtcatttttttgtgtgtgttagttttgctggaatcttgtcaattttattgatctttacaaacagtcagattttgatttgagtttttaaaaagttgtggtagaatatacacaaaatataatttgccatcttgtttttttttttgtttttgtttttttttgagacagggcctcactctgttgcccaggctggagtgtggtggcgtgatcttggttcactgcagtctctgcttcccaggttcaagtgattctcctgcctcagcctcccaagtaactgggattacaggcacgtgccaccatgcccggccaacttttgtatttttagtggagacaggattttgccatgttggccaggctggtctcgaactcctgacctcaagtgatctgcctgccttggccttccaaagtgctgggattacaggtgtgagccactgctcctggcccttaactattttttttttttaaccttccacagtccttttattttggaataggctgtaaacaatcaaaccacgagaacatgattgtacaacagtaaaatgttctcctgtattaaactgaagatatctgtttaataaaaaaaagaaaaagaaaatgtaggaaaggtacttagagctgttactttctaagtacacaacaccctagacaattcaaggcatcttaatctccatcaagaaaaacaagaaaaaataatttttgtcacgctgttaaatccatcattatggatgaaactggtgcatattggtcaaacggatccaacaaacactgatgtccaagctggcatattggcaactaatacgtaactggtggtcaatagagagtttaaaagatcttccctttcttcttgttcttttccaaggttctcgaagagttctgttctaaaatatgttgttgagcttcccagtttgccttctcatcctcaaactgacgacgtttttcctctaattctttgtgctgtgcttccaaattctttttcattagctcacggcgccactggagctcagcttcagagtcctttagtttttgaactttttatttgaccttcatctctaacacctgctccatctccatctctatcttcttcattttagctgcatactcccttctttcttcttccatttgtgccagagggctcttagtcagctgccctttattcttgttgttatcaactccattataagtcacagctgccagttttctgcttctgtagttctcatagtggacattattagtaacatctttcaagtcctgagtgtgtgtttttatcagcatatttcttagaattgtaaaatcacaatgttcaccattttcaacttcagcagcaccccaaggatactgccttcctttgacccttttgccattaacttcaatgatagtattactagcttaccacagcaagaggtaaacagtcctttacctttttagcaagtttattttcttcttcatcatctatttctggaaaatcatatatcttaattttatgttcttggatttctttcattatctgttttttaaactgttggcattcctctggtataagtgtgtctgctttggcaataagttggatgataatcactttttcatgcgaacgcttcataaactcaatatccaatggtttaagttcatgtcctgaaggagcaatgaagtataaacaacactgcaccctgctattaggcatctgacgtctgttcactcgtgattctgcatttaggtagtcctcagatttactatcaatgtaatcgataagaggctgccagcaattactattatccactacatctccaaatcctggggtgtcagctattgtgagcagcaactgaacaccaccttctttgattaaaactttggattgtccacctgtatagtctttttaattctatgagaaggacctggatactctggagcatacaaatctgtaaggaataatgagttgattaatgtcgactttcccaatccaggttcgcctctctgggtaaggtggctcacacctgtaatcccagaactttgggaggccgaggtgggtagattgtttgagctcaggagttccagaccagcctgcgaaataaggcgagaccctgtctcactttgtatgctggtgccagccgggggtgcccctggtaggtgctccctggggtgtctgcttcagggcttctgcgaaggtgcaggtcagggctcctccagctgggaaacttggaatagttggcagctgctttgaatgttggttccttcttctctgatgaccgtgctgtcaacatcaaaacacactgcatctgctgagtagaaaagcttcctcagctctgagtgggagaccatccttggaagaattttcctcgtttctccagtgctagatttctaggagaccacactcttctcttcctgttccttctctggataaaaatgcagcacagagttctgactacagatttcttcaagaaagacctgtggattccgcaagagcaagagcccaggctcaggtgaggcaagggtgcggccggggctgcaactggcgctggccattgaggagcttctgcgcgaccttgcgatcgtgcccgccaggcgccggcccgttggctcgcagcgccagctcgcgccgcgtctggcccttgctgcgcccggctctgcaggccgggaagttgtaaagctcctccatagctgatgggcggcggcggccgggccgaagcctgcggacacggaagggctgcagctcagcggctggttacatcccgcccggccgtctgtggccacccaaccccttaactatttttaagtgtacattttagtgatgtgagatacattcataatgtagacactatccattttcatagctttttaaaaaatcttgttaaactcatactttatagccattaaacaataactcccagtttctcccttctctcagcctctggcaaccaccgttccactttccgtctctgattttagctactcttagtaccttatataagtggaatcatccactatttttttttctttgtgactggtttaattcacttaggagattgttgtcaaggttcatttatgttgtagtatcgcatatgtcagaaattccttcctttttaaggctgcatagtattccaccatagacatactgccaatgtggtatgtctgtaccacattttacttaactgttaattatgttttatttattgtgaataatgctgctgtgaacatgggtgtataaatatctctttggagactctgcttctgattctttttggtgtatacccagaggtggaatttgtggatcatatggcaattctatttttaactgcttgagaaactgccgtactgttttccagggcccatatcattttatgttccctacacctgtgcactagtgtttcagtttctccacgtccttgccaacatttgttattcttttttttatttttcacagtagccatcctaatgggtgtgaggtggtatatcttagttttgatttttcatttttctaatagtcatcgtgagcatcttttcatgtttttttggtcatttgtataacttctttggaaaatgtctgtggaagttctttgctcatttttgagttgggttgtttttgtcaggtgttcgtcccacctcatcctcctgagtacccaggactacaggcacatgccactatgccccactaatagaatctattttagacctaattatattctgtctacctgaaagacaattgaaataaaatgacataaagagaaagataaaacatgccaacactaatcaaattaagctggagtggctatgttaatatcagacaaagcacacttcaaaacaaaacactgggccgggaggctaatgcctgtaatcccagccctatgggaagccaaggtgggaggatcgcttgagaccaggaattcaagacctgcctgagcaatatagcgagactccatctcaaaagaagaaaagaaaaaaggaggaagtttttagttaactgtttgtttgtttgtttgtttgtttgagacagggtctcactctgccgcccaggctggagtgcagcggtgcgatttctgctcactgcaacctccacctccctagttggagcaattctgcctcagcctccagagtagctgggattacaggcgcctgctaccattcctggctgatttttgtatttttagcagagacagggtttcaccatcttggccaggctggtctcgaactcgacctcaggtgatccgcctgcctcggcttcccaaagtgctgggattataggcgtgagccactgcacccagcctactgttgcttttgaaggatacttttttttgctgcatgttttgttcagtgtttagaagggtttttcctttaattttctccttagtactttaaatatgttttttactgtcttctggcttacatagtttcagacaagaagcctgcagtcatttttactttattccccctttaagcaatgtgtattttcttttgctgcttttaatattttctctttattaatctttttcagcaatttgactataaagtaccttactggtacgtgtgtgtgtgtgtgtgtgtgtgtgtgtgtgtgtgtctgtctgtttcagattttgttgtgcttggatctgtgggcttataataatacagcttttaaaatttacagctaattatttcactaaacaatttttttgtccctatccctttaaccccaacctcacacatattagttaggtaggttgctattattccacagggcactgtagctgtgttgtcatttttcatactgttctttattttgaatagatttttttttgttatgtctttagggataatgatcttcttttgtcatttctaatcacatgttaacttttcaatgtgaaatttgcatttttttctttttttcttttctttttttttttggagacggagtctcgctctgtcacccaggctggagtgcagtggtgtaatctcggctcactgcagtctccacctcctgggttcacaccattctcctgcctcagcctcccaaatagctaggactacaggcacctgccaccacgcgcccggctaattttttgtatttttagtagagatggggtttcaccatgttagccaggatggtctcgatctcctgaccttgtgatctgcccgcctcagcctcccaaagtgctgggattagaggcgtgagccaccacacccggcctgaaatttacatttgatgttatcttttgatgttacctttgagttccatgttatttttaatatcttctgtttctctcatattcatgttttctttacattcttgcgcatatgaggcatacttataatagctggattattggattatgcccagtagttaagttgggaatcattattgttcagttgagacttatttatttttttcatacagagtcactctcaggataagttgagacttatttgtcagctcttttagggatggtctagaatagcatttgttctgtggctcatttagccctgctcctaaaggtgtgtctcactctggtctctgctgaatgtgttacatagtcattgaggtcttgccactctggctaaagacaatacagttggctagagacaatacagttgattcgcagctttctgtgagctctgggaattgttcttctgtaattgctctctccctggaagttgttcttgttcagtcttctgggatttcacatcacacatgtgcagattggtattcagttgaaactcaagggtatccctctgcagatttctggagctctttctctgaatacctctcttctcttgggtagtctgtcccacaaattctagtcttcttgagccacctgaacctatgatttctgtcttctcatttcagctctcattttgggttcctatctctgtgtggtagtttctaaattaatgccaagcagaaagcctgtgccatggtaggggtcaccctgtttctttccctttgttcccttcgccatacctgttgcccagtgtcttataataaggttgtttcttatatttgtctggtttcctagttgtttgggctggagggtaattttgacctgtcttactcccatgtggctttatgtagaagtctcctatgttactttaggaactcaagttggtttcagattctgagattaatatggaacataaagttttggtagaaaattttctcaaataaagttagttgtattcttttacttcacatttcttggtaataaagtgaagtgaagaacactgaaatgaaagggttaagagacaggaaaaagaggggaacgaagaaaacccaaagaagggttaaaataaataatcttcatgttgtcatttgtaattagacttcaaactttccttaaaaactgaaactggaaatatctgactcaatatggaaatataaaacatgtatctattttgctgtttaaatatgaaagttggcaactgatagggttttgaagagtatgaccattatctttgcattcagaatatagtgtttgattagtcagaaaagtcacatggcagaagccaatgagcagcaataaggacaccgatgaaataaaagaattcgaaaatgacatgatgtcaataagttggtccattgcccagaaggaaaggaattctgatgaattgatcaacgtaaaaagcatgtcttcctagtgccaaaaccaagaatagaaatcagaagaaaaatttgaaaagcaaaaattaaaatcaaaattattttttaaggagtaagtagggcaatgcagataactgatatgttgatagagattataaactagacagaacgagcttgaaataaagccagttgtgccaaaacaaacaacagcatagacagtgatggtcaagatagtggagaaaaaactcaaagtagagcaaaacatgggtctgagagattaagttaaaaagtcagctaaaccatacggtttccaatttctttaaaagtggatgtttatgattatgaaaaatcacaaaagaaagatgaaaagtaaactctacctccataatggcatgtgaattattttgtcattctctattttctttgaagcagccatgttgggattgtttcgaggatttctagtctcccagtccccagttcttgtattggtctacaggtttctaaacaaaaagtgatcctattaaaaaaaaattcttagacctcatgccttcttaccccctaccgctgactctgccccagccaccgtatatccttcttgtccctctaacccccctcacttgctctcatctcaagaattttgcatttgctgttacttctactgcaatgcttttctcccagatatctgtatggtttgcttcatcttcagttctgtgctaaagtggctccttacaaaattttattttaaaacatttattttataaatctgttatttaaaatagctagtccctttttctttgctttcttttgttggatgttgtatgtgtaatacttgtttactgttgtctcttctcactagaatgtagttttgtgacaggagggattttgttttatttatttctgtatccactgtgtttgaacagagtcagacacaaaggaagattgatagagtaatctagtaatgcttgctcaatgtgttgtccaaatacttgtttaaaatgcttcaaactataatgtttcatctatcagtttccgacagtgggatgttaatatctctctaatgattagttaccaatttctctttgttctgtaaatgtttgctttatgtaatctgaagttctcttatgttatccaagtaaattaatttttttatcattatgacagtttaagccatttatgtttactgtgaaaattcatatttatatttatctttttatgttattttctatgtaccatttgttttcattccttttctgcctgctgttggattgatcaaattttcttatcccttctttccactttattttaatgttttctatcaaatttaaaaacaactacttaataaattctttttttttgagacggagtttctctcttgttgcccaggctggagtgcaatggtgtgatctcagctcaccgcaacctctgcctcccgggttcacgccattctcctgcctcagcctcccgagtagctgggactacaggcgcccactaccacgcccggctaatttttttgtatatttttagtagagacggggtttcaccgtgttagccaggatggtctcgatctcctgacctcgtgatccacccacctcagcctcccaaagtgctgggattacaggcgtgagccaccgtgcccagcctaaaaacaactacttaataaattctaaagatgttctttctttttgtccatgaacaataagatccaccttagagtgttttctccctaattcaccctttttcatctttcaggttttgtagtctttttatttagttctgccttctttcccctttccccctgtgaagtttgaagtgatgctattttgactgcttgacttgttatgtaacattaacaaatttctaatgttgaatcatcctggcattctgattatattcaataggattgttctcagtttttattttcattcatagtttttgacaatgtttgttggaattctgagtcaggtacttccttttttttatttttggttaagaccgactttttgatagtttttagtagtttaattataaaaccatttaggctttgattacttcaatttttttttctttttgagatagaatttcgcccttgttgcccaggctggagtgcagtggtgcaatctcggctcaccgcaacttctgcctcccaggttcaagcaattctcctgccttagcctctcgagtagctgggattacaggcatgtgccaccatgcccagctaatttttctttttgtttttgtattttttttagtagtgacggggtttctccatgttggtcaggctggtctcgaactccctacctcaggtgatctgcctgcctcggcctctcagagtgctgggattacaggtgtgagccactacgcccggctggtcaccttaatttttaatatattattatgttatagctccttcatggtttaggttggttaactttttttttttgagacagagtttcactcttgttgcccaggctggagtgcaatggtgtgatctcggctcactgcacctcctgcccactgggttcaagcgattctcctgcctcagcctcctgagtagctgggattacagatgtgcatcaacacgtccagctaatttttgtatttttagtagagacgaggtttcgccacgtaggccaggctggtcttgaactcctgacctcaggtgatccacccacctcggcctcccaaagtactaggattacaggcgtgagttactgtgcctggcctaggttggttaacttttttatgagaacaagacttaaatggatttcttattgtttaaaacatagttctttgttttattcttttttcatattattcttttatttcatattgtccccccccccccaccccccttttttttgtttgtgtgtttgagacagtctcactctgtcgcccaggctggagtgcagtggcatgatatcagctcactgcaacctccatctgtcaggttcaagcgattcttgtgcctcagcctcccaagtagctgggattacaggcacacgccacaacacctggctaatttttgtatttttagtagagacggagtttcaccatgttggccaggctgttcgtgacctcctgacctcaggtgatatatctgcctcagcctcccaaagtgctgggattacagatgtgagccaccacagccagctgtttttcactttttaaatgttttatgtttttcaattaaatactgagttgatttgtattttttctttctatttcctccctccctcccttctttgttttttttctttagctggaattactggcacgccaccatgtttgcctaatttttgaattttttttttggtagagatggggtttcgccatgatggccaggctggtcttgaactcttgcactcaaatgatccatctaactcgaccctccaaagtgctggggttacaggtgtgagccaccttacccagcctttttcttttaaagagtttaaaatactgcgaaataatttaaaacactgacattatctgagtactgctttgtcagtttccaagtttttatgtgtaatatcttgttgctcttatgtgttattaatttttcttttactcatttctataccgtatttagtacaattcaaagaatttaaaggcattagttttttttttttttttcaattgctttctgtcaggaatttcaccttgctgtgactcttacctttattttactttcctgaagtgtttataaattaaattttattatgcttgtaaggtggacatgattataatcgtgcttaatttttaaaattttgttttttagtcatctgcatcacagtcaccaaaagcaccttttacaaagcttttaaaaatacatatatctggtcatttcacatcaactttattaaatatagaagttaaacctggtatgtgaactttgtgaagaacccattatgtagttaaaagccactactgtagacagagggagacttcagaaggttacctaaaaaaggggcaaaaccagagtgaggaatacttaagtgaattatgaggacacaattatattcatgtgggtctgtcctcacatttagagtataaggaagtgctggatttaagggagaaaatgactgtaaactctgatattttctacttgatatggtaaaatgctggaaaaatgccctaattacttattttgtataccttcaaattgtgccttatgttgaatataagtctaagccttaaaatttaacatttaactctatgtacttattatttttttttttttctgtagacctcgaagtagggggaaaactgcagtggaagatgaggacagcatggatgggctggagacaacagaaacagaaacgattgtggaaacaggtatcagaactcaagaatttataagaatgtataatgatgctttgcatatgtttgtacactgcatgtagcatttgtataacaatattctgtgttaagcatttgtttttatactgaactctaagtttcccatctgccttgttttgataactaatgacaaagtgaaaaaactgagccctctatctctcttttttccctaagccctggtttagtataattattttatatctgaagataaatgttttatcaaggaaataaagactgggagaaacagtaatccaggctgttagtataatcgctcatagtatattctggcctatgaaccatctagtgtttgtttaaagcttattttgttaatatgtgttctgaaaaaagtagtatgtttcgttatggaattaatattgtgaaaggctaggccaaactagaccaaatagtttctggtctgttggacttttaggtgcccttaaataagctgctgtatgttgtgcatctgcaaaaggtagctagagttggttgcccaaagcagtttccaaaattttcaggtcagtggtaagttatcaaagggactaggattcatattgtattgagaggatacctgtaggagatagtctctcattggtaaagttttcaatagttgttagataaagtttagacacagtgataggctttttctctgaagttgaatatcatcttgatgcttacagaatatcatgcagttaagagatgagaaaaattaaaaattgttatagattttaaaatacatttttccagaaatccttacagttgtcagatgtgttgctattatataggtataattcttggaaagccttcaaataatctatagtttctttccaataaggtctagttagagtattactcttggaagctcagaatactaaatttcacccttttgtgcacattcatgaattactgtattactttaaactgttaattctttttcatatggtttttttttctgtactatatattgttacttttactactgaaaagtctttttgaagctttagtgtttttgtttgtttgtttgtttgtttttaagacaagagtcttgctctgttgcctgggctggagtgcagtggcgtgatctcagctcactgcaagctctgcctcctggattcacaggttcatgccattctcctgcgtcagcctccttaatagctgagactacaggcgcccgccaccacacccagctaattttttgtatctttagtagagacggggtttcaccgtgttagccaggatggtctcaatctcctgacctcataatccgctcacctcagcctcccaaagtgctgggattacaggcgtgagccactgtgcctggcctattgttgttatttttgagacagagtcttgctctctctcccaggctggactacagtggtgtgatctcggctcactgcaacctccacccgccgggctcatgcagttctccctgcctcagcctcccaagtagctgggattatagacatgcgccaccatgcctggataactcgtatttttagtagagacagggttttgccatgttgacgaggctggtctcgaactcctgacctcaggtgatccacccacctcccaaagtgctgggattacaggtgtgagccaccgtgtctggctctaattattattattgctattattattattattattattattattattattattctttttgagttggagtctcactcttgtctcccaggctggagtgcagtggtgcgatctcagctcactgcaatctctgtctcccgggttccagtgattctcctgcctcagtctccctcctggtctgggactataggtggatgccaccacgcctcgctaatttttgtattttttagtagagatggggtttcaccatattggccaggctggtcttgaactcctgacctcgtgatccacctgccttgccctcccaaagtgctgagattacaggcgtgagtcaccgcgccgtgcctgattattattttttttaattttgtttttttgagacagagtttcgtcctttgttccccaggctggagtgcagtggcgtgatcttggctcactgcaacctccgcctcccaggttcaagtgattctcctgtctcagccttctgagtagctgggattacagccacccgccaccacgcccggctaatttttgtatttttagtagacacagggttctcccagtgtttgccaggctggcctcgaactcctgatctcacgtgatccgcccaccttggcctcccaaaatgctaggattacaggcgtgagccactatgcccggccctttgattattgaagatgattatttcaccaccttttcttttctcctgaaacttccaacaccccttctcatttttgattctttagtgatgatcttgcttatttcagtgaaaaaataaaaaatagagaacaattagaaaagaagttccatattcatctaccatcaaatctattttcttgcttgcatccctacccgtatgttgtttctgtcctggtaaaatgggataaagactgcggataaagccagctcctctgcttgtgtcttccattgtgtcccctctcatgtattacggactttggttctgcagttgtccttgcttttctgcatcaataacttttccatctcattgatttcattagcataaggggggtgctgcagaatcaccccctttcaacacaaatagcctctcttgatccaacatccccttttaggtactatacagcttctttgctccatcatagcaaaaatccttgagttatttatacctatgattactacttatttttcaccattttctcatgaacccactctaatgaagctttcttcctcccattctactaaaattattcttgtcaatgtaatgatctcatattgcccagaccagcttttagtcttcatcctccttaacctttcaggatcatttcacacagctaaccactctcaggagtgaaacttttttttaaaacttgactttcaggtcactgcattgtcttggtttttttttgtttgtttgtttgtttttttgttttttcctactccttcactggttttttctcattctcttcgctcatcttcttatgtattaggtggtcttattcagtttaatggcttattatctatttttgtgctattattatgttatctaaatgctaatgactctaaaattacgtcaccagctctttcttgctttgaacacaacctgtatctttcagcttgtttcttaacatctcttcttagatgtctgaagaggatctcatatttagtgtgtcctctctggaaatttttgttgttatcctgaaaccctctcttccagtgttaccacctctggtatattgccactgtatattgttcaggcttaaaaagatggagtctttcttgatttcacattttcacattttacattttatacattcacattttagacattcacatttcacattttcacattttagacatccagcccactggagggctttacctacccagtatatcctggattcaattactttgacccctccactgctattattccagaacttcacactaccattccactggactgctgcaatagcttcctaactggtctttttccttttcattccattctactcttgtcccacacatagtagccagagtgatccttccaaattcaaagtgagagccttttacttccctctgtcaaccatccaaagactccagtgatatttagaataaaattcaaagttcatgcagtaccattgttttcaggctccattgatctgactttggctacttgtataaccgtatcttatgttcccttgttcactgggctccatccttactggcctcctggcttttccaggagcccaccaaacatactcctttctcaggcatttgcactttttgtcttctttgcttggaaaaattttttctcagatattcatacagcttattcccttacttcagtcaagtctctactcagttacagttttcccagagacctttcctgacaaacttgtctaaaaagtaacacttgtcactttgtcttctcctgctttatttttctcctagtacgtaacagataggacatttaatttcatattggcttattgtatgctttccacactagaatgtaagctttatgaagtcaggggatttgtcttgttaccttatttatccccagtgccaagaatacttctagggatataggaggaattggattcactaagtgaagcagtattgtgttcttgaattttctttatgttttctaagctacctaccattcttggaacattacaacattacaacaaaactaaattcctggcatttttttttccttactggagagtagtaagccccacgaatggactgtcttctcatgctgtctcctatgagaggtcaaggcaaatacagtttagataaatgttttaataggagcagaaaactattttttttaacctggctttactaaagttaataaagccaagtgtatattagtctttgttttgtctttgtccttggaaagtccattgtccacttcttttagggaacatagtgaacatagggcaaggagaacagtgaaagaaagaataactgttataaccactaaacctgcaaatccagacagagtttgttccataaatttctagttcatttaaaagcacattcaagtttgctgcaaggttttaacatatgtatgtctcaagaccccagggtttatttgaaggttctcttgttcctgtaaatcctgtgccttgacatgcttacttaatgttttgtagtaatataagggtattacgctgggcgtggtggctcacacctataaccctagacctttgggaggcctaggtgggtggattgcttgagctcaggagttggagaccagcctgggcaacatggcaaaaacccgtctctacaaaaaaatacaaaaattagttgggtgtgatggtgtgcacctgtagtcctagctactcaggaggctgaggtgggaggatcgcttgagcccgggagacaccagttgcagtgacctgtaatcagtcgcaccactgttcaccagtctgggtaacagagtgagatcctgtctcagaaaaaagaaaagaatgctaatgagtctcctaccatggtgggtggatgggaatgagtaatctaggagtagccattgggaaagtaataagaaacctcatttggtaatattttatgttaagaaaatttcatctttatctcagctcactgcaacctctgcctcccgggttcaagcaattctctgcctcagcctcccgagtagctgggattataggtgcctgccaccatgcctggctaatttttttgtatttttagtgcagactgggtttcaccatctttgccaggctggtcttgaactcctgacctcgtgatccacctgccttggcatcccaaagtggtgggattacgggcatgagccaccacacccagctgagaaaatttgatcttttgttggtggtggctgttaccagtctctgcgcattttttttatatgaataaaatcaacttgagtgaagtgctagttacttgaagagaagagaaactttttttttcttgagaatcacataatcaggtctttgcaaacttgttttcattaactataattagctaattataattcagttagttataattaaacatttttctcctagtgttcaagttgtcatagtttggctcatgggagccccttgtcagctggcttctgagtccttttaaataacatctcaaaacctttcagagctctgtgctctttggcaaaagttttatttttcaggcccatttaaaattctccctgccacaaggtatgaaatcagctattctctaaggacttctagttttttagtggagaatagtattagggacaaaaatttaggctcaagggatatcgggggaaattcagccagatattgggcaaaattcacccccgataattcacgtaggttcttttctattttccctaagcttcggctggtttgagaaatagagggacagagtacaaaggagagaaattttaaagctgggcatccgggggagacatcacatgttggtaggttccgtgatgccccacaggccgcaaaaccagcaagtttttattagtgattttcaaaggggagggagtatatgaatagggtgtgggtcacagagatcacgtgcttcacaaggtaatagaatatcacaaggcaaatgaaggcagggcgagatcacaggaccacaggaccagggcgaaattaaaattggtaatgaagtttcgggcacgcattgtaattgataacatcttatcaggagacagtttgagagcagacaactggtctgaccaaaaatttattaggcggggatatcctcttcctaataagcctgggagcgctacgggagactgggacttatttcatccctacagctcgaccataaaagacagccgcacccaagggggccattttagaggcccaccctcagggatgcatttgctttcttagggatgttccttgctgagaaaaagaattcagcgatatttcttccatttgcttttgaaagaagagaaatgtggctctgttctgcccggctcaccagcggtcagagttcaaggttgtctctcttgttccctgaacattgctgttatcctgttcttttttcaaggtgctcagatttcatatagttcaaacacacatgctctgcaaacaatttgtgcagttaatgcaatcatcacagggtcctgaggcgacatacatcctcctcagcttatgaaaatgacgggattaagagattaaagtaaagacaggcataggaaatcacaagggtattgattggggaagtgataagtgcccatgaaatcttcacaatttatgttcagagattacagtaaagacaggcgtaagaaattataaaagtattattttggggctctaataaatgtctgtgaaatcttcacaatttatttcttccaccatggcttcagccggtccctcagtttggggtccctgacttcccacaacaaagggatgcatattacaattgttactgttgagaattagttatgtgagtccactttagtcatatactagtacagtcatgcactgcataatgacagcagatcacatatatgacagtagtcccataaaattataatggagcggagaaatttctgtcacctcaatatgtcatagctgtcatgatgtcatagctgtcgtgatgtcatagcacagcgcaacatagtgcattactcacatgtttgtggtgatgctggtgtaaacaaacccagtgtactcccaattacatgtactatacaaaagtacactacatacactcttgcacagtacataactcttgataataagtgactgtgttactggtttatatatttactatactatactttttatcattattttggagtgtaccccttttcttaagcaaaaaagctgtaaaacagcctcaggcagaaccttcaggagctatatcagaagaaggcattgttatcatacgaaatgacagctccttgtgtgttattgtcgctgaagaccttccagcagggcaaaatgtggaggtggaaagacagtgatagtgacgatcccgacttcgtgtaggcctgggctaagtttaaaacaaaaacagagaaacaaaaaagaaaaaccctaaaaccaaaaaacttacagaataagggtagaaaggaagattttttttgtatagctgtacagtgtgtgttttaagctgtgttattacaaaagtgtcaaaaagtttaaaaaaagtttataaagtaaaaatgttacagtaagctaaggttaatttattactgagcaaagaaaaataatattttaaaaatttggtgtagcctaagtgtacagtgtttataaagcctactttagtgcatagtaatgtttgaggcctttacattcactcagtgattcacccagagcaacttctagtcccacaagcaccattcatggtaagtgctctatgtaggtgtaccattttttgtgtttttacactgtattcttaccattgtttctatgtttacatatatttagatacacaaatacttgactgttgtgttatagttgcgtacagtaacatgctgtacaggtttgtagcctagagtactaggctgtaccaaatagcctaggtttttagtaggctataccatctaggtttgtgtaacagtgacaaaattgcctaatgatgaatatttcagaacatatccctgttctgagaggactgtaattacatagatctatacacacacttacaaatgtgagttcacatcgatacattcagttacttctagcataagtttttaaaaatagactttattttatttatttattttttttgagacagagtttcactcttcttgcccaagctggagtgcaatggtgcaatctcggctcactgcaacttctgcctcctgggttcaagcgattctcctgcctcagcctcccgagtagctgggactacaggcatgtgccaccacgcccagctgattttgtatttttagtagagacagggttttccatgttggtcaggctggtcttgaactcctgacctcaggtgatccgcccacctcagcttcccaaagtgttgcgattataggcatgaaccactgcacctggccaaaaatagcctttatttttcagagcaattttaggtttgtagcaaaattgtgaggaaggtactgaaatctcccataaatccccttccccgacacgtgcatagcctttttcagtatcaacatcctatactagagtggtacatttgtcacaattttttaagcctacattgacacattatccacagtttatagttcacataagggttcactcttggtttacattctatgggtttggacaaaggtataatgacaggtatctgtcattatagtatcatagtcactgccctaaaaattaataggtgttccacctattaatccctccctccttgctccctccctccttgctaacctatggcaaccactattctttttactgtctccatagttttgccttttccagagtgtcaaatagtttgaatcatataggatatgtagtcttttcagactggcttctttcacttaataatatgcatttatgtttcctccacatccttttctgtttttttcttttctcttttcttttctttctttatggagtcttgctctgtattcccaggctggagtgcaatggtgtgatcttggcccactgcagtctccgcctcccggtttcaagtgattctcccgtctcagcctcccgagtagctggtattacaggcatgcaccaccacacctggctattttgtatttttagtagagacggggtttctccatgttgatcaggctggtctcgaactcctgatctcaggtgatccacccgcctcagcctcccaaaatgctgggattacaggcgtgagtcaccgcgcccagccctcctccgtgtcttttcatgtcttgatagtgcatttcttcttagtgctgaataatattgtattgtttggatggaccagagtttatccatttgcctactgatggaatttctatttgcaccctggttttggcagttaagaaagcttctgtcaacatctatgtgcaatttttgttgtggatgtaagttttcaactcatttggataaataccaagcagcatgatttctggattgtatggcaagagtatgtttagttttgtaaggaaccaccaagctgtcttccaaagtggctgtgccattttgcattctcactagaaatgaataaaagtttctgttgctctgtgtacttactgacatttggtggtgttggtgttccagattttgaccattctaataggtgtgtagtgatgccctgttgttttaattttcatttccctgataacatataatgtggaacatctgttcatatgcttatctgcccatctgtttatgtttattggtgaggtgtctgtattccctatgctttttttctttctttctttctttttttttttttttttttttttttaagacagagttttgcttttgttgcccaggctggagtacaatggcacaatctcggctcactgcagcctccacctcccgggttcaggcgattctcttacctcagcctcctcagtagctgggattacaggcacctgccaccatgcctggctactttttttgtatttttagaagatacggggtttcaccatgttggtcagactgatctcgaactcctgacctcaggtgatccacctgcctcggcctcccaaagtgctaggattacagatgtgagccaccatgcctggccttccctatgctttatctcctgaaagagagtatagagaaatggtataatttcttccttaaatgtttggtagaattcagcaatgaaccaaactgggtgtgttcaatattcgaagtttattaatttttgattcaatttgttttaataggtatagacgtattcagattatttcttcttgtgtaagcttgagcatattgtgtcttttaagtaattggtccatttcatctaggttatcaaatttgtgggcatacagttgttaatagtatttcttgaatatttaagattccatgggatctgtagtgatgtcccatttttcatttttgatattactgagtgtagattttccctcctttctgaaacagttggccctttaatagcttggggttgaaccatgtgcatgcactgataaatggatttttttcagtaaatatattggaaatttttcgtggagattcgtgacaatttgaaaaaatgcgtagatggactgtgtagcctagaaatatttaaaaaattaagaaaaaggtatgcatgaatgcataaagtatatgtagatacttgtctgttttattgtttactaccataaaatatacacaaatctattactgaaagttaaaatttatcaaaacttaagcacacacttaaagactgtatgtggtaccattggcaattgagagaaatgtaaacaaatgtaaagatgtagtattaaataataactgaataaaatttactgtagtacatactgtacaactgtaataattatgtggccacctcctgttgttattgcagtgaactcaagtgttgcaaatatctgattaaaacaccatgggataccaatcatctttgagcagttcatctctccagtaaattgggtatcttggtaaaaagtgatctggcgcttctcatgtatctttcaccatgttcagtgcagtgctataaattgtgcataacaccacgggacccatatgaagtgccactaatgatgcttaaagtgctccctacaagaagcaaagtcatgacatacaagaaaaagttgaactgcttgatgtgtaccatagatggaagtctgtagctgaggttgcccactatttcaggtagacagtcttgtaaacaggtgacataaacttatggtatcagtaaatacagtatggtcttgtaaatgtattttctcttccttatgattttcttttcttttctttccttttccttttccttgtctccctggctggagtgcagtggcacgatcttggctcactgcagcctctgccttccgggttcaagcgattctcctgcctcagcctcctgagctgggattataggcacatgccaccacgcccagctaagtttttgtatctttagtagagacggggtttcaccgtgttagccaggatggtctcttatctcctgacctcctgatccgcccgcctcggcctcccagagtgctgggattacaggtgtgagccactgtgcctggccatgattttcttaataacattttcttttctctagcttactttattgtaagaatacggtatataatacaacacagaaatatttgttaatctactgtttatgttattggtaaggcttcctgtcaacagtaggctattagtagttaagttttcaaggagtcaaaagttacacagatttttgactgtgtggtgggggggttggagcccctaaccctctcattgttcaagggtcaactgtatatgtgttaaatgccataacttttcctctaagcactgctttcactgcatctcacaaattttctttttattttcatttagtttaaaatatttttcaatttctcttgagatttcttctttgacctatgtgttatttagaagtgtattgtttaatgtctcagtattttgggattttaagctatctttctgttaccgaattctagttgaattctgacgtgatctgagagcagacattgtatgatttctatttttaaaaatctgttaaggtatgttttatggctcagaatgtggtctaccttgtaagtgtcccatgtggatgagaagcatgtgtattctgctattgttgatgaagtagtctttagatgtcagttatttccagttgattaacggtgtcagattcaactatgtctttgttgattttctgcacgccagatctatttctgagaggggtgttaaactttccaacgataatagtgggttcatctcttactccttgagattgtatcatttttttgcttcacatattttgatgttctgtttagacacactgatgtcttgggaattaacccctttatcattataaaatgcctttctttattcctgataactttgacatctgagctgtctgaaattaatatagctactcctgctttcttttgattatttttagcctggaatatctttctccatccatttatttcttatccgtatgtatctttatattatagttaaagtggggtttttttgtagacaatatgtacttgggttttctttttaaaaaatctattctaggccatgtgcggtggctcatacctggaatcacagcactttaggaggctgaggcaggtggatcgcctgaggtcaggagtttgagtccagcctgaccaacgtggtgaaaccccacctctattaaaaatacaaaaattaaccgagcatggtggcgggtactgtcccagctactcaggaggctgaggcacaaaaatcacttgaatccaggaggtggaggttgcagtgagctgagatcgtgccattgcactccagcctgggcgacagagcaagactctgtctcaaaacaaacaaacaaacaaacacaacctattataacaatttctgtcttttaattggtatatttagaccattgttactcaaagtgattcttctttatttttagagacagaatctcactgtatcacccaggttggagtgcagtggtgccatcatatttcactgtaaccttgaactcttgggctcaagccatcctcgcacctcagcttcgcaagtagctgggactacctgtgctcagcctcccaagtagctgggactactggtgcacaccaccactcctggctaattaaaaaaaaaatagtttttttggagggacgggttctcgctgtgttgcccaggctggtcttgaaatgctggcctcagcctcctaaagtggtgggattactgggatgagccaccatgcccagctttagagtgattgttgatataatggaatggatatctaccatatctgttaactgttttctatttattgtccttgttctttgttcatatttttgtcttccactctttttgtgctttttgtggtttcattttattttattgtattataattttttgagacagagtctcactctgttgcccaggctggagtgcagtggcatcatcttggctcattgcaagctccgcctcctgggttcacgccattctcctgcctcagcctcccgagtagctgggactacaggcgcatgctttcctgcccagctaatttttaatatttttagtagagacggtgtttcactgtgttagccaggatggtctcgatctcctgaccttgtgatctgcccgcctcggcctcccaaagtgctgggattacaggcgtgagccaccatgcccagcctgccttttgtggttttaattgagcaatttgtatgattctgttttctcttctttcttagcacagttctctctttttttttttgagttgttgccttagagtttgtaatatatgtttacaacaaacccaagtctactttctaataacactgtgcagtagtgtcccactttaactgtggttttgcttttcacagttttggttacctccagttaaccgtggtctgaaaatactaaatgggaaattccagaaataaacaattcataaattttaagttgtacgctgttttcagtagcataatgaaatcttgtgcttttcagcctgagatgtgaatcatctcttggtccagcacatccatactgtatatgctacctgcctgttagtcacttagtagccatcttagtatgattgaaaaagcatactggatatattgggtttgctgttatttggtttcaggcatccgctggggtcttggaatatattccccatggataagatggcaccactgtaattttcacttgtaatgtgagtactttataagaacaaaataatcctaattccttcctcgcatcccttgtattgttgctgtcagtcatttcagttatacataagcatatgtatttatacataagcaatcataattgaatacattgttgcagatattattttgaacaaacttatctattagatcagttaataagaaaaaagtttttttttaaaattttatcttcacttgccccttctgagatgctcttcctttcttgatataggtctaagtttttgacctgtaccgttcttgttctctctgaaggacttttaacatttcttgcaaggtaggtcatctgacaacaaattcttaaatttttgtttgcctgagaaagccttcacttttgaaggataattttgcagggtacagaattctaggttgatgttttctttctctcaacatgttacatatttcattccctcttttcttgcttgcatggtttctgagttgatgtaattgttaccttaggtatttttttccctctgacctcttttaggttttttcagtattctgtggtttttaatatgatgtgaccaggtgtagtttgtttgggcatttatcctttttgatgttctttgtcatttggtttctgagattaatttgaggaatatttcttcttcttcctctcttttgtctctttttggtatttccattacatgttacctttttgtagttttctgtattaaacattctgttctttttttttttttttttcccagtctttttctctttgcttttcaggtttggaagtttcttttgaaatatcttcaagcaatgagattgtttcctcagctgtgtgaggtctactaatagacccactaaaagcattcatcatttctgttagttttaaaaaaatctctatcattttaatctctagaatttcgagttctctgcttacattgcccacgtcttcttgcatgctgtctactttatccattagaaccgttagcatattaatcatagttgctttcaattcctcatctgatcatttcaaattccttcctgcatccaagtctagttctgatgttgctctatactgtgttttttgctttttagtataccttgtaattttttttctcgatagccaggtgtagtacactgggtaaagacaacagctgtaaataggcctgtagtaatgtggtgggccttgtaggaggagggggaagtctgaattttttactcttcctccccaccctgccctttcactgcttttaggtggggcagaatggcctagaatgggctaaagttagatagttctcttaggctagaactggctggagtttatttctcttctcgtaggttaggctctagttaaatagtttctcctgaaggcaggccttgttaagagaaatggttccttttcccctcctgctgttgaaagcaagaagatatttttctgtgaagttcactgtgagaaactggtagagctcctagaggtaaaacacaaaaccgtggggccccacgatgactgggtccctctgtagtttgtatcttccagactcgtccacactgaacctccaacgttttgtcaattatggttcaggtttttgtacccatggagctttttacccatgggtttctgctcaggtaagttgtgattcatgtctattcctccagttctgagggtacctgtttgccctgtgactttattgaccttatggttctagcaagagttgttgatttttcagtttagctttttacatgtattaactatagttatatcccttttctaatttggtaagccagttctaactatagtggaatggattataattgttaacaataactaagttaatacctatccattattataaatatgtctcataaataataattcttattaaaatagtaaaactatcggatttaatatcaagattaccatttgtgactaacctttgagggatttccactaatgatgtctatcatactgccttgagttatgtatcaaaatcttagattatcttctggtctaattatttgttaatttttagctgttgcttatgtaatgactattggttcttatttagtggtggttttcagatgttagtatttaattgacatagacaagataggggtcttttgctttgtcagtacacttgatgagacaggtggaattggagttccaaagccatacacgtgttactttacttcagcgccttttggttatttgcatatggtttaagtatacagctttgtataaaccctacatatgcctttatttacaagaatagaaactttagtgatattattattttaaaaagtggacaccccaaattattgtttgtacattttgagtctagctgctaattcacaacagattatggtgacatttggcacaaagaaaaagcctggattcttattacattaattggcctaacaatttaactttacctgtcctttcttatctttttttgatatgaaagtttgtaattgacacttctctttttgaagtatcaggtttttctttggataaaattttccctaactttagtatattatttaaaattatatactgtggtggtagatattggtgttgtctgtcaaatagttctggcactctcccttctggatatgtggtggaattacacagctccaagcctgcttgacaggcccatgtgactgtgtccagtgaattgtgggtggaaatcatatgggtcacttctggactggagcaaaaccctctgagcttttttcttttgtagttactgtcagtgtttgaaatactgactgcttcgatggtttagttgaagagatggtgaagcaaagacacctatatgtctttgataagccatacataattttcaaactgaagtttaaaatgaaaaattcagcttcttattgccacgtaacaaatcatttcagaacacagtggcttaaaaagcaaacatatttcatgatcttgtgggttaggaatttaggtcaggcttggctgggcagttctgctctgctggcatccaccagagtcatttattgctattcaggtgacacctgggctggtctagagggtccaagacagtttcattggttcatttttgtttttaaggcctaaataaagttaaatttcagaagaagatcaatattggtagaaataattgttataaagatgtatgttgtaatttgttggtttattttagtttcttttattaattgcaaaaaattccattaacatttaaaagttatgtaggaaaactaaaggaaatactgataacaactaaataaaacacctagagaacagttgacttccaacagttactattttttttcatttattagcagtctatcctgcttaaacaattactatttaaattaatgcccgcatattttttggcttttgacaagtattggactcttaagctttttgaatttgcattaaaaaatcacattaaatattataacagtaatgtatatttgtagaaatttatggaactgtgggtaattataaagagagtaagtcacctgtaaaagtgttaactctcagagaaaattagtgctttttttgtgtatttacttttagttgcttacattgttctgtgaaagcagcaactatattcatattattaatcagtgtcaatattttaagtagtttagtgaataaagatagtgttaataaataatttgctttttctaatatagtgctaatgttttagctttacagtacaattttgatgacattggatacactagattcaatgagatatatccagaaaacataactgtcaggaggcagacttctttcaaaagaagggagggacatggttacacaatttcttagctatgttttcttctgtagttttagtaggaagcaagcatgaaaagtattgccattctctggagttaagggaagtcagttattctatttaatagctgattaggctgggcatggtgatggtggctcatgcctgtaattctagcactttgggaggctgaggtgggaggataactggagcccaggagttcgagaccagcctgggcaacatagttaatccctgtctctaccaaaaaaaaaaaaaaaaaaatccaggcgtgatcgcatgtgccttgtagtcctggctagtggggaagctgaggtgggaggataccttcagcccaggagtttgaggttctgatgagctatgattgtgccactgtactctagcctgggtgacagagcatgagcccatctcttaaaaaaaaaagttgattaaagcatagagggagaaggcatattttttggataactagtcgataatgaatgtcagtgtttacttgcatagttagtaaatatgagttcattttaaatatattatttttctctgtgctttttataaatctttgtatctatatatgagatttatctgcttgctttatattatataatattaattaagcaactatcgaacatcattcaggttttgtggtagctctggtttataaaaacagatacagtgcctgttttcatagagcatatagtcaaattggggctgtggtctcctgtgaatggcacatacagaacaggggttcttaactttttcagtgccatagtcccctttggtactatgatgtaatccatggactctttttcaaataatgtttttaaatgaataaaataaaaatacaccaaaataggattacaaagataaacaattgcattgaaataaaaataagccaaacttgtaatcttataacatctttttaattcacttaaattataaaatctagcagtgaatttaataactactgtaattttgaagtagtgatgagggtgaatgatattttgggatatctgcaacaactgcatgtgataagaaaatatccgtgatttctgttggtgacaaacacttaggtatccaccaataccactgtgcttgttgcttacattcttaatattttcttagaattctaaattttggaagtgaataaaaattagaggttagtaaaaataaagaagtaatttctccctctaaaatcctataacccttgagtgagtaaactttaaaaatccattgaaaaagtaggacgctttgaaagaatatactaatgtattgataagggagtccaaaattgacctctaaaatatttttgacatagcctgttatgctatcagtgttggtaagtttgttcagtatatttgtaggctacacacagtcctttcaaagaagtatttaacctttgagggaaatacttttgtaattgttcaaaatcaaaatgctttatttctgtgaacttggctgtgagataaatgttctgtccacttcataattttattcagcagtgcttaaaaaagagtatttttagttatctcatagtgtttatattcagtaagtgatccctcagtaacatggtcctagtaagactgttaacatttctctttaatattgatgtatttataaaacttacatgctacactttgatgctctgccaggcggtggaagtagtgaaaagagcacatcaggctttagagttacacaacccgattttgtatcccagctttgtttcctattagctttgtgatcttgagcttgtaattaactttcagattttagtttccttatcttttgaatgaagaaaatatgttagatgttattctttttttaaaagagaaaacttgagagagaactattaggcacactttgatttatccttttagttttagctgggcttctaatacctttctgaagcctttctgagctgtattccccacctcttccccttaactcccatcatgccatgtgcttaccagcatcatcattattgtgtcctatttttattttcagtctttcatctagatccattaaacgtagggatcttgactatctttgtaatgactaccatttgaatagaaattatagtatgtacttgttactcaaaattttgtttggtaaataaccattctaaattaatgatatattaactctggagcatagatcggagggggctaaataaatgtcttctttattctcattaattctcataatgcaatttaataattcatgatgtgacatcaagagttagaaattgagtaggtgagggctgggcacggtggctcatgcctgtaatcccagcactttgggaggctgaggcaagcggatcacgaggtcaggagatcgtgaccatcctggctaacacagtgaaaccccgtctctactaaaaaaatacaaaaaattagccaggtgtggtgccgggcgcctgtagtcccagctacttgggaggctgaggcaggagaatggcgtgaacctgggaggcagagctttcagtgagctgagatcgcgccactgcactccagcctgggcggcagagcgagactctgtctttaaaaaaaaaaaaaaaaatcaagttgtataagtgaggtggacaagtgaatccatagactatagtgtgtgaatgtagatagaggtcatcagaatagcagctacatcactacacttaagacgttgagctaagtgcttttcatgcgttcttttttttttatttttggatcataaagacagttttatactaggtggtattgtctgtcttaaatgacgagcaaagtaaaattgagatgaagttaagtaacttgccaaaggtcacattgctagcagatggcagagctagaatgcagactcggaaccattggattccaagcctttggttttaactaacacagcagacaccttttgctattaaactttctcatgtcttagaaccaatttgtgtaggataaattagagtcattggaggtggaaaagtaaaggtttaaaagagggtatgttatgaacttatttaagggaaagggttagatctaatttatctttgcatccccagagataatgcctggcacatagctgatgctatttaatgaagtgcacattgtcttcaagttctcttaggaatctacttacatgtgattaggttctcttttttattgttgttgttgagacagggacttgctctgtcacccaggatggagtgcagtggtgtgatcttggtgcagctgcaacctctgcctcccaggctcaagtgattcttccacctcagcctcctgaatagctgggtctactggtgtgtgccaccaaggccggctgaattttttttgcttttgccatgttgcccaggctggtcttgaacttctgggcttaagtgatcctcctgcttcccaaagtgctgggattacaggcttgagccaccacgccaggtcaatgattaggttccttagtatagtttaccactgtacatgtgccacctagtggatggagattatccgtagatagtggctacagatgaaatcgccttgcctgtccttatcccagggttgcagttgtccccacctttctgactttggtgcattttgtgaccaagtgtcattgcctgtattttaggtcaggttcaaagtaagggaaaagatatattagggattttatattcaagaaaaataccacactgaatttttaaaaatgcaatgtaattttttaaatgtctgctccaatttccacagtttggcttgcaggcagtttgagctaattggacctcatgaaaggcaaaaactctgcaaagtggtggagtcgccaaacctggactgttttattggttgaatggctagcttctttctttaggcaaagcataggatagtattcaagagtacatttttaataataaactggagataattaagtactggcatcaggcatatttcctcagatatcactgggtttgtagccatttcatccagagcatctctggatgacatctctggttggatccctggttgacatcatttttatccagagcagtctgtttcacattctgctgccaaactctgacaattgtttgaagactaggattaggagaagagagagagacataaacactcagttgtcctgccttgactttgacagatactaagatctaacatagtctaccaaatgaagagtgacagttaaagacagcttctgttattacctgaagtatcaaatatttagtgataccttttttgttgtttgttcctattttgtggcaggaattactgctatctaggaagcagtcatagagtcctctttatttgttaaagaacacaagactgaaacaacaaaatctaaaccaaaagtaaaaccaaaactatcgctccctactgtttctttagcagatccaagttagaatcatgggcagagccagtaataataatagctagaggagaaaagagaacaggatgaactctgaaagcctgtcttcttacctgctttatgggatcagatctggtgccgatcctatttcttaaaaaacaaaaaaaaaacaaaaaaaccctatagtctgaatctgtttttttctctttgaaatgcaggaaacataatttcaaaaggttgtatacctgcaaacctactggccaaccagtaacattaacgtttaacttttctatttccttctggctcttatttgagggagagatagacattgtcctgcttcttttcccttagctgtaagcaataaaactcccctaaaaataataaaagtgctatgtattttcttttttggggataaaaataaggaaaaagctgaaactgttatatacttcgctaggagaaggaaatttttgactggaggtcatatatggtagatagcagcatagtaaaaggaagcagacaagtcatactggattggagagagcacagcttgggagtggagacaaatggatctggctccaggaaaaaatgtgttttcagggtaatgtaatgatttgcgaccctgggccatttggctcattgttggtaagtttctgaaggcactattcttattcctccttaagtttgtcacttatttttctcttcccctttcttgttacccagtagtaagaatggtataaaatgggtatatcccaaaatgtattctgggactctctgagtagaaatgaaatgctttcatacaggtatttatatatgtgataattttatagtactttgaatataataggcaggcagagagagtctctctagcagaactgtattcttttctatctttggctgtaaaaatactagagagaggcaacacagaataccctttgggtcattccagatgctttgcctagagctacaggctctgtaggtacagtctacattccaaattgttgtaggtcatagctatattaaatattttaatatagcctaaaaagggtcagttgattttcagactccattatcagtgtttcacggcctgatcaagccacttgaagattttgttacggcaattcttcactctttaataccagttttctgtgttaattagggcatgggttaaactgctgtaacagagaccccaaaatatagcagtggcttaaataaaacaaattgatcttctctcatgtaatatttctgaggatggagaggtataggctgatgagttgtcttttgctccatattattgtttgttgacccaggtttcttctgtcttgtctctctgccatcacctggagcattgcgcctcattggcagcattgcgactgggttgctgtcatgtccattccagtctgtaggaaaggggactataatttagtgaagagcagctcacttccttttagatgatgaggttgcgcagttgcttctggtcatattctctcggtgagaacttgccatggtttgctgcaaagagggttggggaataaagtctctagctgagcagttatgtgtcctactaaaacttggaaagcatagaagatgaagagtatggattttgtcctttgtctactttctttctttctttttttgagacggagttttgctcttgttgcccaggcttgagtgcaatggcatgatctcggctcaccgcaacctccgcctcccaagttcaagcaattctcctgcctcagccttctgaatagctgggattacaggcacgcaccacctcgcccggctaattctgtatttttagtagagatggggtttctccatgttgaggctggtctcgaactcctgacctcaggtgatctgcctgccttggcctcccaaagtgctgggattacaggcgtgagccaccgcacccggcccctttgtctacgttctacaggtttatgtgccttgttcatctttggagttatttagctattcttgatctgaatacctttttttttggggggggattcaaattgtatttattttctctcatctgtgacacattcattttgttcatgaggtcatttgtcacatagaaatgtaaattttcattttattattccttttgaatacaagcttacgtatttgtagatttgattctagatactttatcaattttgtctcgggatagacaggacaccttgattgatagactgtataaacacttaatttaaggtcagcttttctatttcaattttttaaaaaagaaaagaaacatgttattttaagtatgaaaaccaaaaccatctgtttgatgcttcatgttatcattagttttatgatttgataggatttacaattatttgtagttttttctaactacccaagaatagttatacaaattgtttttcaaaatacttttctaaaattcattttgaatgtagaagatagttttctttttttaaagagggaagtcagattgaagtgctaatctgagcgataagagataaagttttgtgtgaaatttagtgttcaagctgctaagtatgtctagtgtatagttaaaatatggtgtggaactcaggagaggagttagtgctagagatgttgacttacaaatcataaagtccagaggaaattgttgaaatgtggataataagttcttcaaagaggagcttataggctgggagtagtgactcatgcctgtattcttggcactttgggaggccaaggcaggaggatgatttgaggccaggagtttgagactagcctgggcaacatagtgagacccccatctctacaaaaaaatgaaaaagaatgtggtgacatgtgcctgtggtcccagctgcttgggaggctgaggtgggaggattcttgagcccaagaatgcgaatgatcatactactgcactccagcatgggcgacagagtgagtccttttctcaaaaacaaaaacaaccacccaaccccaggagtatataaaggatgtatagagggctgtacctatatttagaggtctaaaggaaatcagctgaagagatagatattagactattatatctctgtgcttataaaagatagaagatcatttcactaaggaggaagtgatcctggtgtgaagtgaacttttaggatgtttgaagaaagcttgtgggtgctaactggattgttaattcttttgccgttggtctattggtggtgttgacgagaataatttgtgtgtgtgtgtgtgtgtgtgtgtgtgtgtgtgtgtgtgttttgagacgcagtttcattcctgttgcccaggctggagtgcaatggcatgatctcggctcactgcaacttccatctcccaggtttaagcaattctcctgcctcagcctcccgagtagctgggattacaggcatgtgccaccaagcccggctaattttatatttttagtagagacagggtttcaccatgttgttggtcaggctggtctcgaactctggacctcaggttatccgcccaccttggcctcccaaagtgctgggattacaggtgtgcatcaccatacccagctgagaataattgttataataggaggctggatacaattagaaaggtatagttgaaggggaaggtagtagagttcagtcatgccatctcatgaatttggtggtaaaaggaaagacagagaagaggcgcttgaaaggactttaagatgtttttgtttgtttggggttagtgatgcagaaaggtctaaataaatttcaaattagaaaagaaggagccagccaagagcatggaactgcatcatgagcactggtggggaggtgtaatgtcccttcattgtagtaatagagcatgacagacagagtggacatataatttttattaaacaagaagaatgatgttaggggtagtggtgtgtggaaatcctctcagctgttaggctgcctcctgagaaagaacatttaaggtgtttggggttggattcaaggagaatggaaaaaggcaataaagtgaaggtttgtccttttcaaatattaagcttttagaatgggtaataattaagatacatgatgagtcttttaatgatgattttataaagtgtgaagcaatttttaatgagtcactttgaaatacatttgttctgtagaccaattgctataatcctgaaataagatttttttttggccgggcacagtggctcatgcctgtaattccagcattttgggaggccgaggcaggtggatcacctgaggtcaggagttcaagaccggcctggccaacgtggtgaaacccagtctctactaaaaatacaaaaattagccaggcatggtggtgggcgcctgtcatcccagctattcaggaggctgaggcaggagaattgcttgaacccgggaggcagaggtggcagtgagtcgagatcgcgccattgcattccagcctgggtggacagagcgagactccatcaaaaaaaaaaaaaaaaaaaaaaaaatctttttgttgttgttgttgttgttgttgttgttgaggtaggatctagatgtgttgcttaggctggagtccagtggtgccatcacagctcactgtagcctccgctgccggggcttgattgattctcccacctcagccaccagagtcgctaggactacaggtgtgtgccactatgcttagctaattttttgtagagatggggtgttaccatgtttcccaggctgtcttgaactactgggctcaagcaatatgcctgcctcagcctcccaaggtgctgggattacatgtgtgagccactacacctggccaaaaataagattctttttttttttttgagacagggtctggctttgtcacctaggcctgagtacagtggcacgatcccagctcactgcagcctctggctcccaggttcaaggcatatccttccatctcagcctcctgagtagctgacattataagcactcaccaccttgcctggctaatttttacattttttgttgagatgaggtttcaccatcttgcccaggccagtctgaaactcctgagctcaagggatttgcttgccttggcctctcaaagtgcagggattacaggcatgagccaccatgcctggccaagattcttaacatttattactaggatgaaacttctctgagtcagctataatttgggcacaaggaaaagtataccatgcttcacattattttgataatcattttgcggtagagaataaagatgcacaataccactaattacgtgcatgaacttttcttgtgttagtgaaatattgttatttgttgtttctttttacattatgacctatgctttatagatacattcaccagtgattaaaataaacacaaaaatgactctttgttttctcttgtttactgttaagcagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcaggttagagaatgaatgcagctggattggatattagtgacaggaataaagcagtgaaatgactatagagaaaattcaaggagtatgagtttaggatgaaaatctgggtgggattttatgatttagtagctaaatttgaagctgatacctctgtgtttagttgggatgagttacatctgtgggcttaggcaattgtagagcagggcagcacactacggttttactctagtcacctcaggccagtacagaatattaccaatgtgctgttcctggcagaagacataaatgtgagcatttagcatgaggattaatttttgatacttacctgtaaacttaagttgatagttttgttccttaccttctccccattcattaaaaaaggaaacacaggacattataacctattttttttctttctttttctccccccccccaccacccctccccccctccctttttttgagatggcgtcttgctctgtcaccaagctggagtgcagtggtgccatctcagctcactgcaacctccaattccctggttcaagagagtcttctgcctcaggctcctgagtagctaggattataggcatgcaccaccatgcccagctaatttttgtgtttttagtagagacagggtttcaccatgttggccaggatggtctcgatctcctgatctcatgatccacctgcctcggcttcccaaagtgctgggattacaggcatgagccactacactgggcctgtaatatatcattgtataattcagctttgaagttttaagagtttttagaccttatttgaaagacatgaataaaataatgaaattatccatcagtttggtactcccatctccttccttccctccctccttacctgtctccctcccttctttccctccttccttcccgccctccttccctccctttctccctccttcccctccatcccttctccctccttcctcccttcgtttcccttctacttccttttcctcttcccttttcttcctttcctttctttttttttttattttttgaggcaaggtcttactctgttgcccagggtagagtgcagtagtgtgatcacagctcactgcaggctcaacctcccaggctcaggtgatcctcccaccttagcctcccaggtggctgggactacaggtgtgtgccaccatacttggctaatttttaagctttttttttggtagagactgggtctctttatgttatccaggttggtctggaactcctgggctaaagcaatcctcctgtctcagcctccctaagtggtggaagtgcaagcatgaaccactgcacctgacctctctcatcttcttgaaccattttctttcttttgcttttgggacatctcactcctcattttatcttttgctagttgctgtggagactctacatgtttataattttggagttcttaaggataagtcctcagatatcttgtctactttttgtctctgttcactccctgggaaagaaagctcattcattctaatggctgtaacctctgtgtgtgcccttaagagtctcacgtgttcatttccgttactcttctttacctgaactccagacttttatgtccaactgtctgcttgacgtctctatttggaagtgtattagacacctcacccttaacatgtccagtaccatgcttgattctgcctccacctctgccccaaatctgcttctccctacgatttcctcatttcaataaataatgccagtattcactcagttgtttagtccagaaactttgaaagttaatccttgatttctatcttttctcataccttgtagctcaactcgataacccaaacaacttgttagtgtcttaacttgcctaacattttagttgaagtcactgttatcctttggaagttgtagtagccttttaaccagtctttctgcttctctttacctttccatagtccaatttgtttatagcacagttgcaaaaattattctaataatgataatcaggtccccactctccactctctttcatgactattatatttaaattatattcataatttcaagtacttaccatgtctacaaggtgtgatctgttcctgactgcctctctcatgtcatttgtcactcactgtgctctcaccacattggcctcactcttttaaatgtgctgatggggtttctgtctgagagctttggtgcttgctctgcttgtctcctggcttacctcccagagaggctaccttgctgataatactagcctcctctgaagggccacatccagcttagtctcagtcagcttaggaaaaagaacatacaatgtgaatcaacgaaagaacacactggtgtttgttatactgtagtcctctcctcctcctccaatattttttgggaggtttgaacattttcaaaataaaggagtaggatggaaaagaaaacagcagctcccaccatattttacatagtaacctgctttatttttctttgtggcacttattattttccaacagttcatttgactgtcatgtgaactctgaagacacgcactttgttggtgggctttgttcaccacactgtgtcctgcacttaatagttcctgacggagattaggtgctgtataaatttttttttcttttttcttttttttttttttttttgaggcggagtctcgctctgttgcccaggctggaatgcagtggcgcgatcttggctcactgcaagctccacctcctgggttcacgccattcttctgcctcagcctcctgagtagctgggactacaggtgcccgccaccacgcccggctaattttttgtatttttagtagagacggggtttcaatgtgttagccaggatggccttgatctcctgacctcgtgatccacccgccttggcctcccaaagtgttgggagtacaggcgtgagtcaccgcgcccggcccaatatatttttaatgaataatgaattctagttgattgaaaagcatttaaagttctgcttaaatttttgtagtttgatactaccatgaactttactttttgctatgtgttatatagagattagaaatggtgtaatgcatatgtggtattgagaggtacagaatgcagaatatttgctagtttagagcaggtgcctgagagccttctgaaagtattctgtgcctctgtatcctctaggcctacttcgggaacccattgtagttcttaaccttcttgcttggttcttctgcagatcttaaggacacagtatgcctgactgacttatctttttgtcacctgtgagtagcacactgtcactgttagtcctcatctaatacttgtacagagaatgaaagttaaaagctactcatgaatatatgataatttcatttataataatcatggcctatcagtggaaaagaataggtcactcaataattggctatccatgtaaaaaatataggtagattgatgctcatgccacatggaaaaataaccttgaggtagattaataagcaatgccattgttatttatttatcctgggctatactaccactaccactgttattttcattagacaggacagagtgaatgtacactgagaaagccagcatactgtaaatacagacttggtgtttattccaagctccgactttttgacctttatttattcatttttatctctctgtcccacagtttccttaaaataggatgaacagattgaatttaatgaattttattttattttattttttttgagacagagtcttgctctgtcgcccaggctggagtgcagtggcacgatctcagctcactgcaggctccgcctcccgggttcgcgcgattctcctgcctcagcctcccaagtagctgggaccacaggcgcctgccaccacacccggctaatttttttgtatttttagtagagacagggtttcaccatgttagccaggatggtctcgatctcctgacctcgtgatctgcacatctcggcctcccaaagtgctgggattacaggcgtgagccaccgtccccggcctgaatttaatgaattttaatggtgcagtatataaaatgttctaaatgaatatgtataattaataggattttagcaagattactagataacaaaatcaaaatgcaaaaatcacatgtatttttatatattaggaacagagttaaatggtattttttagaatattttccaataatataaaataatatgtgactaggattatgtgcaaaaatgtaagacttttatagagaaaattataaaactttttggaaagattaaggatcacagacataatagcagtataatactcacattttaggggattcagtattttaaagatattctttcccaattgatgtgtaggttcaagaaaattctaataaaaatttctacagtaaattttacaagctgatcttaatttatatgaatatgcaaaagacaggataagccaaaggacccatgaagaagaggaaggattgctttacttgatactaagactttttgtaacacactaataaattaagtcagtgctgtattaccacagaaacagacaaatagaccaatggatcagaatagggaacccagatacagatacatgattaatatggacaggttatttataacaaaggggcatcacaaattagtgaggaaggaagtctctttcaacaattgtgctagaacaattagacatactttaaaaaaaaaaaaaaagaaagacctaatttattcatgtctactccagttaatttatagacttaacacgtgagaagcaaattaataaaagaagttaatgtagaggaatttcttcattgctttggggtaaggaaagacttttaaaaaacaaatggaaagccctaattatagaaaagggttgattggccaggcacagtggctcatgcctataatcctagcactttgggaggttgaggcaggaggattgcttgagcccaggagttcgagaccagcctgacttgaacatgacaaagccctgtctctacaaaaaatacaaaaattagtaggacttggtggtgctactcaggaggctgaggtgggaggatcgcttgagcccaggaggtcgaggctgtagtgagctgtgatcctgccactgcactccagcctgggtgacatagtgagaccctgtctcaaaaaaaaaaaacacacataaaaagaaaaggggccgggtgcggtggctcatgcctgtaatcccagccctttgggaggctaaggtgggtggatccctgaggtcaggagtttgggaccagcctggccaacatggtgaaaccccatctctactaaaaatacaaaaattagctgggcgtggtggtgggcacctgtagtcccagctacttgggaggctgaggcaaaattgcttgaacctgggaggtggacgttgcagtgagccaagatcgcaccattgcactccagcctgggcgacaagagagaaactgcatctcaaaaaaagaaaagaaaaggattgattaataccactatacttaaatttacaacttttcatgaaaaataccaagagtaaaaagataaatgacagaaaagggaaaaatatttctaaagcatataactaacaaagaacttatgttcatatgtatttaaaaatgaagcaaaacaatgcaataagaagaagcttctgtagaaggcagtaagcattacttgattacttgcaataaacattactcgattactttcaataaacattacttgattatgacattttttaaacatgctgttgggttttagttagctaatattttgtttatgttcataagcaatatgaatttttgtaatattgtaatgtcctagttttggagacaaaattacactagcctcgtgtgtgaggcatctttcagttttcttattttctggaacagctagtttaagacaggaattgactccatgtaggtctgaagtaactgtcataaaattacatgggtctgtggggtttcttctagaaaatgaagtcattaccagttcaattcaaagattttttttcttggaatatgtattccataaatttgctccccacttccaaatttttttctattcagctgtctgtttcatcttgtaccaattttctcatgttatatttttctcagaacatatacattttatctaaaatgattcatgatacatttattatttttgaatgttatttttgattggcaaatcctaattgtacatttatgagtacagtgtgatgtttcaattcatgaatgcaaagtggaatgattgaatcaagtaaattaacatccattaccttgattaactctcatttgttacttgaaatttactcttaagttggtgcaaaagtgattgcggtttttgccattacttttaatggcagaaccacaatcacttttgcaccaaactaatagttattttaaaatataggtcaccctgctatgcactgtatctcaaaacctattcctcctgtctcaaccttcgtatcctttgcaccaaattgttattttaaaatataggtcaccctactatgtagtatatctcaaaacctattcctcctatctcaatcttcatatcctttgaccaacaacttactatttccttcttcctgccttaccttctccgagtgtctggttaccatcactctactactggttcttttagttcaacttttttagattctacatataagtgagatcatgccgtatttgtctttctgtgcctggattatttcacttagcatgatatcctctagattcatctgagttgttgcagatgacaggtccctcccgcttctctctctctctctctccccactcttccttaatccccttcccctcccctccctgcctcccttcccttcccctccccctctttttctacctccccttccctccctcttttttccttccttctctcccttcgtccctccctccttcccttccttccttccttctttcctttttttctttccttcctttctttctctttctctctctttttttttttctttgaaagggtgtcactctgttgcccaggctggagtacagtgccatgctcacaactcactgcagtctcaacttcctgggctcaggcaatcctcccaccacagcctccaagtggctgggactacagttgtgtgctcaccacaccaggctaatttttaaaattttatgtagagatggagtcttactgtgttgcccaggctggttttgaatatctgggctcaagcagtcctccagccttggcctcccgaagtgctgggattataggcatgagccaccactccccatcctcccgcttttcaaggctgaatagtattccattgtttatatataccatgttttctttatccattcatctattgatggatacttaggttgattccatatctggctattgtaagtaatgctgtagtaagcatgggcatgcagatatccttttgacattgatttcagttcctttggatatatacccagaagtgtgattactagattatatggtaattctatttttagttttttgaggaacctctttaccattttccataatggctatactaattgacacccccacagcaatgtacaggactcccattttttctgtatccttggcaatacttatctttcatctttttaatagtagccatttgttaggtgttagccaatagccaggtgttacgtgatatatacttgttttaattttcatttccctaatgagtagtgatgctgaacattttctcatgtacctgttggccatttgtatgtgttcttttgagaaatgtctgttcaggtcctttgcccattttttaatcaggttgttttcttgctgtttatttgggttccatatatattttggatattaaatattttctcccattctgtgggttgtctctttactttgttaatattttcatttgccgtaaggagcttggtggtttagccatcccatttgtctattactgcttttgttgcctatgctttcagggtcatatccaaaaagttattgcccacatggaactttctccctatgttttattctagtagttttatagtttgacatccgaaacataagactttcatctattttgaattgattttttgtgttatgtgagacaagggtatgattttattcttgtgcatatggatatacagttttttcagtgccatttattgaggagacagttctttacccattgtgttttcttggcatctttgttataaatcaacttagtgtaaatgcgtgagttcattcctgttccattggtcgatgtgtcttcttgttttttgagccagggtggtatttgtagcccaggctggagtgcggtggtgtgatcttggctttctgcaacctctgtcttctgagctggagccgtccacccacctcagcctcttgagtacctgggactacaggtgttcactaccacccctggcttattttcgtatttttagtagagacggggtttcaccatgttgcccaggctggtttcagactctgggctcaagcagtctgcctgcctcagcctacccaagtgctggcattacaagtgtgaaccaccatgcctgtccagatgtatggtttttttttttttggtgccagtaccatactattttgattacaatcattttgtaatgttttgaaatcagacagggtgatgcatccagcattgttctttttgctcaaggttgtttcggctgtttgatgtcttctgtgcttccatataaatttaaggataatttatttctgtgaaaattgacattggaatttcgatagatattgcattgaatctgtagatcactttgggtagtatggacagttagtttcacagtattaattcttccagtccatgaacataggatatcttcccatttcttgatgttttcttaaatttcttttgtgagttttatggttttcagtatacaggtcttttacctccctggttgaaattacacctaagtatttaatttttttgttgctattgtaaatgggattattacattaattttcttttaggatcgtttgctgttagtatatagaaatgctactgatttttgtatatttactttgtatcctgctactttatcaaatttgtttattagttctaacagttttttggtggagtctttagggttttccatatataagatcatgccatcagcaaataaagacagtttcacttcttcctttcctactgggatcccttatgtctttctcttgaccatattgctctgcctaggacttccagtaatatattgaaatttttatattcagtattttatattttatatcaattttatattcagtattttcattatgattttatttcacatattgggatttccattttaagtgaaagattcttaaacaatatcttttctagtttccaaatttatttatttatttatttatttattttcttgaaagggagtcttgctctgttgcccaggctatgcaatggtgcgatcttggctcactggaaccaccacctcctaggttcaagcgattctcctgcctcagcctcctgagtagctgggactacaggcgtgtgccaccatacccagctaacttttgtatttttagtagagacggggtttcgccatgttggtcaggctggtctcaaactgctgacctcaggtgatccacctgcctcagcctcctaaagtgttggaattataggcatgagccactgcacctggccagaagattttaagttatccatttattatacatttttagttttactgcattattgtcagagaatgttgcctgcatgatgttggtcacttgctatgtatcatgtattcttttatggcctactatgtaatccactcttgaaatattttaatatacttgaaaagaatgtgaaccgttagttgtagatagagctgaatatagtatctcaaactaatttattatgctcaggtaattaataaataatgaacaataaagatgttcaatacttaatttttattggtttgacatagtattttctgagaaaaataattaaaatcttccactgttgttgatttaatttttttagtcttccagttttgttctgagaaactcaggttgagtttctcctatccaaaatgcttgggacaggccaggtgtggtggttcatgcctgtaattccatcactttaggtggccaaggcaggtggatcacctgaggccaggagtttgagaccagcctggccaccatggcaaaactccgtctctactaaaaatacaaaaattagctagatgttgtggcgtgtgcctgtagtcccagctactcgggaggctgaggcaggagaattgcttgaacccaggaggtggaggttacagtgagccaagaccgtaccattgcactccagcctggacaacggagtgagactccatctcaaaaaaaacaaaaacaaaatgtttgggaccagatgtgttttggattttggattttttttggattttggaatatttgcacatacataataagatattttggggatgggagacatgtataaacatgaaatttgtagggtccagccccacaggttcggtgggttttctccccgtgtgcggagacgagagtatagaaataaagacacaagacagagataaaagaaaagacagctgggcccgggggaccactaccaccaagacgcggagaccggtagtggccctgaatgccaggctgcgcagatatgtattggatacaagacaaaggggcagggtaaggagtgtgagccatctccagtgataggtaaggtcacgtgggtcacatgtccagtggacagggagcccttccctgcctggcagctgaggcagagagagggaaagggagagggagagggagagcttatgccattatttctgcttatcagagacttttagtactttcactaattttctactgctatctaaaaggcagagccagctgtacaggatgaaacatgaaggcggactaggagcgtgaccactgcagcacggcatcacaggcagacggttaggcctctggataactgcgggcgggcctgactgatgtcaggccctccacaagaggtggaggagtagagtcttctctaaactctaaaagagtttagagactccctttcccggtctgctaagtagtgggtgtttttccttgacactgacgctaccgctagaccacggtccacttggcaacaggtgtcttcccagacgctgggaccaaggactcctctggtggccctgtctgggcataacagaaggctcgcactcttgtcttctggtcacttctcactatgtcccctcagctcctattgctgtatggcctggtttttcctaggttatgattgtagagtgaggattattataatattggaataaagagtaattgctacaaactaatgattaatgatattcatgtataatcatatctatgatctatataactattcttattttatatattttgttatactggaacagctcgtgcccttggtctcttgcctcggcacctgggtggcttgctgcccacagaaattcatttatgtttcgtatataccttatacacatagcctgaaggtaattttatagaatatttaagtaattttatgcttgaaacaaagtttatattaagtacttaggtgtgaaattttctacttgtgatatcatgttggtgcttaaaaagttttgaatttcggagcatttcagattttggattttcagattggagatgcttaaccatctctttcagattcgagattcattttgagaccagattcatgttggtctgagtatatggttatgatcgatatctattatactattcatcattttgttagtgtgtaacatctttttcatctctaatgtcatgttttctttttgacataactttcattttgtctgataaaattattgccactcaaacttccttttggtttatgtttgcctggtatctttttacctcttttcccatcaacatttttgtccttgttttatatgtcatttgtgtttatacttccaacattttttgcacctattttttttttttttttttttttgagatggagtcttgctctgttgcccaggttggagggcagtggtgcgatctcggctcactgcaacctctacctccctggttcaaacaattcccctgcctcagcctcccgagtagctgggattacaggcgcacaccatcaatgcctggctaatttttttgtatttttagtagagatggggagggggtgggtgggtggtgtgtgcttcaccatgttggccagagtgatttcgaactgacctcaggtgatctgcccaactaggcctcccaaagtgctgggattacaggtgtgtgccaccacacccagctgcacccaattgttagatctaattttaatctaatctcaaaaatggtcttttaattggtgatttttgccttttaattggtggttttggtttacattattgtaatggctagtaagatttcgtatgctattttagaaaatgttttttagtcactgtatatatgttttttctttcttttatttgtttttgaggtggagtcttgctctgtcgcctaggctggagtgcagtggcacgatctcagttcattgcaacctccgcctcctgggtttaagtgattctcctgcctcagcctcccgagtagcttggattacgggcgcctgccaccatgcctggctaatttttgtatttttagtagagacggggtttcaccatgttggctgggctggtctcgaactccagacctgtgatctgcccgtctcggcctcccaaagtgctgggattacaggtgtgagccaccatgcccatcctctttttctttttaaaatacaggcagggtctcactatgttgcccaggctggtctcaaaatcctggggttaagcaatcctcctgccttgacctcccaaagcactggggttgcagtgtgagccactgttcctggctgagttgctgtagtgcgtgacatctaatgaggtacatgaagaggagcctttgtgtgggttagaattcccctgtctttggtcacaggtgttaacatagtctcactgtgtttcacacttggcttctagcaatttcttaaaaatttttactgagttcttatcaccctgctggtatgatatcagtggcctcttcctcagaggtgctattgtcacatttctttatggaagtgtctttcatttggtggtgagttggttgccttgtgatttctgccctctgatgggtttcagaaaagtgaatttgcagattctctggttgggttatgttgtgtggttgggcacaatgttgtttgcagctttctacagccagaccaaaagctagaaatttcccttgacctcgtattaaaaaaaagtcaacaataaattactctgaggtgtttgacctcccttacttcatacaaccttttctaattctttaataatttaagtacttctctaaaagtattttcatttttgatctgttgtctggcaaaatttctgaggtcttctaagccagagagtaattttattataccttcacatttaagcgatagttttgaatataaaattgaatgctaaggtatttttctgcaatagctttaaaatattgctccattttctaatcagtgctgttacaatcaatgttgataagactaatgtcaatctgattgttgcttctcatgggtagtgtttctaggggaagaaacaaaccagaaatgggatatggtgaaataaatgtaagcttaatagctcagagaacattacaaataaggggatagtaagatactggcaaagcataaggtggtggtctctttttggaaagaagaaattttctttttcaacttgacttgatttttttttttgaaattacactacatttaatttgtgtatgtctcggtaccagcagacaacatagtttctcatgaacttgaaataggtaatttattacaaaaacaaagctaattttgataaaagtaattagttgagagtccaatatgatttaaacctaagttttaaaaagtcacctcaaaaggctataggttagttctatcacctggtaatgcaagatatgtaagatcatggggtaaatactgtagaggtaactttaatgcccaagaaggaggatttgggtatagcagcagtaaatatcttgtgaagtgtaaatataatcaagaggaagcagtccttttaatttcattctttctaagatctcttagtaagtgtatattctatatatgtatattgattgttgtctcttaattttttaatgttttctccttttttattaatagacttagagcatttttaggtttacacaaaaattgagctcattctcccacctctacccccagcagtttccctcatgattagtattgtgtgctgtgttacagttggtaaaccaatatggatacattatttttaactacagtccatagtttacattagggctcagtatctaccattatagtatcatataaaatggtttcactggcctaaaaaatcccctttgctcctaatcatccctttccttcttccagttcagctcttctgcttccctaaaaatctactaccactcaacccaggaactatttaagtttatatttttatatctccccgtgtgtatgcatgtgtgtggtatatatatatcatgcataatgaacgttctatcaagtggttaaataaaactgtcaccatatgttttacagaactgtcatacagttgggtggctactaaactctaccttctttcccatttttaacttgcattttttttgtttcctgagacagagtcttgctctgtcacccaggctggagtgcagtggttcaatctcagcttactacaacctctacctcccggatacaagcgaggtgcctcagccacccgagtagctgggattacaggggtgtgccaccacacccagctaatttttgtatttttagtagagatggggtttcaccacgttggacaggctggtctcgaacttccacctcccagagtactgggattacaggcatgagccaccgtgcttggcccccacctttagctttcttacttggatttttttctagtcaaatataaaagaaaataacttttctaactgctaactagaattttttggatttgatatgtgtactactttttaaaatgctatggaaaagtagaattccaaatgtataattattaaacttaattgttcttatgggtaatcactgaatagactgtagaaaatagattgaaaagcttagcttgtgctttagacataatttaaaagcacaagtatctatagttatcgcttaaagcagttgaataaagctacttttctccttctctgacttacatttcatttttactagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaagtaagcagtttcgactttaaatgttggaatagattaagactgcatataatttatttccattataatgtttataaattttcaaatgggattgttcttgttgaacagtttctcctgttctccacatttatgggatactctgactcaccattaacccaattaatccaacaaactatccttttcacaaatttttcttgttattttttaaaaagtttatattaattgtatatgaaagcggtgtgatcacaaaactaaacttttggaagaaaacttcaaagaacataacacaagctgagagggagggagttcatggaatttataaatggaaataatgtaataataaaacagatcaataaagtccttcttttgtttctctaaataagcttttaattttaagaatataacataatacaatagcaaatccagaattggttttcactactcatgtcttttgtgtcattcattcatcaatccattcagtcatttatttaatttatatataagtttgtgtgcttcagaaaatgttgcactgtcctatacattcttccctccctccctcccctgccttccctcccagaagatgcttttttcttttttaaggaattttttttttgtaatgatgtgtgtatgtctgtattcacgggcacattgtaattacctaaaggtcttgtctgatatagtttaaaatattttgtacagttgtgtttaaagaccatattaatatggagacttggctgtgctggttaagggagtagaagtttctgtagttgatgagaatgtgtaaaaattaatttagcttgcaaagctaacactgcctcttgagggttatgatgtaatcactcaagtgcttatctggcttatatccaaatttaagtactaaatcattgttgtgttgtacttatttgattggctcattgttttgaactgctgccaatgccttgaagacctgaagtaggaaatgaaacaataaaaagagggagaatcttttaaaagaatttaaggtggaacagtttaaggaaacttagaagtactatatttggagagttgtgatgttttggaggctatagctttttctttagttgtcagttgagtacacacatcttaataaaataatcaaaaggccagcaaacttaaaatgtctattagcaaatttaatggagtgaatcaggctgtatcttatatcctcatgttctgccttaaataatggcaattatataaaatcctctcctgagaaatggaattggtttcatttccttgttttaaaagtgaaattaatttttagtgaaaattcttatgagctcagataattatataaaaatagcctttgttaaacgaaagtctttatatatacttagtgcttaccaacttaataagtaatgataatatggcagttaatgaagtacacttaaaaatttggcatcattgaagggtaggcaattaatttagcttggtaatgatttcaaatatttacaaaatgtatgttgctaatgaagtttaaatagctagttaatttaaaaaacaattttacaaaggttttgaaaatgtctttgctcattttcactaaataaaaaaatcaagaatttttttcctttttttgttttataactaagaattttgtgggtatgcatttcagctgattcctcttgatatctctttctaagctgggctgctgtcatccttagtgttgacattgatatcttactgatatggtatatacatacaaaccagtctcaaaacttgaaggttgaatttgattaagctgctggttaggacctgattagtaataaattagtcattctcttggtttttttacacccctttccctcatcaaatactagtgcaaaacagtatgctaaaacaacatttagtagttatagatgaactgttggtcttttttttttctcccaataaaataacaatgatttgtaatggagcatatatttgtaggaatagagattatacttataggaaagaatttgttctcattttactgtgggcatttattaaaatgagaatttaaagttagcatagcatgctataccttttaaaaaaagtctatgcatttctaatgctgaacataaaaacattactggttatttttatatggtttgatatttaaatgtacttattgaaatatgttaatactttttttctttcaatgattccaggtataaaaatgtttagtaccctggtcattgtgctgattttctcttaataggaatcatgataaatatccagcatacagaagtgcagtgagttatgatctatattcaatagtgatttaatccagaattatgatcaggttaaatactatgatattaggagaagatttaagttttagtggtagtcatctgatttcccatatttaataattaagtacaatagccatttttatttatttaatggtcttaaataatacctaaagtgttagaccttgaaagcctgaaatctcccatatgttgtttactttattcaatgttctttttttagactatagtttttgctgttatactatcttccttattctacatgcctttggtagctattttgcttttgctttttacttccaatttgtgacatacagtcttgattgagagtacttgcaacgtcatgccacagaccagctgttgagatttgttgacgggaccataagaaagctacagctgatacattccattcctcctgcctctgttttcacactctgtagtgggttttcattttccctggaaaatatcctttctttacacagttaactgccacctctgttgtggcagtcctcagtcaagatacagcagactaaacatttctgatttgatcaagttttgttttgtaagcgtttaagtaaagccaaaggaaatactcagtttatgtgttaaatacaattcctgactaggatatgagagttggttttaaaaacattatattatggaatggaaaaacaaatttacaatttaatacttccctgtgggtttggagactctttttcttacttgttacttatacgatataatatggcaacccagtttaatattataccatggataatactaacagatgaattctaaaagttgttttatgacagttaatggctgataaattaaaattgatttggcagtacattgcatttaaacagttaaaaatgaaacaattttctgcttgttttcactttcacagttattttattttattttcagagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggtatgggcatgttttcaataatgactgcctcttaattctggaagcattttaattttaatacattattaatgtcctcaataataaatacctttcatctagaaataattataatcatactataaaaaaatcattattaaatatgcctggttaggtaaaagaaaaggtttatctatttaaaatctgtacagtaccaccaccggactggatgctttttaaaatacttgtattttttcttgtgtagatagcggtgccatggagatctgacaattgagaaaagagaaaattttaaaggggaaaattttaaagtgagaacttggggaatgtggcattctgagtctattttatttgggcatgaatgaaaataggtcttagccgggtagattatcttattataacagtattgtaactcagcactcatgatatggtgctactggaatttaaagtacatctcattctgtagttgaactgcagattgactgatagtggttcaagtgttatgtgatggataatttaaaggctgaagtgttaataatcattgatacgtgctctcactgtgggatgagggaagtagaggtgtatgtgtagtttattttctatacatttcctttgtatatcacctcaacaaagtactaagtaatactttgtttgctttatataaagataccagaaacatatcaaatacatatataatatttaaataaaatgactaaaaactaattttgtttgttgaagaaataatcactaattcagttattcttaaacttgtgtgtgcatcataataaccagacggcttgttaaatcacagattgctggcagggcacggtggctcacagcccgtaatcccagcactttggcaggctgaggtaggtggatcgcttgaactcaggagttcaagaccagactgggcaacatggtgaaaccctgtctctacaaaaaatgaaaaaaattcccggagtgtggtggcatgtgcctgtagtcccagctatttggcaaggctgagacaggaggattgcttgaaccctggaggttgaggctgcagtgagctgtgttcatgccactgaacttcagcctgggcaacaaaaaaagtgagaccctgtctcaaaaccaaaacaaaacaacaacaacaaaaaaaaacagaaccaaacacagattgctgggccccactgcacgagtttttgattcagtagatctcacttgtgatctgcgcttctgcatttttttggtttttattttgagacggagtcttgctctgttgcataggctggagtgcagtggtgcgatctcagctcactgcaacctctgtcccctgggttcaagcgattctcatgcctcagcctcctgagtagctggaattacaggcgtgcaccaccacgcccagctaatttgtagagacagggttttgccatgttagccaggctggtctcaagttcccagcctcaaaagatccaccagcgttggcctcccaaagtgctgagattacaggagtgagccactgcacccagacagattctgtatttctaagaatttctcagtttgatattgatactggcactcagtggttggtccacatttttagaagggccactttactgctatcacaaatacaggatgccattgtatatttacatattagagttgattttgaagttttatgtctttatttattagctttaatttttttaatgtttgctcatttgctccttttcatttttcccattttaggcacttgttgggctcatcaccgttgtgtggagtggtcactaggagtatgccagatggaagaaccattgttagtgaacgtggacaaagctgttgtctcagggagcacagaagtaagtagacaaagcaaatatttaaatcatagttttataacattcactttaatcagaagttcacttgaaaggattattaaatgattgctgtagtgtaaaagctctcaaaataggaaattattaatttttattaagagaaattctaggccaggtatggtggctcacacctgtaatcccagcactttgggaggccgaggtgggtggatcacttgatgtcaggagtttgagactagcctggccaacatggtaaaaccccttctctaccaaaaatacaaaaattagctgggcatggtggcagtcgcctgtaatcccagctacttgggacactgaggcaggagaatttgcttgaatctgggaggtggaggttgcccgtagccaagattgcgccattgcactccaacctgggtgacagagagagactccgtttaattaaaaaaaaaaaaaaaaaaaaaaaaaaagttattttatgcaaaaattagccgggcatgctggtgcacatgtgtagacccagcaacttggggtgctgaggtgggaagattgcttgagtccagtagattgaggttgcagtgagccatgattgcaccactgcactccatactccagcctgggcgttggagtgagaccctgcctcaaaaaaaaaaaaaaaaaaaaattaatttgtgtaagccattggaatgtagtatgttactcagtgaacttgaatcttttaaaataagtagtttacatttaaattagaaattaaaattttagaaatgaaaattttgcactatgcttatacattcatgtggtaactttttaagacaaaactatttgataatgatttaaaatgaaagaaaatatttgaaaagatttgaaggtcattagtccataatgtggactacctctgtttgatattttaaaaagtgattaaaaaaatttttttagttcggtcagcagttcagttcatctttattgcattgtatcaaagtaatatgtgcatagtctgccatttttcagagcttttcctgtgattttcatgtaattttgaaacaaatgcaaatgaaacggcttcctcccatctataaagacagcaaactctgtgaagtgatactgctttgctgtctacaaattgcttttctttttcttttttcttaaaatgtagagatggggtctcaccatgttgcccaggctggtctcaaactcctggacccaagggatcctctcttctcttcttggcctctcaaagtgctgggagtttagttgtgagctactgtgcctggccttcctttttttttttttttttttttttttttgagaggagttttgctgtgttgtgcaggctggagtgtggtggcatgatctcagctcactgcaacctctgcttcctgggttcaagtgattctgccgcctcagcctcctgagtagattggattataggctcgtgccaccacaccggctaatttttgtatatttagtagagatgtggtttcactacgttggccagcctgatcttgaactcctgacctcaggtgatctgcctgccttggcctcctgacgtgctgggattacaggtgtaagccactgtgcctggcccctttggtttttaacaagtatatttgggagaagtgagacagcccttccaatggaatattaaaactggaaattttgaccttagaaactatatgggctttaatagatagaacataggcaaagctttcaaaagtatagttgagacaaggacttagattcaagtaaaaattcaatcattagaacattagctttacttggattatcaaaatgaactgatttacatagatgagtaagcatcacctcaagagtagtgaagtcagagtgcttgttttggaaattttacattaaagtgtatatgtcatcaaattttgaacagtttaatgcataatagtattttccccagcctgaacattcttagagactggattaagacaatgatatttcagtgaaaaccatctgttttatgaattacttcataaaagtaatttttattttgggctattttgtgacagtgaaaagtattacagggaaggtaacaaaggctaaatgagctttttggtggtggattagaaccagaggaatcaatataaactcgtagtgtttgatacttagtacagaaatgtaggtgtatgtatttgcatgagtttgtatgtgtccatgtatttcctacctctgtttgctaggaaggtagttaaaagaaaacttgcctcactctgtcccttttggacagaagttaccatttttgttcttactgattaataattaaatggtatttagagatgaagactgtgtcctaccactggcagaggaatcacaagcccttaggagacattgcatcccttccgactttgtttaggcattagaatttggtgggcctaagcaagttaaatgcagattgagtacttggagttggtagaccatgtggggattagaagggatctagtggtaactctgtcaaatctttacctctccactagattgaatcactcaaaactcacaggagtgtcagttttgtgtcgccatttgtacggttgtttgttttgtccttcttccttctcccctcccttcctccctccttccctccctctctccctctctccttccctccctccctccctccctctttccttcctcttctgtccttcgtcttccttccttccttccttccttccttcctttctttcttccttccttccttcctaccgtccttccttccttccttccttccttccttccttccttccttccttccttccttcctccctcttctttccttccttcctcttctttcctcccttatttccagggtctcaccctgttgtccaggctggagagcagtggcatgatcacggctcattggcacccttggcttcccaggctcaaacagttctcccccgagcctcccgaatatccgggaccacaggcatgcgccacctcgcctaactagtttttaaattttttgtagaggctaggttctgctgtgttgtccaggctagtctctatctcctgagcttaagcgatactcccacctcatcctcccgaagtactgggattataggcatgtgccaccacgcctggcttttgttcattattcttcattatcaaataggcacaagatggaccagttagctagaactttgtctcaagaaaggaagacttgtctcactggcaaaaattcaaacataaaacaacacatttgttgacagggctgtggggaaacaggtactctcattctttgctgctgcagatgcaaattggtacacatcttttggagggaaatttggtgatacctaacaaactgtatgcatttacctctcaattattctaggaatctatgctgaatatgcctctaacaatacaaattatgtattacttaatgttattaattatagtattatttaatttgcgaaatattggaaacaaactaaatgcccacacagaggagaaggtttgaataaactgtgttacatccatatagccatataatggagtaccatgcagataaatcagaaactagagattggttacctgtagggagtgggagggagaagaagggagtggagatctgtgtagcatggatgaaatgtgagtggcacttctcagagtatatttgtcagtataactctgattcttagaaccataggaatgttttaaatgcttctatgcaattgccaccaaccaggatgtgggagaccaaataagcaattaccacctacccagatgcaggagaacccaaaaaggaatagtaaaattcacataaaagaggatagggagggaaagaactcacctaagtaactgtagaaaatagtgtcttgattaaataacataaaactagaggcaaaaagaactgtacagtcatgctgtagtgttgagatcagaagtatgaaaataaactcatgttttttaatatttacacagacatacagaaatatagatgtgtgcatatgtatgagttaatttgaatatgtgtatttcctacctctatcccctgagagggcatagaaacaatgacaccccagtagcattgagaatacctagtgcttagatcttggtctccaaccattgctcttcaatgaaaggaaccagggctccttgagaagtagttccttacgggactggtgcagagaaaatacaaggtaagcctagatcatcttgtggtgccagaaagtaatgaagtgcttaaaaagatgaaaacctgttcaaagcacgggaacctacctgaaggagctcctaagaactggaccaattttagcaaccacaaaaataatgataatattgcattttcatccatagaataagtacacgagtccatactgatgtaaatagattgtccagtcatgtcactgctctacttaacactcttcagtgacttcccattttattctgagaaaaaaaaaaaaaagattccttgctaacctgtaaggctctacatgatcttcaccacacctcacgtatacttctcagacatctttcactataaccgtttgttcatttacttccttcagccatgctgacctcattggtcttactcaagtacgcagacgcagatccacctcagggcctttcataatgcatgtgttgccccctcatatcctttatgtatttattcaagcgtgactttacagtgaggcctttgctaggcttgctgtcaaagatttcaaatgccttcccataatatctgcttttttgttttctttttcgtacttatcacctctgacagagtgtatattcacgtaataatcttacttattgttcatctccctctcactagtatactagtgccattcggatggggtttttttctgttttggttattcctcagtgaatatttgtagactaattaatagcactgaagatcattcatggaatcattcataggcagcaaataagttctaagtacccaaaagtgttactggaggttatcaatatggctaattacatgaaagtttatatacttaatctctaaatagagcaaatctttacagttctacagaaatgattgggaaggaggagccaaggaaaatttctgctatcacaaaagtttccctaggggcgatatagctattgaacttagaagacgtttttattttgccaaaaggtcgattttgctgaccttggctaggtgcagtgcctcccacctgtaattctagcatgttgggaggccaagatgggaggatttcttgagcccaggagtttgagaccagcctgagcaacatagtgagatctcgtctctattaaaataaaaaatgaaaaatgaaatttgctgacctttattatgtagctgagtatattctgatacctagctctattttcaaagaaaacaaacacttaacctgccccttcaagataaagatgacatttcaacattgagaatgcagtgacttttcaaagaaacatgtcctggggcgttgaacattttgaaaacagatgttttgaactatttatattgatattttattgtcagaaataatgaaggttgtaaaaacaaaacaaaaaactctcatgtttgtcaccttaaaagaaacttgaacatggaattttctgatatgtttaaaatattctaaagagctctggtttaagcccatttattaaacattcaatatttttattagagagggtgaaattttatttgcttaaattttgataatttcggttgagatttaaaaatggttgcagaaatcatgtactacttctaattagatcattttacttttggggagaacctgtttttttaaacctatgagagccatagaaactaggtattaaaataaaccaaagttagaattaggctttttaatctaagaaaatggaagggaatgagatactataaagctcaggtgaggggttgcagtattttgtaaattttttgattgtgcacatcttttaataagaaatgtttgagtatgcagctttattatacattctcagtggaatatgtatgtcttctctctctttttttttgtttttggagacatagtctctctctgtctcctaggctgagattgcagtggcgcaatctcagtttactgcaccttctgcttcctgggcccaagtcatcctcccacctcagtctcccaggtagctgagatcataggcgtggaccaccacgcctggctaatttttgtatttttagtagagacagggtttcgccatgttggccaggctggtcttgaactcctggcctcaggtgatccgcctgccttggcctccccaagtgctaagattacaggcatgagccaccatgcacagccatgcatatctcctttatgtaacttaacatctgcagcgtttgtttgtgtgagttttttattctgtctgcatttgtgtatgtgagtctttttctatggatttttcccaccatggctgtaagcaccatgagagtgaggaaaatagctgttttgctttatcatattttctctggtgcctaacaaagtatctggaacacaagagagtcactaatgggataaatacatgcattaatgggatttgtcaatgaagggcaaaatttagtgcattagcttgaatgaggaggtaggtcctactggctggcctcttgggtagaggccaggactgccgctaaacattctgcaatatgcaggacagcctcccacaccaaaactatacagcttaaaatgccgatagtgctgaggttgagaaatcctggtttgacatattattcctgtgttaaaattaatatatttaaagtaatttcctcggttgttaacatggcatttttgtcaagcaattttgttttctctgaaacatacctcagattgtttttagtttttccaggggaaactttattcattttttactagagaaaagaacatggcaaacagtgaatctgtgtttcaggaagggtaacgtcgtttttcttttaatttcccttttgaagctctcagggtgctaccaacatcttggaaatctggataatttgagtattactgagggaatattttcattctacatgctacaaatgtttaatcattttatttatctaaagttcctttcttggccaggcgcggcgtctcatgcctgtaatcccagcactttgggaggctgaggcgggtggatcacctgaggtcaggagttcgagaccagcctaaccaacatggcaaaaccctgtctctactaaaaaaatataaaaattaaccgtgtgtggtggtgtgtgcctgtaatctcagctacttgggaggctgaggcaggagaatttcttgaacccaggaggtggaggttgtagtgagctgagttttcgccactgcactccatcctgggcaacagagcaggacttcttctcaaaatgaatgaatgaatgaaagaaggaaagggaaaggaagctcctttctcttctattcccagtattgccccccaaaaagaagtaatccataaacccccaatgtatatttctgttttcttaactatttctgaataaaatgttcagtgttggctgggcatggtggctcacgcctgtaatcctagcactttgggaggctgaggctgaggtcaggagtttgaaaccagcctggccaatgtgatgaaaccccctctctactaaaaatacaaaaattagcttggcatggtgacgtgtgcctgtaatcccagctactcgagaggctgaggcaggagaatcacttgaatcctggaggcagagattgcagtgagccaagatcgttctattgcactcctgcctaaaactccatctcaaaaaaaaccaggtgttttactcttaaaataagacattaaaaaaatacttctgttgtctcccctcatagaattggtaatctcttccttctccaccctcatcccctgctgtaattctatattgaaatttcattgtattttgtgccagatgtctttgtgtaaaaccaacttagttctgtgagaagagttgtacgtttttaatatttttgttctttttgtagactgcagaaacaaaaatagccttcctatagtaaggtggcaattcacattaagaatgtagataggcaaatttaaacttctaaatgtaatttgtctaaaaaagttgaaaaacagtgtatagtaaaagtctctcctccaaccaatggaaagtacttttatgtaagatcctttaagttactgacttgaatctttacgtaaggtaatttgctagtatctattttataaataatgttatttaatactgttttattttctatagaatcctagtgtttttccatgtaaatttttagaaattcttaaagtatgtatccctcattttcccctatagttgtttgcttctacttctgtttttaagagatagcatctcagttgtttaagctggaatgcagtggcacgatcatggcttactgcaaccttgacttcttaggctcaagcagtcctcccgtctcagcctttagagtagctgggatcacaaatgcatgccaccacacctggctaacttttcttttcttttcttttttatttttttgagatggagtctcacactgtcagcgggctggaatgcagtggcatgatctcggctcactgcaacctctgcctcccgggttcaagtgattctcctgcctcagccttccaagtagctgggattacaggtgcccaccaccatgcccagcgaatattttgtattttttttttagtagagatggagtttcaccgtgtgggccaggctggtctcgaactcctgaccttgtgatttgcccacttcggcctcccaaagtgttgggactacaggtgtgatccatcacacccggccaacttttctttttttttttttttttaggagacagggtcttgctctgttttccaggttggtctcaattcctgggcccaagcagttctcccacctgggcctgccaaggtgctagtattataggcgtgagccactgcgcccagccctttatagtttttttcttttttttgagatgaagtttccctctgtcaccaggctggagtgcagtggcgcgatctcggcttactgcaacctctgcctccctggttcaagcgactctcctgcctcagcctcccgagtagctgggactacagatgtgtgccagcatgcccagctactttttgtagttttagtagagacggggtttcgccatgttggctaggatggtctcaatctcttgacctcgtgatccacccgcctcagcctcccaaagtgctggcattacaagcgtgagccactgtgcccggccagctctttatagtttaagaggaaggataaaccttaagagatcacaaccatatatttgtgtcaggggtccacaagactgcctccatgtttggagatttgctagaaggactcatgggatcagcttagggttgtaatggctaagatttattactgtaacatagtatggatatatagtagaaagacctcaatggcaaaagacactgacagagtctggaaaaatccatgtaccagcttccttatgtgctgtgccttccatgaggatcacacagactaccttctttcccccttaacgaaaatacaacaacatatgtgactgcccaagaaacacagtttttatctaggctggtcatgtaggtgtactctctgcctagcatgtgtgaaatttccagactcataaaaagaatagcaggataagccacattatttccatagtctagatatagtaaaccatgattaccagttagggaaccctcttgaaattcaagttctcagaagccagcctaggaccaactgtgcaaacagacagaccctccttcacaggataatgtaatagtctcagatctgctttgttaatttttgtttgcatagagttttataattggaaggtgtctcaaatgctacatatttctgtctaatggactatagtaagagtgttgtatagtatataacattgaattattctccattatagacaggctgtgataagtgttctaatgtttatacaaaagaactttgtaactttgagcagagtaaagagactgttaatgatacttttgactgcaagtagtagaaaaatgttgtgtttaactctgaaatatgctttgcctcatattagtatttctactctagctttctcttgactagcgtaagcatggtgtatattattccattcttttattttaacctgtttgcatctttgtatttaacttgtgtttcttgaaggcgatagttttatttctctgataaaaacatataagaagacaatcacattaaatgtatatggtctaaaacctctgctttttaattgggggtatttagaccatgtacatttaatgtgattgtcttcttatatgttttctatttatctctatctgttccttgcatcatttttcttgcatcccccacctgccaagatggggtcttactctgtcacccaagctagagtgcagtggtgtgatcataccttactgcagccttgacctgctaggctcaagtgatctacctcagcctcccaatagtggagaccacagttgtgcaccaccacacctggctactttgttttatttttttatatatggggtctcactatgttgtccaggctggtctcatactcctgagctcaagtgagtctcctgccttggccacccagagtgctgggattacaggtgtgagccattgcacctggtcttcttggattcttttactttatttatttatttatttatttatttatttattttttgagatagagtctcgctctgttgccaggctggagtgcagtggcgctatctcggctcactgtagtctccgcctcctgggttcaagcgattctcctgcctcagtctcctgagtagctgggattacagacgtgcaccaccacacccagctaatttttgtatttttagtagagacggggtttcaccatgttggccaggatggtctcgatctcctgaccttgtgatccgcttaccttggcctcccaaagtgctgggattacaggcgtgagccaccgtgcccagcctacattatttattatgattccagtttgcctctttttattacttttacctgtttttaaaaattatttttgtagttgctttaagattatagtgtacatttagagaggtctaccttcaagtaatattgtacacttcatctataataaaagcattccttcatttgctttcttttcctccctcgtgcactttgtgctattgctgccatgcatttgacttttatatatgttataaactctgtaatattttgctgtcttttattaaacatatatctcttagagatttaaataataaaaaatttaaaagatgtttgctcatatagttaccactgtggtgctctttattccttcgtattgatccagattttcatctgacatcattttgtttctggagaatatcctttaacatttcttgcagtgaaagtctcctggtgatgaattatttcattatttatgtttctggtgtgcctttatttcaccttcatttttgaaagatatttttgccaggcatggaattctagttggccttttttcttctagaactttagagatgtactgctgtcttctcacttgcattgtttctcaaaagaaatctgatgttgttcttatctttgttcttctataggtaacatgtctttttatacagctgctattaataatatatccctgattttgaacaatttgattatgttatcccttaatgtaattttcttcatgtttcttgtgcttggggtttgctgagtttcttggatccgtgagttaataggtctttttatggctagaacattttcagcagttgtttcttcaagtattttttttctcttcctcttttttctcctttggggactccagttacctgcatattattaggctatttgaagttgcctgactgctcactgatgctttttaaaaatcactttttaagattttttttttctttttgtactttagctagtgtctgttcttgtatcttcaagtttgctaatcttttcttctgcagtttctaatctgctttagttcatccaatgtaattttcatctcaaatgtttttgtctttgaaagtttgattttggcttttcttgtttatctcccatgtctctatttaactttttgattatatgggatacatgtataaaaacagttgaatgtcctcctctgctaattttaacatctatttaagttctgggtcagttttgattgattattttcagtttgcatcatgattgtctgctgctttttatgcctggtaatctttatttagttgtaaaatttaccttgggttctggctattttctttattctataaatcttcttgagctttgttttgagatgtagttgagttacttataaaccgtttcattcttttgggttttgtttttatgatttattagacagatatgaaggagtgcttagtccaggactaattattcctcaccactgaggcaagactttctgtggactctgttgaatgttccatgaattaatagttttcccagtttggctagtgggaacagatactattcctggctttgtatgagtatcaggccctgttccctcccattgtttctgatggttctttttctggattctcatagtttcctcatatgcatatgctgatcagttatctggtgaatgcttgagagaagatctctatagacctctggggttcttttctatgcaactgtctcctctcagcattctgtgcagttattccttgctgcttttttctctcctggctcttaactttctctttccaactcaggagtcagctgagatttgcctcagttgccactctctatgccatggcctggaaactcttatcgttgtgtgctggggcatatgtagggctcacctcttttgtttctcatttctcaaagctctacagtcctttgttgcctgatgttcacatagcatatatatgttcacatatattcacgtctttctttctttctctctctctctctctctctctctctctctctctctctgtctttctttctttctttctttctttctttctttctttctttctttctttctttctttttctttctttctttctttttagtggtgatgggatttcaccatgtttgtcaggctggtctcaaactcctgacctcaagtgacgcacctgtcttagcctctgaaagtgctgggattacaggtgtgagccaccatgccctgccatgtcttcattttttatggttgtttcaggaggagcgtaaatccgataatccggtctctgtgactccatcttggtcagaattagaagtattatgcaagtaactaagaagtttattatttcacaatagaaaattaggagttagggtgatgggtagttcagtagcttcatgataacaagttgtcagggtcttaacatcttttcttggtgcatccagaacatattggtctctttcttgatccagttcctctcatgagcaaaagatagtgggcaggacctctaagcattgtactctcaggatagcattcagaggcagaaaggaaaaaggaacctttttattattatgttaattaaggaaaaatccttgccagatgcttgtcccatcctagcatatttctctctctctctctctctcttttttttttttttgagatggagtttcgcctttcgcccaggctggattgaagtggcgcgatctcggctcactgcaacctctgtctcccaggttcaagtgattctcttgcctcagcctctggagtagctgggattataggcacccaccaccacgcccggttaatttttgtatttttagtagggatgggatggggtttcgccatgttgcccaggctagtcttgaactcctgacctcaggtgacccgcccgcctcagcctcccaaagtgctaggattataagcgtgagccaccacgccctgcccctggcatattcctcttaacattttattagctagaattaccttgagtgttcatatctttttttttttttttttttttttgagacggagtctcgttctgttgcccaagctggagtgcagtggcgtgatctcggctcactgccagctctgtctcctgggttcacgccattctcctgcctcagcctcccgagtagctgggactataggcacccgccaccatgcccggctaattttttttgtatttttagtagagacggggtttcaccgtgttagctaggatggtctcgatctcctgacctcgtgatctgcccgcctcggcctcccaaagtgctgggattacaggcgtgagccactgcgcccagccgagcgttcatatcttaaaccaataactgataaagaagttgagacagccatgatggctttcctctgaggctggggagagtatttagcccctctgaagcatgtttctgcttagagcagggtgcgtatctgaaaaagtggaaatctgtaggaaggaaaaagggggaatggatattttataggcaataaacagtgtctattattggaaatatgttttaactgagggaatctgaaaatatttttaaagaaggaaagatttaaggtggtgcttggaggatgggtaagtttcagtagattaacatagggattctagacagagggtcaccctttacagggtttgaaactatgagggtatatggattttggaaaaatggcacatacgtaagaatgactggagaataagtagggtagagaatactaggggacaggaatggaaaatttccttggctttgcataccaagatgaggaatttcagtaatgtaccttttaaataagaagagcagtattaaatgatctaaattcccccagccctttgtaattgaattggaaaaggtttacttgaagacaaacatatttaggattactgctataaattaaaggccaatgagtgtaaaatcttgagtttaggtattatgtgtaaaacataaagatgaaatattgtaatagaatgcatagtatttgattctttataaattagatggaggaactgcagatgtcttttttttcaagtctaagtatgttggaagatcacaagttttgtttggttgtgctgagcctgaaaccgtgtgaaatggctttgacactaaatgtcagggtaggaatcatagacagttttcctaactagcagtggtggcaaatcaaactgactttggagaacaagaagagaaaagaagatggaagattgatcctttggtcaatgctctgaggaagaaccagtgaaaaggtggatgttaacacagaataagttacaggaagtatagtagaaattatagtagtttggattaatagatttaaggaggtatggtcaataatctcaaatgcctctcaagtgtgtttttgtattataagattttctaaataaaagtttctaaataaaacctaataatatttattttttaagagatagagtcttctattttgggagtggcgggtccggcagagagggatcttgctgtgttgctcatgctggagtgcagtggctattcacacatgtaatgatagtatactgcaactatgaactctagcaatgtttccagctcagcctcccacatagctgggactacaggtacatgtcaccatacctggtcataattattatttttaatgggaagcaatcgggagtcttcacttcttaatctgtctctgacattgttagctaatgtcaagtgacttcttccccaggtcatgttacctgtcagtactcaatcatcatgtacacagtaagaaattgttttatcttttcactctgaaatgcagggatagaaggaaggcatcaaaaaattaacaatggattatttcatcacaatgttaagtgcaaggtgtcggtacagcaagataatcctagatatttatttgaccttggaatgccgttaggcatatatctacttaaaaattgatgtggctgggcatagtggctcacacctgtaatcccagcactttgggaggctgaggcaggcacataacttgagctacaagttcgagaccagcctgggcaatgtgacaagaccctgtcttttcactaaaagtaccaaaaaaaaaaaaaaaaaggcaggtgtggtggtgcacacctgtagtctcagctactcaagaggttgaggtgggagggatggcttgagcccaggatgcagaggttgcagtcagctgagattgcaccactgcactccagcctgggcaacagagccagactttgtctcaaaaatgaatgaatgagggaatgaatgaatatgtttatttcccgtcaccttgacaccttgactctggagctaagaggaagctgaaaaatttgttttagaaaattaagagttttgtatgcctatttaaaaacagttaaattttggtaggcccattcaatgaagatgtctcaatttaattttaatctttctttttagtattaaataagtttaaagaaatgaacttacctttgtgatgaggtgggtggtattctttggtattgtaaaggaccccttgaatgtaaagtttaggggaggggtggagaataatatgaacttacatctgcataaaatatcttgtgaaggatgcataggaaactggtaaaattctttgcctgtaggaaacttattttatatagttgtatacaaagtgattttatactgcataccctttaggaacttttgaaccatggtaatgtttttatttcaaaaattaaaaaccttttaacagtttctaacttgttttgaaaatatacttcaaaaacttatttctctagttgtgcactattgtgtgttttatctatttgaaattgatttgtgtatcatgtgatataaggggtccagtatcattttttcacacatggacagccaattgttactacaccatttattgaaacatctttttcctccacatttgaaatataacctattatatagcaaacgttcaatgtattttagattgttggtaggttctctgttttattctttgtgtatttgagaatcccagtgatatatcatgatgtcattgttactgtagctttatactaagtctttctattcggtagtataagtgttatttccacctcttcctatggcagagatacttggtttagactagcctttccactgagaacaattagaaaagctgtataaaatgttgtttcaaataaatatttaagggatcagaaaactagaagagtggtgaggacctgagggagtgagaattcagagggtaaggttgtgcagagtttggcctgaccttaaattttcttttccccttgagttaattactcagttcaaaaaaatccagctgagaggttgaaaagctgagaagcttctggcagtctgcagagctgggaagacaaaaagggaatttaggggtcattaaatgctatagaagtttatttaggaccctgaaggctacagaggggtggatggaggtgtcagcaaatgacagcctgtggggtcacattcggtcctccagctgtgtttatgtgggacatgagctaaaaatgttttttaccttttaaaatgtctgaaaaaaatttaaaagggaataatattttatgacacaggaaatcataacgacattcaggtatgagtgtttaaaactaatgttttatgggaacaaaaccacacccatttatttgggcattatatatgacttctgttgcactacagtgtcagagttggttgctgcagagagcacatatatttcaaattgctgctctgcatgctacgaatcacaatgacatagttacagtttgtcagtatgtgtgtgtgtgtgtgcgcgccacacatattgccctggcatcttatttatttctctcattaccagtgcatacccacctatcatgttaaaacaagaaaaggagaaaagtggactttatatgtaacactttagaggtatagtggaatgtatattattattaacaaattagatagcaaagcattatatttattatgctagaagactatggctgtgctaaaagaatataatatatgtcagcattaccagacttggcacttctcacaatattcccagccaacaggaataaaactaaaaggtcagaaaaaaaaatagtaaattaaaacaaaattttatcacagcagaatttcttctcaaaaacaaaaaatggaaattaggctataattaaagtaagtttttcaatggcttatttgttagccaagcaaggaaaaccattaccaacagtagttaattaaattatgttttattaaggtaaacaaagatgtgtccatagaaaataaactttaaaaaagactattagcctttcagcgagagtaattgctctaaaagttaaggacgttgggagtaatatcaagtcattttggaaagaagggtgaatgatttttcatggttttcttaggcttttgatggatgaataggtgttaccagtactgttcagttgttacatactccagaagttagtgctgagtttgaagtgatggaagaattagtgtttatgcatagtctatgtgaaacaactacaagagaaaatattttcagaaaagttgagcaaacactaacttagtacaacctgaagtggaatccgctaagatgcgttacagttgatagtggcaaaaataactgtggagcagaaagacttgagttggacaaatttacaaagcttgttaaatgtcaggtgtttaaagcctgattatttactgtattatttattagcaggtactttgcagaaaatatttaaatctgtcatgttttagtgaactattatataatagtgtcagcagtgattttgacttgcatttgtggacttcatcatcaaatcctatgaatttttgttagatatagaggcagaatatactgaattgccattctacatagcaatttagtgacttggcagtggtaaagttttattgcagttttttgcgctgcggaatgagattgaaatttttctgaataataatgccctcaactattaagtcaaatacttaatagctttgaaagttggcttttcctgtagatttcataatattttgtaacaaattcacctaaaattacaaggcagaacagtgattataagtgaaccttatactgtggtaaggtcacttctacaagaataatgaatcatgaaaatcaagagaaagaacaaatagtaggaaaatgtcttccaattccttttagcccttcatatttctacctgaactcataagcttttaaaaagataattatttttatttatatttaaaaagataatataggataatatttttgtaaaagagttcttgagatacagcactgaatgtaaaggaaaatattggagcattcaactacatttgagaaataacttctgtttattaaaagatactataagaatgaaagcacaagccctaatgaatattcttgtttgatactaaaccaaagcttgagaagtggtagtttcgcaagtttttcaagtggtttggtgcaatctgaagactgcaatcccatcaatgaactttatatctttaccctttaaaattataatttatgggccgggcgcagtggtttacgcctgtaatcccagcacttcgggaggctgaagcgggtggatcacgaggtcaggagctcaagaccagcatggccaagattgtgaaaccccgtctctactaaaaatacaaaaatcagccgggcatggtagcaggcacctgcagtcccatctacgggggaggccgagacagagaatcgcttaaacccaggtggtggaggttgcagtgagccgagattgtgccactgcactccagcgtgggtgacagagtgagactccatctcagacaaaaaaaaaaaaaaaaaaaaaaaaaaaaaatatatatatatatatatatatatatatatatatatacacatacacacacacacacacacacacacacacacacatatatatataaaatttattagactaccttgcaatttcaggggatcttttacccatatatgattttataagattactaagtggtctttggaaaatattggttcactgagtgatccagatattccaactattgatacggttgtttttgtttgtttgtttgtttgttttgttttgtttgttttgagacagaatctcactctgttgcccaggctggaatgcagtggtgcgatctcagctcacttctgtctcctgggttcaagtgatgctcatgcctcagcctcctgagtagctgggactataggcatgcaccgccaggcccagctaattttcatatttttagtagagatggggtttcactatgttggctaggctggtcttgaactcctggcctccagtgatcccaaagtgctgggattacaagtgtgagccaccttgcctagtcctacacatttttaataaataacaaaattcacatttgttataatccactgatctcatcagaaaagtctttaagtattggaattagttaagcttacattgttggatataagtttttcaaatcttcttattgtccactcatgttctaagttgttttccttgaagtgacaggctcactttattccttttttcaagaaatatgttagataatcaagttttaataattgtggtttgttatttgttcttacatgtaaaaccggtgttccatgaaaaaagcatttatttcagtttataaatcacatgatcacaaattctttcctcaagaaaaactatggtgtaacaattattttactctttatttctcgttttgtcacatagataattaaaagatgtgtattcatggatcaagacttaaaacattaatgatttttgctgcttcatcagtgatattctcaatgatactctacattatttttactgtagttgtagtgccaattgagaatgtgacaacttctaatacagcttggtgccaactgctttcagttttggaaatgcatcaacagttttacccaccatagcttttgcatcgtgtaacaatttttgcttcaattgttaaacattattttgaaaactcaaggaacagtaaagtctgttttattgcccatatttttactatttgtttgttctttcttccttcaggatgttctgagaatccttctttttatcattctcctttctggttcaataacttttctcactattcttttggtgtagttttgtctcatgactaatttttagttctcattcatctcacaatttcttgatttccctttcattactaatggatgtttttgctggatatagaattctttgttgtcagttcttttaggacttgcaaaaatgttatgctgctttgttctggcctccatggtttcaggtgagaaatctgctgtcatttgagttgtttttcatctgtggataaggtgtcatttctcttatttatctcagggttttttagtttagtcattagttttcagaagtttatgatatatattagcattgatttatttgtgtgtatcctcttaggatttattcaatttcttgaatctgtgggtcttcgaataattgttcagctgcgtcatgttccttttctgagattccagtgacaggaatgttgcatcacttattatagtcccacaagtgtctttaatgtcttttttaaaaaaaaaatatttatttatttatttatttattgtcagagttttgctcttttgcccaggctggagtgaagtggtacgatctcagctcactgcaaactccgcccctgggtctaagtgattctcctgcctcagcctcctgagtcgctggaattataggtgtgtgccaccatgcccagctaatttttgtatttttagtagagacagggttttgccatgttggccaggctggtcttgaactcctcacctcaggtgatccacccatctcggcctcccaaaatgctaggattacaggcctgagcgaccgcacctggccacttttttttttttttttttttaaatcagttcattttcttctcttgtttaggttgggtaatctctcccattttgttgttcagcttagtttgtattttatttttgttagcatattttttagttttcaacttggtatttgtttctttcttgatttctttgcaaaactttgtattgtttcctttgtttcaaaagtatgtttgtaattgctttttttttttttttttttttttgaggcagactcttgctctgttgcccaggttggaatgcagtaaatgatctcagctcactgcaacctctgcttcctgggtttaagtgattctcatgcctcagcctcctgagtagctggaatcacaggcgtgcaccaccatgcctggctaatttttgtatttttagtagagatggggtttcatgatgttggccaggctggtctcgaactcctgacctcaagtgatccaaccacctctgcctcccaaagtgctgggattgcaggcgtgagccactgtgtccggctgtaattgcttgttgaagcagtgttatatagtttaaaatctttgatagataattatgacatctatgaattctcattgtttgcaccttttgactatattttcaaattcctgttcagattttcctggttcttagtatggtataacatgttatatttggttgaatcctttgcattttaagtgttgtgttatgaagctctgcattttatttaaatacccccttttagtaggatttatctgaaactttgcttttggggtggaggtggggcacagccttgttactactcccaggtgtatgtgaagattccagttccttagtaggcctttgttgactcattgatggagacgtacacctagtaaatgctgagtaggagtgaaaactctggacttgcattacacctttgtgaataccaccctggctcaaaaggttcctgcttttcacttggcctccactgaatgggatggaggggtggttaagttatcactgggcagtgctttgagtttggattctccaataggcctctcctgtcatatctctgtagagggagggatagggatatgtccttatcactgggtgggtgttgaactcaggctccccactttttttccacccacactctagagggaggaagccgcgttactgctcagtgggtatgaatgtcctgtgtcccagttggcctgctgtggtatcatgttgtccgtgggcaggagtggggaatggctgactatgtcctccttttaagtctttgcaaaaggtatatggcttgggcttttatttgtaccatttggcttaaactggtttgttgttgtctatgagttttttgtcttggtagcctgccgcttccctgcttttttgacaaaagacagcagaattttcttggagttttacgtatgtgtgtgcctgttggtgtttctgagttgtctgcttctctagcaacttttcttgtatatatgagtcagaaaggaaacctagggaattcatcctcttttgtttcttggctcctgaagccctaattggtctgccctctctctacattttgttgtcttcttttgtttgtcttatgtatcacggctaagggtttttaaagctgtatttagtggaaagaacagggaaaagtacattttctgcattttgtctggaagtggaagtctgcattcatttttgctgtttttccctgaatacagagttctgggatgattatgtttttcttcttcaagcatttaaaagatgttgcattgtttcctgtcttccatggtttctaatgagaagtcaggtgtggtgtcagtagtatcattattcccatgtatataataatgttttgatattctctggctgctttcaggattttctctttatctttggttttcagcagtctgactatgatgtgcctaggtgtggttttctttgtattcatcctgcttgggggttgctgagcttcttgaaactgtaagttgatatttttcaccaaatttgtgaaaagcttgacttttatttcttattctttttctgtctcatttctctctcctcttcctctgtaactctaattacatgaatgttagtatatttgatattttgtagattactgagggtctgttcgttttcttcccagtgtttttacttttagttcctcagaatagatacactattcatgtattttcaaggagatggaccaattttctaccaatctcttgttaagcccatccactaaaattttcattgaaattaccatacttattagttgtagaattttcttttcttttcttttgagacagggtctttgtctcccaggctggagtgcaatggcgcgatctcggcttacagccacctccacctcccaggttcaagcgattcttgtgcctcagcctctcaagtagctgggattataggtgcccaccaccacacccagctaatttttgtatttttagtagagatggggtttcgccatgttggctaggctgctctcaaaatcctggccttaggtggtccaccttccttggccttccagagtgctgggattacaggcaggagccatcgcgcccagactgaaactctatttaaatatagattttagccaatgatattctgctttttttccaagggtataatgtcctcccattccagccagtttttggttatttacaggtaacttcaattagttagcttttacgttttcttcagatttgagacattttaggaaagttactctgatattagtccctatgctgttacccaataaataaataaatttatgtgtgagagccattgttttgttaaggtatattttgcatacgctataattcaccctttctaaggtgtgtattgaatgtgatttggtaaatatgaacagtcatgtaattaccatcatagtcaagatacagaatagaccctttacccataaattcactcatgaccttttgaagttactgcctacctcccactccagctcctgccaatcaccgatctgttgctttcctatagttttgccttttctagactaatatatgaatggaaccatacagtatagaatcttttctgtctgcctttttttacttagcataatggttttgagattggtccattcactagcttacagttaagtttcgttcaatttttggccagtatataaagctgctgtgagcatttatgtaacatgcttcgttgtggatgtatcttttcatgtttcttgggtaaatacctaggactggaatttctgacttgttggaaatatattcttaactttggaaaacagtttcacagtttcttaagtgtctgtatacttctccgtttctagagatctgagagttccatttgctgtacattgttgccagcactggatattgccactgtttctaaattttagccatctggttggcatttagtgataatttattgtgggtttgattttgcattccctgatgattaattagattgagcctctttttatgtctttttttgccatttgtgtatctttggtgacatgtctgttattttgtctctaccatttttttccaattgatttacttgtcatcttcttgagttgtaagagtttttttatatattattcacagaagtcagttttggagatgcattttataaatatttttgcctaatgtgtgacttgttttcatttatttagcaatgtttattgaacagcagagggtttaattttgatgacattggtcatttgttaattttttggaagttgaaaaaattatgctgtttatgctttattaaaaaatctttgcttgccccagtgttagttgtaggtttaaaaaatccatttatggttaaattacacatatgataaaagaatttgagataagattcatgtttctttgttttccatacggattatttagcagttccagcatcattctaaaagactatttattgctctcttggattatcttggccccttggtcaaaaattaattgaatatggaaaagtgagtctatttctgtattttctgtttttctgacttatttgtctctccttttaccaaaaccaaacataaagattttttttcaaaatcatgagttgatatttatgttttcagtttaattcaatagcacaattacatatctttaaaacagttttatacctgtagctaagctatagttgtatattttcttttaatatcatctttcctataactgaaaaagtcattaaaagaagaaaagattattgtttttgtttcaatttcaaagtaatcaaaactaagtgtactagtattaaatagttaaagctagtagatcaataaggaaatttaatgttattgcttttttctatctttttttgagtttactagtgatgtaaaagatttgagttatttgctgtgattatataaatactcttttgatgcataattcagcagttaacatcatgttaatttgtggcattagtaattttactgatagcccttctgtgattctgatttttggtagtggtttttacctggtaagtagcattttatcagttggcaggtactggaaatctgctttatcacttcttttttaagaaaagtggaaaacacaaacagtttgttcaccaaagttatgtttcaaggattccattcaaccagaatctggttcaccttattgactcaccttgggggtatatgtactagatttttacatacatctgtttggagaaactcgttttatctgtgtaatgtttgtaagaccagaagttcttttactgttcttgaaataaaacttttaagaagctgagtattcttctgttagtttcaaatttggactaaaattacacccaggttttggactaaagagaaagcaaataatctgttctcatgttcttaaaagacatgatttaagtgtatccaactaacttgattcttactgtgtctgtgtttactcctactaaaatgaaagcttttaaattttttcccactttttgaagtatttaactcttctgtaataggcagtgttttcttattaactttaaagttgtgttaagcaaacgtgtttaaattaatatttcaatttcaaaaaccctaatttgaaacaataaattttatcattgtatacattatgagcttttaagaataaccaaaaaaatgggggtggatgttttatgtggaagttatgtgtatcccttttctgcttttggctaaggacagatatcttagaattagctttatggcgcattcatctatctgattatttcagttaatatcatcttaatataatacaggttacttgagaagaaaacaaactcttaacccactattggagagataccaggtaggatactaaccttgatatagaatttcatgtgagaaagaaaaaggaaaatattttccattaaaagttgagtttttatctaaaattctcttaattttctagaaaaaacttaatttttctaaaaatatgttgaagaattatatataaaattcactttgctatatatatagcaagtgaataataggtacacatttctaggaataccccaaatattagaacgtatatactaaaatcacatcaggaaacaaataatagcgccccagaaattccattcagcctcctgttggttactattcctaactccccaaagacatgcactatcatctagtaacaacataggtgagtcttgcctatgtttgtactttgtgtaattggctttgtactttgtataattggctactaagtactgttttctgtcatctttcatgtatatatttgtgagataaatccaaattgttccttccagtcgtttatttttctcattgatgtatagtattctgttgttaagagtactataatttatttattttaccgttgggcattttgaggactttcaatttgaggtcattatgaattgtgttctatgaacattgcagtacatttcttttggttgacactgagagtattttatggattctaaccccaaagtggctactttcttttctttctttcttttttttttttttgagacaaggtccagctctgtcacccaggctggagtgcagtggcgcaatcttggctcactgcagcctccacctcttgggttcaagcgattctcctgcctcagtctctcgagtagctaggattacaggcgtgcaccaccacgcctggctaatttttgtattttttttttggtagaaatggggtttcaccatgttggccaggttggtctcgaactcctggtctcaagtgatccgcctgccttggcctcccaaagtgctgggattacatgcacgagccaccgtgcctgtccatatgttattttcttacaacctaaataaaaaccattacgtaaacaagacaaagtacttagtacatttccatagtcgatgaatttgtctttattacttgtatataactaattatgaactccttgagttcagttcctttcatttcctgactcattgggcttgaacaaggatatttaacctctctgcttcatttgtaaaatgaaaaatagtaatatctacctgaaatggtggtggttagatgggaataaagtaatttctttttttttttgtttttgtttttgagatggagtctcactctgttgcccaggctggagtgcagtggcgcgatcttggctcactgcaacctctacctcctgggttcaactgattctcctgcctcagccttccaagtagctgggattacaggcgcctgccaccaggcccagctaatttttgtatttttaatagaaacggggtctcaccatgttggccaggatggtctcaaactcctgacctcaggtgatccacctacctctgccttccaaagtgttgggattacatgcgtgagccactgtgcctggcgtagatgggaataaagtaattcttataaagtacttggcttagctgctggcaaataataatgcttactgattcttgcatattacccatagtttattggctaacttatgtcttccttaaattatgaaattctataaactatccttgtctattttaaaattatactcatttttataacttacatgctttatttgtatatatccaggatactagatatttgtaattcaaattggaggttattttttgtcacttgattttttttctgtaatgtgtgttctcaccacatagaagtttttacatttctatgtagtcagatttattcatgtttttatttatggttatgttaaagattatagctattagggacctatttcttcagggtttataatttatgtatgttgttacaaatagagagattactttttctttgacccaataggtagagggcacttttgtggactcagaaagcttgcctctcctatttttttaggaaaatatctgagattctgcctcctcatttccaagccagagtttaaaatatttacatttttacttcatagtgttaagacattgtgtaatgtaagtataatgtttaaaaaaaaatcttaaaaatgtaatagtgatttggcagagaccaaagcatggagggccttgaaatgctgctctgtttgttatctgttacaataaagcaattaccataaacttaatatcttaaaacagcatccatttacttaggtcagaactcagggtaggctcacctgtgctctctgtttaaggtctcacaagattcaaatcaaggtgttacctgggtggaagctctgggggtgaatcctcttctaggtgcattcaggtgtgggaggaattcagttctatgcagttgtagggctgagctcgccattttctttctttctttcttgatctgccgcccaggctggagtgcagtggtgcagtctcggctcactgcaacctctgcctcccgggttcaagtgattctcgtgcctcagcctcccaggtggccgggattacaggcgtgcgccaccacgccggctaattttttttttttatttttatttttagtagagacggggttttaccgtgttagccaggatggtcttgatctcatgacctcgtgatccgcctgccttggccttccaaagtgctgggattacaggcatgagccaccgcaccctgctgagctcaccattttcttactgcctattggcttgggtcactctcagttcctagaggccactctttggtttttcctcgtggctctttttatcttcaaagatagcaacagtgtattgaaatgttcccttgctatgaatttcccttttgctactagctggagaaaactccgctttcaaagaggttatttgattagattaggcaaatctcccttttgattaattcaaaggcagttgattggtggctttaatcacatctgcagaattcctttgccatataatatattaatggcattatccttgccatgatatttcatcatatttacagcctctgtattagggtaggaaatttggtggggtcggtggtatgcgggcattttagaatactgcctaccacacattctgtattgaggggtttgcgtgtgattcagaatatatttgtattccttcagaaagattactgtggcagcagggaggagaatgtggcagaaaggaaaggtactggcaggagaaaaatcccactcttagcagtctccattttgattttgtaatgtcgtttgatgttattttttttagcagatgtttcaatcagaaatgtgtgtttaatagtatgccaactagaatgattagcctggaccagaacaagagttatgagtcagtcaatgaactgttcattacttcaggtcaattcatatacagaataatttcatagattaggttttatttcagtcagctttatttcattttctaaagtgaacagttgtttaaacctcggatctcattaacagcattttaataaacacagtattagggtgggtttacttccctagattgtgaatctcatggattatatgttgattcttattggcttaatttttgaattgggcattatttattttaattctttagtcttatagttttgcatgtttgaagctatatgttttcctctgaagaccacatttgccacgtctcagagatttttttgatgtttcttaatcatttaaaaataatacatgatttttcttcttgattgaaactctgccgttatatagaaaggacttttaaattttgccagtggatagatttgggactttatccttatattgtgaatttctaatttttattgtattaggtctagggacacatctgcttttactgaatataacctaggaaatacctgctttttaaaatatgtggacatttctttacgaccatacatgtggatttttttttgaaaattctatgtatatttgaatagaatgttttctctatttttggaatacagagatctgtgtgtattttatgtgtctgtttgaatcaaacccgatcattgttattatttatttcatatctacttaatatcctgatttgagagctatgttaaagtctaatctatgcatgttatttctactcagctttactttttatatgtgacatatatttattaggtgtataaactttaatgactatggcttcttttggaatttacactgtaacataaaacttaggttattatgaaatattatctttgacttgttcactgctttttagtttaaattctatttctttgcaattattgctatacctgcattttttggttagcgtttgtgttttttcccctcaagtctgtttttgaattgtgtatgtcactgtgcattgtgcatatatatagctgctcctgtgttgctgtaaagaaatacctgttgctgggtaattgataacaaaaagaggtttaattggctcacgattctgcagacagtacaggaagtgtggtgctggcatctgcttctggtgagggcttcaagaagtttgaaatcatttagccaggcgcggtggcaggtgcctgtaatcccagctacttgggagactgaggcaggagaatcgcttgaacctgcggggcagaggttgcagtgagccgagatcaggccactgcactccagcctgggcaacagagtgaaactctgtctcaaaaaaataaatataaattaaaaaaaaaaagtttgaaatcatggttgaaggagaagggggagcaggcatctcacatagccagaacaggagcaaaggagaggggtggagatgccatacacttttgaacagccagatcttgtgagaactcactcgttatcgcaaggacagcaccaagccatgagggatttgcccccatgacccaaacacctcccataaggccccacctccaacattggggattacatttcaacatgaaattttggcggggacaaatatccaaagtatttcatttatttcatattatatatgtgtacacacacacacatacataaatgaagtctgtagtaatatgtaaaatatgtatatgtgttatgtagtatattttgcatgttttgaaagttgctatcttttactagagaatttaacctatttacatttgttatccatggacttgaatgttagcttaacagacattaaaattttggttttaaataattttttataggcctagaaaaataatgattttttttgggtttctttttaattcagtattgataatgagaactgatgcccgattcttctttttttgtaatgatctgttttcttttttatgtggctccaagaattttccttttatccttgttatttcaaagtttctgggaagtttttacctgaagctgccattcagggagtttaaggagacattgttacagatcaagagtgggtatttttgtaaggatatagaaataagtggaacagtgataatgactctttcggttttaggttcctcatctgttgaatgaggattatgcttaattaaatgttagcttttattattagatatttacataacttttcctttagaattttggtgattataatccctcccattttctcccattctggtactcatataaaacagacattgcaccttctggatcagattttcatgtcattctacctctttctcttactttccatctttgttctttattactgcatcctgggagaatcctagttgcctaatactaaaaaaagactggtgaagattaaaaacaaatttggagcatggggagccttataatacttatttattagagcacgtagcctaaaaccattgctatagttggtacagaataaatactggataattaattaaatgaactgtggaatatttaacttcttggtatttttttatgatacaactttaatctcaaattttgttcattctgttttgttttatggatacattttgacagattatttcaaactattaaataaaagtcttgaaaattcctcagactcattcttaaaattggtaatacgagttctcactgagtttttgttgttgttgttattgtgttcttggattaatatgggaaaatattattataacatgttacttttttccttttcttactccctgtctttttaatgatgaataaaagtaaaaagaaaaaatgctgtctaggaattttcattattgattcaaataaaccatttagttgatacaccatttaagggcctttttttttttgaattttatagactggttctcacttttgtttcccaggctagagtgcagtagcgtgatcacagctcactgcagcctcaacctcctgggctcaagcagttttcccaccccaggctcgtgagtagctgggactataggtgcatgccaccatgcccacctaattattgtattttttgtagagatggagtttcaccatgttgcccaggctggtttctaactcctgagctcaaatgatccacctgcctcagcctcccaaagtgctgggattaaaagcatgagccaccatgcccggccaagagctgtttactttatccctcctccccaaatgttaattagcttcgtaattgttacttatgtattatatattacttattgtattattaatattttaacttgcttgatttcttttatgtgtagtgtataagagtgttgacatttgagaagttccctgtggaaatccattctttgatattgtctacgattttacaagtactttttacttggtttaggaagatacattccagactgtgtatatatagtaaacattttcttttaatgccgagtgctcttcattagctatttaattgtaacagatgggtttgaagcgttctcctaaatgtagtgttttattttccttcttttattcactgatatctttatatgatattgtaaattagtatgttagatatattccagtacttctcatagtagtttagctaatataatatttttcattgcagatatgattaagagaacatattggtgtttctaaaatgagaaagacattgagaagctggtcaatttaaattactttctgttattatatacttacctctcattatattttatctgccaagattatttttagtgtaaaaggcttctgcaaaacttgccatatggtatcaaaataagcgattttagattttaacaatttagcagaaattagttatgttaatgagttgttataaacatttttcaacagattgattgtacttttcctttcgacatttacgtggtctttctattcagacatttagactaccgaggtgttgtatttgtagttaattctgggttctgttaatgcactaaacatatttagataccttgggagttataaaaaattacctgttttgtaaaagctggttattacactttatcaatgaagaaaaatatttattttctgtgtttctaatgcattaatacccttgagtgccaaaatagcactgaaatgttattctgtatacttataatattatataaaattaaagtgtcacaacagtaattactgtttatgagttatttagaagcttctcctgcttcagcctcccaagtagctgggactacaggcgcccgccaccacgtctggctaattttttgtatttttagtagagatggagtttcactgtgttagccaggatggtctcgatctcctgacctcgtgatccacccgccttggccttccaaagtgccgggattacaggtgtgagccacccggcccagccaaatttttgtatctctttcttttcttctttctgattcagccctcaggagtcacttagctttgttatgttgattcagtgcagtagactgatgacagtgaggaagagtttgatagtatgtgatatacagatttacacataaaacattgaaaacaattataattttaactactgtagtccctggttaattagcagaatataaagtcagtgtagtaacatgtgaagatatccacagtaatgttagcagggtccaactgtctgtgttacatgaggctccagttatctcagctaagctgtttatgagccacactcacaaaaaagatcaccaaaagttaagtctttttggtatatgtataggaacacctttctattagggcctgtttcaagcagcatttttggtgctttggatacaaagatagtatggtgcctcaattgaaggatcttggactaggatgaggaaaagataaactgatcatgtaatggcataagcaagtaagtaccatgtaatggtgtaaacaaaaatttatgttagatagtcatttcccacagagagatgtcatactgtatagtacagggcccatcaaactctcttcaaagaaaatgatgctcaaagtggacttgggagaatgaggaagagtttgtgaatcattctaagggaaaactgaataagtaaatgcaacattttacataatttcttctgacttcttatgtgttcacttgccctagactgcccctcttgtttggggcttatttctgtgcgttttaccacttgcaagataatggaggcaggttgaaatgggaaagataccagatgactaattttttttcgcccacatttccatcttttgttaagaaatttgaagttgattgctacattgaagtatgtagttttgtgtttttttctgtgagtctttaaccatttgtgtccctgttaacttacaattgatgagtttattttgtatttatttttaggcagggtaaaaaatagtaatatgtctcataaataaaatatatgttcctattactagttttggtgggatttaaaaactttataataatcctcaatatagaaacctgcccttttaaccatattactatttgctttaaaaaaaaatctttaggttttgtttcaaaaatgcttcaaaatttatttttgaaaatataaggaatgaaattctaactttctaatttgaatggaaggatgagttggtagcacacgaagcgctaaattgagtaatgtagattttattatttttaacgaatcctttgtttaatattttgcaggttcaatttgttttacttgtgatatacagagagttttttataccttcccagcttatatttgaatattccttttcaaggttttataaagagatttctctcctttacccctttcagcgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatgtaagtttactacggatagacttttaaacttcaaccaatgtatttactgaaaataacaaatgttgtaaattccctgagtgttattctacttgtattaaaaggtaataatacataatctttaaaatctgagggatcgttgccagggatcgctggggagggaaatgttatcagtggtttcattgaaattaaatccaaaaagttatttcctcagaaaaatcaaataaagtttgcatggtttttattcttaaaacattttaaaaaccactgtagaaagatgtaaatagggactatgcagtatttctgatttatactataaaataatttattaaaaagtcaatcaacactaaaaagccatccagttgaagaattagaagacagttcactcaggtgttatttcaggatttacgttaataagaacaccaaagacttctgaaattcttagaaattgtgtttccctgataggtataatagaaatctctgctagtaccttttcatgattcatctatcttagtcttctgtaatctgcagttgtgctgtttttcttttccaaatagtattttataattcaatgaaaatgtttaaatgcgtgaaatttacattatacaggaaattataactctttactattgtatcattaaatagagatctctcctttttcttactatgtgttttccctatgagcatatatgttttgggatcttttttctcctagtctattgaatttccaatctcattatgaaacctccatgatattttattcaatcttttttatgtcacctcttagttacctaatgttagcttttatctgttccttagcaatgttaataaaagcttttttcctatcttctccaggtctgtgaaacgtaagtatagctaccccaggcttaaactaatctcaaatacagttagtctacatgatcattacccttttctttgttgagtaccataatttcattttccattaaaattattttgtgtccacatatgtaatcatatcaccattagtaacctagtgtacaaattataggtaaggcaaactagaattttaaattatatttaggctaataagggatttaaagttttaaaatgcgttagattgtacactcttcaatctggaagagaagaacttcatgcactgcaactgttacggctactatttatgtactgagttacttcagcaagtgcataaactggcagttatcagagtggattatattctgggtggcataataaatatactttgtcatctcaataaaacaattttgtgtgtatataggaatctgaattttattcagccttttgtagttaatcatgctttagacctcagcaaacaacatgcaaacttttacaagaatgttgttgtagtgttagaatattttattacttaatggcagtgctactttctactgaaaactgtgttctaacagtgtataccttcagttacatgttagcaatcataaatcagtttgtaaaataataaatactgaggtgagataatatgctgttgttgatcatgtatataatgaaaggtttatggcaacataaagctaaaagatacactaaaattatgagtactctgcctttttccaaaatagacttatggagactcataaaaatacatgagcaataggataaaactaaagtaaggaaatttggcaatggaaaatttagataggataaatatgaaggtaatagagagaccccccccaaaaatatataactccagacgtaaccacaaatttggccccataccttttcagcagtcaatacaaagaaggaaatatgagcccttaatctgattcttactatttataacaagacgtcacttgatataatgatataataataacaagacatcacttgatacaatgcaatgaaaaattatcttaaagtagccaccttgcagtagaaaaatatcagtttcatagggctgtttcttatagcagccttcaaactaagtcggtggtgtaaaatcaaggcctaaatgactaaattagatttctttggggttttttttttttttttttttttgagatggagtctcgcactgtcactctggctggaatgcagtggcatggccttggctcactgcaaactccgccttccaggttcatgcgatttctcctgcctcagcctcccaagtagctgggattacaggcgcataccatcacacccggctaattttttgtatttttagtagagacagggtttcactgtgttggctagattcgtctcgaactcctgacctcgtgatctgcccgtctcagcctcccaaagtgctgggatacagaggtgtgagccatcgtgcccggcctccttggggatcttaagcagtgcattctaactacacagcgttctgacccatctgttaagacgatcataatcttggattaagtaccaaggatataatttaaagaatattgcagataggatgttttgtcacctttttaacatgttttataaatattttttcctatcctaattgtgtgtcatggcagaagttaatttttatgcttttaaaatgatactgtcttaaatcatagtgttattatgagggttaaatgaaaacaatgaatggaattcacataacattgtgccttgtatgtattaattgctttaaaaagggtagttattttacctcctatctaaggattaagttatgagaatgataatacatattgagtatatgtattttctgttgcttcctaaggggcagagcagtagctgtgatagttgactgagttaggagtaaggttgacatctttttataaaagttgagaaatttaacaaaagcatgcatctcattataaagaaattcactaaagagagtatctgtgaagaaggccaagattttcttcaggaaacacttttagggtgctctgtcataggtaaatggctggtcattgttgcaacattattttcatgatgatacaaggatacattaaccttgtctggaaattttaccctaaaaatccatctagtagatacaaccagatatacttcctgaataggaaaactgaatggcacaaagccaatcatgcaagataagaggaaagaacattccagggagagggaacagaccactacacagaccttgaggaatggatttggcatgattcatgaacaggcagcatgtcattttacttggagcatagtagcctactaggtgggtagtagagacatcatcaaggcgaacaaaggctagatcatgtaggccttgtaagcaagggaaggagtttgggttctattcggtctgcaatgagaagtctttgcaaggtttaaacatggaaatgctacatatcctaattcaccccctgttcctcaatgtatttactcatcatttagctttaattccttttacttcacttaagctttaactccagcctcttttctttggttatctttgtatttcttgacattaagtcctgttgcttttcttttaccctaaattctgtcagtcctctgacctttcttatctacctgccaatgatacggtctagcctctttggatgacatccatgatttattttttcttcccagagattctcttttatagacaaatcactcagcacagtgtcctgccagtgatgaaaattggcagatgatagggtgtgatggaaattagaaagcaatgctgatttggtccttcttaaattcacactgtatgacagctattttgacttttgttgctgttcaccaatgcttttattcttatgtgttgtctggattttcttaagtaatagtttcatcaggtttaaggatctgtgataagctctgttctaatttaagctcaatgtttttgtcttttttatttatctcttctctttttacggctgtcttttaggaaatgaccttctctaaagatgatcattttgtttcctctcacttttctcctgccataagaaccttgctccctttacttcatttagcttcatcttatgccactgttggcatttcatgtctacttttgtgtatactcaaatactcatcactttcattgatcagtagtaaagtttgctgaggagtcaatttgattagtagtcaagagcctgatcttagaatccaaatagacctggaatttactcctctgcccttttaaattatctttagttatagcctgtctttgctttttcaactgtttaaagaaaaatttcttagttgattattgctttaaacttagtgtctctggcttacagacatgtgtgtctaaatattcatatttaatttctgtcatgacaccaaagctatccagtagtatcgataatcttgtacatgacctccaaaaggttgtttcagtattcccacacatcttctccctgactgggagggttggaaccaacctcatttctttgtgtagtgcttttaaaaattattgtgtttcacataaggcatattaagtgtttttgcaccagatgtatgtattacatggatgtttttctttgactaatttattaccaatgatccatagtaatcaaagaacacagcaaggttatcagtaaggaattggtggaaatcatcatagtctaaaaagtgatttttgtgacaatgacagttgtcttgttgcagagcgaactttgttgtgtataacagtgctgtgcagtataaatacaatgtgagcaacataagtaatttttctagtgggtatgttaaaaatttgagtaaaaggaaacattgggaataattgtagtaaattttatttaattcagtaatccaaaatagtaatatctcaaattttgagatactttttctcctgttaagattttggaatccagtgtgcattttatgcttactgcacacctcgatttgaactaattacatttcacttgtttggaaaccacatgtcgctagtagctaccatggcaacttgaagtgtcaggggagcaaactctagaaagtttcacagaagcattttagtgttcctaggaaagtataatagaaaaatgaattgtttatctgataattagtttattatttcccccaatttttaaaagttttacggtgagcaaaaagatcaatttttaaatgtacatattttgaaagataaatactggtactgtcttaagaaacataacatcccagttatgtcctttctatcaaaaatgaactaatttatgatgcttccattgttagattaatgatttattttaaatgcctatcacttaaagagccatttaaaagtgattttagcagtaagtccttcacttaaaatatgttcaataagacttgattcatgttaggcagttggggatacaaagttaaaaaagttaaggcccctgtccttcaaggattcacagagttgtgctgtaattaattgattatgtaacagaagtttcttgtaagcatatgggtaaaagtaatattcaacaactaaaggtatttgggtgtggtaataggtattcaggaaataatgtgcagagtttttttttgagacagggtctcactctgtcccccaggctggagtgcagtggcgcaaactccagtcacagcagcctccacctcccgagttcaagcgattctcctgcctcagcctcctgagtagctgggactacaggcatgtgccaccacaccctgctaattttgtatttttagtagagatggggtttcaccatgttggcccggctggtctcgagctcctgacctcaagtgatccatctgctttggcctcccagagtgctgggattacaggcgtgagtgtctgtgcccagccatgagcagagttttgaaggctgggagcacagcagaaaaacaaaatttcaagcagagggaacagaatgtgtaaaagcacacagacatgaatagcatgttatgtgaggtgcatggcagacaacccaccatgaccacgagatagtgagtggttctgagattcagttggaaagggagataagggcctttttgcctcatacttgaaaattctgattttcttttaggtgaaaaatgaggtattggtggagttttaatttatacagaggttaacaattagatttacatttttgaaagattgttctggatgtgcagaaaatgatttagacaggatgtcagaaccataagtagagatgatttgatgcagaagatactgcagttagcgagacagagtattaggtaggtacaaaggtaattgcagtcttcgccattaaaagtaatgtcaaaaactgcagttacttttgcaccaacctaatatgatagactaaactataaacatacaaggaagaatgatgtgtaggaagtttaatacataagaattgggatctggctggatgtgttgggtcagggctgagttcagagtgaacagtgatactaaggtttctgcctttatctattcttgagaaaaatggatgatgtttcgggtttttaaaaaagtttcactttagagcagttgagattgagtgtttttagaacatctggctattgagatccagtaagacttgaagaataaaggtttggggtttatgaaagaattctagggccaataatacagatttaggaatcatggtggcattttatggcatgagagttgatgtgatcacaaagggaaactatgggggattaggaaagaaggaaaaggatgaaatcctaagaaactccagcatttagaaagattgtataggtacaaaagccaacaaaggaggatgagatgaaagtaagggaaaactaaggagaaattaggagagagttgccatgatagaaactaaggaaaggggcgttttaatgtgggagtggctagcaatgcaaatgctacaaagtgcaaaaagccaaagactaaaaagtaacaatcgggtttcctatgggcattggcaacctcactaatgtagcttcagatgagtattaggtgctaagccagccttcatgaagtacgtcagaggtccagccagcgtccacattttgaagcctgtttttgtactgccctcaagcgaggaattatttttacatttttaaaagagtgcaaataaaaacaaaaagtctgactttttgtcagagactgctatggctcacaaagcctaaaatatttactatctggcccttttcaggaaaagtttgcagactccggtacaaataaaagaaatatatttttactctgtttcaagatgcttgactggaaaagaaagaacgtgtgagtcagagagaaattgataggattgaccaaaccttcaaaatggaaaaaaggctgagtgtggtagctcacacctgtaatcccagcactttgggaggttgaggcaggaggattgcttgagctcaggagtttgagaccagcctgggcaatgtggcgaaacaccgtctctactgaaaatataaaaattagatgggcatggtggcacacgcctgtaagcccagctactggggaggctgaggcatgagaatcccttgaacctgggaggcggaggttacagtaagccgagatcgtgccattgcactctagcctaggtgacagagtgaaactctgtctcaaaaaaaaaggaaaaaaaaaaggttcatatactttgtgatacttgttaaatacaggcatatttatatatattatctaaggttggtatgataggcttgactggaaaagaaagaacgtatgagtcagaatagtagataggaatgatcaaaccttcaaaaaatgaaaagattcatatactttgtgatacttgttatatacaggcatattttttatacattatctaagattggtatgattttagaatacattattttccttattttgcagtatgcataagtttaactgtatatttggcagggcagtttatccttatattttctgttttatatggtaaaagaactgttagtacattttcttttaatccacatttagggatggatgatgtccataattatgtggattttaatgcttttacaactagaaattaatatagatgaatatataattagtatattaagtaatgtgtttgtgtatgaatatgtagcttctgtctttaatgttcttccacataaggcattttccagtaattaaaaaaaagcccttatatgatttgaatagtctgtttatgcttaagaagcatcttagtctaattgatattaatgtttcttaattttgtctcttatctgattttgtaatttcaaaatatatttaacattcaaagaaaatgtttatgttacactgcaaagcatttcttaatttgtattttccttgtttggttctttccagtaagcatatattgagcattaattaggtatccagcattatcattggcattaggaatagaaaattaaagaagacctgcttatggtctcaagtagatatagccacaaataattgcaaaactatacgattaaatttaatgtggttacatttagattaaataccctacagtgtttttattggtacctctttctgattagatgacaattcaatgtgaataacttcaaatgtctgaaaggttcatgatgcaaatcctttcaaatgattttactgtatagtcagaaaaaatttaaattcttatacaacaatttcattgtttcactgttaattatagcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaagtaagttttcatttcaattcaaagctgtgtattgggtttaagagggaccctattactaggtgctaaaggtttgtgtaatataatagaggttgttcatattttagctatattcattcagtgacttcatcatacttaaaaaaattactggatattataacatttatccagtatatatccataatataatttgttattatattataatataaataacatttatataattttgaaagaagtctaaacaaaactgattttaatcatttaaattgctctggtcgtctaaagagctaatttaaatttgccaacaatttaaaaaataagcgatattaacaatttaaaacaaacagaagaataaagtagtttttcttaaggggtactggggaggagatttaataggatttaaacgtctaactacagaagtagaagaattagagttgagccaaaaaatcagtcatgtgtttgaatttccattccaggaaggacaatttctactattattttaatgtacatctgcatctctctaaaagccaccttgagtagatcctggtcagcataattccaaaacgaaatatgtggcatttacaaatttgtaagggggttatattttcctatggtatttcatctcttggtcatttctccagtcttttctgtgatttccgcttgcacccccatgattctaatgagcatgataatttggggatgttaccagtatcttcatttacaggctgagaatttttgttgtaaccagcaagaattatgcccaactgccatgatcagtctgtttttattatttagtttgataagaaataaacgtcagtatcttagagttacgtgacataaataggactatgtacctccatattttggtaaaaattagataaaatattcagtaaacatttattcgataccttatatctgcgctcagtttcttgggaaggattaaaagaacttgaaggaagagtacttgtcctccaagatctttccacgtagctgaggagataaaacgtgactttttatggagaggctgaactgaataataattggaggctaactgacccatcttcctgttgacatctatttatcccccagatttcattcagagattcctctctcagctcttcttgctttccctgttgtttcttttcccctcctcttgaatttaaaatcatagtatctgaaagtgattatagtcaaaaatctcaacagagataaagctgtaggacaggggcccaatctttgggggcagaagagtgtttagagaaagattttaggttttcaactataattcttaataattatgacaaggttcgtattttgaaataattattcagcatttaattgcttaatagacattctaagcacttgaacccgcattacctttaattctcgcagtaatctttattattcccattttatacctggaactcagagagctttagtctaagttgtttagtgacacagctagaaaacagcagcctgaatacaaatagagatctgatgccaaatttgatcctctttacgttatacgacagtgtcttttcaattcgctgtgccaagatttgttcctttccacacagtagcacctatcagttatagcaccttcctctcaaaaattctattttaaaagtaaagatcagaggctattcatcttgccttaacccttcctcctttgcaggaatcctaaaatggctagagcaagttaaccataggtgagcattgagtaaagatcaccatttaggaggtaatccttatggcagggttacctctgttactatctgcagagacaaaacagatactgaggtatttatgaactgtgcagttcccaggactgattattttcatgattacttatgttacaaaacataagtttaaagataaggcatcattaatgctatcttattttttagacaatcgggagaagatagcaagatgctagtgtgtgatacgtgtgacaaagggtatcatactttttgtcttcaaccagttatgaaatcagtaccaaccaatggctggaaatgcaaagtaagttgtttatttatttatttttttaaatcctctctatgttttatatggagaccagacaaatcggatacctattcaaatctgtacatcatcaccatcagctttttaaaaacagctttattgacatataactgacatataataaactgtacactcttcaagataatgaacatagtcatcaccctcaaaagtttcctggtgcctcttggcttgctttgtggctgttcaaacccaaactctgtcttcctagtctgctttttcactatagattagtattcacttcctagaatttttaataaaagcttcatatactatatactcgtttttggtctggcttctttaactcagtgtaattattttgaaattcatccatattgctgcacagatcagtagtgattcttttttattactgagtgctggagataccacaatttgtgtattgaatcacctgttggtgaacatttgggtccttcaaaattttgagctattacaaaaaatgccgatgagctcattaactaacttcctacctcacttggcttctgccccttcagggtgaggcgttcagagccgggttgggggcagtggggtagtggagatagcccttggaatccaaggtgcggtttagcttttaagcttagtcttcctgggctgctggtgttgcgaggttgagggatggagatgaccctcaggtgctgcatgggcctggagcgggtttttcctggagctggagagggcatgatggcccgtgtgcgggagtggaaggcacagcattgtcattgctcttcttggaactgctttttctagtgaggaggtggagggcctgggaaaggagggtgatgtggccagaaccccaggtccccagctgggggaggaggtggagcagacgcagggagattctgtacctgcaccctgtcctcgccagtgaggtttggcacctagaactgcaagcagtattaccaggttcttttgtggtcttcagcaagtcctattaggcatctgcctgagtggtgggggttgaggggaggggctttctctcctggggggaaaaagagctgctgggtaactgtgctcagctgtggctacctgggaagtggggtctgagggctgaaggattgtgatgaactctggcctgcttcctcaggtagttcagattccttctcttgctgaatgacttatcattggaaaggaaaaactctgctatttgactgatttgtatatttacactcttatcttcactcagttcctctacttgcctttttatttttaatatgaagttgaatttgtaattcattttctttcctttcctaaggaaaaaggacatttaagactataagtttaccttcggctgtagctttggctgaagccaaatttattgtatttgtaactttatgtatgtatataccttaccgaatatctttatcttttttttaagttgtgctgaagtatgttaatttatgctttcatttcatttaatcagataatttaactaaggtaggttttttaaaataaatgtgttgatacttgtagtgactttttaaaggtgtagcatttgtgtttattaatttcatttagttagatgaagtccttttaccttattttttgacttgttgattcaacaagttgttacaattgaccactattaattgttcctatcaatttatcatatttttaaacaaataccttgtggctgttatttagcaagtaggtcacgccagtgttaatatattgtgctttttaccagtatgaaattgttctttattctatgtaatgtgttttttgttgagggatcaggaagggcaggtattttgctttgcctgacactatggccacgtagggtgttagtttaacagttgaatggttatcttttcacatctttttattttggattcttttgtgttataaaaatgttatcttttgaaaagcttaatagaggtaactgtttggattgatggttgtaattgaaatgcttggctgttttgaggcaaaattgttcttataattcctttctacttttctcttcttttacttcctgcaatgatttataattcagaatctcattttgtgaatgtaaatgattataaatgttaaagatataaaatttctcccattccccactgaaaatgaagtttttattccccttttctctgtttgatttgattaacctagattataaaccttgtcacaattttctttcaaaaatatatttcctctgttaattccaactttaccctcaatctttcggagtcttggttatgttcctttaaaaataattataaattttctgaaaccctacatgtctgaaagagactgttccctttaggctataagaacttggcacagtataatgtttcatattacaaatttttctttcttatactctgaaaacattttcttcagttttttcagtttatgctgtcacaagaaaaatcttaactttaaaaaatttaatcataatcctttttttcttcctgaaagctttgggagatgtgtgagtccccatcccccacgccaccccagcacctttttaaaaaaatatatttacttaaaaaattaccttctttacactctctaataatatctagtaactactggataatttttgttcttgctcttgatcttctttattagggttttcattatcttgagaactggtagagaattctgggtgtctttctcagcttgttctgtctcccctttggtgtgcttctttctaatttgctctttgtaatctgctattctcttttgagagtgacagaattacataatttctgggaatactattggatacttaatctttttatcctgttctatgaagggactatagtgtggtggttcaaagcttatgctgtggagtcaaaatgcagttttttcagttactaaattgatgatctttggctacctgtttaacttccctaagtcagtgtatagaaggttaacggtacttacctcacagggatgttggatttaatgaagtggtatctataaagtgcccagcacaatgcctaacacaaagtaagtacagaaatagttaccagagtttttcatggattgaaaggtttgtcctttgaaccatttgaagagtgatcatctttctctgctgttaaattcttctgtagttctctctgtagtcttgagtcataatttgctcatttgtttgcatttaacttttgagtgtttactgtgtgtgaaactgtagtgaaggctggagatgttgggacaaatcagtgtgcccccacagggctgtcagtctagtttggggctgctccctggtgagctggagtgggggtaatcttttcaggatctttattgtaaaccagtcattgtcagataggtttctttttcctatttttatctcaagaatgtctgtttgttggtatgttatgtgtttttagaaagtttttacttgaaaataagttcaaactctaaaagttggagaaaataaaaataatacccatgtcgcatttacttagatttatcagttgttagcatttcattgtcactgggcatgccctctcttgctttctctgtgtgtgtgtgtgtgtgtgtgtgtgtgtgtgtgtgtgtgtgtgcgcgtgtgtgtgtctgtgtttttgtctctattccccctaaccccctactatttgagggttaattacatacgttgtgcctttttaccaccatttcagtatgtatttcttaatagtaggaatattcttaaaaaatcacaatcctgctatcaacttcctaaacttacatcaatgtagtatgtttatctaatgtactagccatattccagttatgtcatttgatcttatgtccttcataacctaccccttcctccaagtaggttctaggatttagtttttgtcattggtatttttgaagaatagagttcttctcgatatacttgtttttttctttttttcaaacaaatttccccattttgtctttgatatccccttataattagatgagaggcatgcattattggccagaatactgcaaagtactgatccatcctcagggtatcacagctggaagcacacattattccactttccctcatgggaatcacctggtcaggctgttgtccaatttcttttccccctcctttgtatctaataaagcagtatgtaaggacactttaagaccatgcaaatatcttgcttttcctcagaatttccttctagatttgaaaaacttactccctaggctgggtgtggtggctcatgcctataatcttagcactttgggaggctgaagcgggtggatcagttgaggtcaggagttcgagatcagcctggccaacatggtgaaaccctgtctgtaataaaaatacaaaaattagccaggcatgatagtgggtgccatgtaatcccagctactcaggatgccgagacaggagaattgcttgaacccgggaggcagaggttgcagtgagccgaactcatgctactacactccagcctgggtgacagagatagactctgtctcaaaaacaacaacaacaacaacagcaacaacaacaacaacaacaaacttactgcctgatgatgccattttaacctgctttgttttggttgcaaatgatgcatttccagctctagcactcccaccgcatttaccagttagccctctgctttcttttgtaagcaagaacacttctttcacatgttaaacttacttattaatactgactcatgagctcctattatcttcaatcatttacaactcattacctaattattttttggctgaaatagtcccatacttgctgtcagttgctccttcaagctggcgctggtgttgtgccctcaccacttacttgaacacttcatactttttggtgtaacaagatgttacaagctcatcttatacctcctgtgccccagccctggaataagtccattgttaaataagtaacccagattcctttagtggggaatgggtgctgggtgtgctcattgctactgaagggtgtttgcttcttcatcctttcagcaggtggtgtcaggaaatacatgcgtgtgtatacacttacagaagtttgtccaacccatgacccgcaggctacatgtggtccaggatggctttgaatgtggcccaacagaaattcataaaatttcttaaaacattatgaggtgttttttttgtgtgtgtgtgtgtgtgtgcgtgtgtgtgtagctcatcggctatcgttagtgttagtgtatcttgtgtgtggcccaagacaattcttcttctttcagtgtggtccagggaagccaaaacattgaacacccctacacttaacgtatatacacataaatattcatatacatatgcataacttagaaataatgaatttacaccagtacctccagttcttgtccttctccactgaattctttgccttctcattcttgcatgtctgttcttctacaataaaaattctgggttgtagcaacatcagcacatttattcagttgctcaatctaaaaagcaagtctgcttcagtttgctctcagtaatagattttattcccctttcttttcttagtgatttaattttttaaatatagaagatattagtatactttcaaaactcaatactatatgaagttttactcagaattgtcactgcctcttgtttattatttatactccatttctcccaacctcttggaagtaactaacttcattgttttctgttttaaacctcctgttatttttcgtctaagaataagaagatatattgctcttattttcagtgaaggtagcatgttgtgtatgttcttttgcatgttgcttttttcgtgtaataaaatctggaaatcacttccaggcaagttaggcaagttcaagagatctcattctccttttaaacagctgcatagcactccattgtgtatctgtgctatgggttactcaaccaatggcctgtgctttggtatttcagtagtttacgatattttgcattataaatgattttacactccctagctttgtgcatgtgtgtttttgaattctcagggacaaatctgtagggtaaattcctagaagtaggattattgcctcaggagtgtacacatatgtagctttgttagatactgtcagattccctttcttggggcttatggtactttgcattgccaccagagatgtgtgagagaacttttcttacgtctttgctaacaggatgacttgttcagcttttgaatgtttgtctgtcttctgggcgaaaagtggtgtatcaatgtagttttaatttttgtttatcctgagtgaagttgatcgttttttcatgtgtttaagggtcagttttaatttcttctcgtgaattgtctgttcatgtgttttgcctgttattgaagattttggcattttcccctaaatttaagagttctttataagttagggatgtaagcttttatctgtgttacatgatgcagatactttctgccagcttatttgttcttgttttttttgcttatttgtgtgagacagtgtctcactccatcaccccggccatagtacagtggtatggtcatagttcactgtagccttgacctgggctcaagcagtcttcctgcctcagcctcccgagttagctaggagttatgtgtaccaccaagcccagctaattttttacttttgtagagacagggtctcactatgttgtccaggctgtattatgtgtcttttgactttgtttttattattttttttttgccatgcaaaagtttctttcttatggagttagatttattaatcttcttttgcttctggatttttgagtcatattcagaaagcctttccctacactgagggtatagaggagttcatattttctgctaggatttgcagtttttatgtttattttatttttgagatagagtttcactctgtcgctcaggctggagtgcagtggctcaatcttgggtcattgcaacctccccctcgcgggttcaagtgattctcatgtcttagctcccccaagtagctgggattacaggcatgcgccaccacgcccagctaatttttgtatttttagtagagatagggttttgccatgttggccaggctggtgttgaactcctggcctcaattgatctgcctgcctcggcctcccaaagtgctgggattgcagttgtgagccaccatgtatggcttgcattgttttattttttacatttaaatctctgatctatttggagttgatgtttgtgtatgatgtgagtatctttttccaactggctattcagttttctaaaaaccattcattaaaaagactgtctttgccctagtgacttgagattccagactacaatgttagatttgattgaacttatatctggaacctcttttccattccatcgatctgtctattcattcaccagtacgacactgtttttgttatagagcctttgtagtatctggtaatgttgggccccttcagaacttatccatttcacaggtttcttatctgtgcttgtgtatttgtttttctgtataaactttaggatcaccatatgtagccccaataaaaacctcattggaatttttattggaatcacatttaatttattgagtgtctgggtgcagtggctcacacctgtaatcccagcactttgggaggccaaggcaggggtgttgcttgagctcaggagtttgagacaaacctgggcaatatggtgaaactgcctctctacaaatacaaaaaaattagccaggtgtagtggcacacgcctatagtcccagttactcagaaggctgaggtgagaggatcacttgagcccaggagttcgaggctgcagtgagccatgatcatgctactgtattccagcctgggctacagagcaagaccctgtttccaaaacacacacacacacacacacacatatatatatatgtatatatatatatatatatatatatatatatatataagtgagagttgattgacatcttgattttaagacatcctaaccaagaacaagggatgtctttacaagtttgttaaagtctagttttgtgtcttttaggagtgttttataattttcttcatactgattttcaacatttaagcttattcttgaatatttatttttctgctgttataaatggggttttcttaccatcctttaactcgttatttgtgtgtgtgaattctattgccttttgcatgctaattttatatcctagtactttgttgaattcttttattgaatttttgaacaattttctaggatgttccaactctgtttacaaattaagagttttgtttcttcttttcctggtcttatgtttctgttttcatttgtttcaatgcttgcattggctccagaaccatgttaaaatagtagtggagataataggcacccttgctttttcctgtccttagtgggaatgcctctcgggctctcccataaaataagatgttgcctttagaattgaagtatttatgttggtcacattagagaaatacccatccatttttactttctcaagagttattagtaatgggttttgattcttcccaaagacttctttctttaatcatctgttgcattgaaataattttttctcctcagaccttttaatttgttaaactttattaatggatttttctaatattaaatatctttgaatttcttgtataaactccacctgggcatagttattattttcttaatgtggtattagagtctgtttgatagtattttatttaggattgtttttcttttctccttctcattagataaaggataatacattcttttaaaaaatatatgtgtatgtatttcaaaagatggggtctctgtgtgttgcccaggctgaattctacctcctaggctcaagagatccttctgcctcagcctctcaagtagatgacaccacagttctgtgccaccgtgcccagctatttaggatttttgcatcagtgttgttaagtgcattcattttaatctttaagactagctgatctatggttcctggtagtttctctttttaagtgagcatccctttcatatcaacctggtagcacagaaagataaagttcccttttattgatattttagattcaaaatttggggtgggtaatgagagccccacaatgtattaaccttacacccagggatacccagggttttaaggctgactagctcacaggcacagaagtagttttggctggcctctggttggccttttacttcataaacaattctaatttggtaaggataggacactctctctattctaaaaacatgaagggccatcattggacttttgatgtggagcaatatattttcacattttcagacaccaagtcacatggcgttgaccgtgctctgtgtttccccacccaccatggcagtctcacattgttgcccaggcttgagtgtagtggcgtgagctccctgcagcctcaaactcctaggctcaagcaattctcctgcctcagcttcccaagtagcagggactacaggtgtgcaccaccatggctaattaaatttttttttttttttttttttttttttttgtagagaaagaggtgttttgccttcttgcccagattggtctcggatccctggcttcatgcgatcctcccatcttggcctcccaaagtgctgggattactggcatcaaccatcacaccaggctggccatgctattgttttagagttgagcagacttactccacaaaaattacttcctgctcctagcatatgtttctttttttgaattttgagttgctgtctttttggttttatctcttccacctatatgttttcctggatatccccattcccttatttaaattttcctggagattttagtgcagattttgtgaggccacatcagacattgaaaacagctttttaaaaggtgtataccctaaggccaggcgcagtggctcacacctgtaatcccagcactttgggaggctgaggcaggcagatcacttgaggtcaggagttgaagatgagcctggccaacatggtgaaaccctgtgtctttagtaaacacaaaaattagctgggtgtggtggcacacacctgtagtcccagctactcaggaggctgaggcaggagagaatcacttgaacccaggaggcagaggttgcagtgagccaagattgcgccactgcactccagcctgggcaacagagtaagagtccatctcaaaaaaaaaaagcatgtaccctaaattagtgtcatgaaaataaaagcttaatgtataatccacaaatgattcatgactttttaaaggtttacatcagaactacaattacaaatgcataacaaactgtttttgtttttatttttcctggtgtttagaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtaagaagatagttattctattcagttgttttgtcgattgttttattcatgtggtcatttgctctaccatcttacagcttctaagtttttatcactctagcaattccatcagtactgattgctgttatagatggaattaaatgatgtttttgagtctcaaaggcataaggaagtaaatgggcaaaagataagaccagaccacatcagaaatgagcactaatagggaaaagtaaagagaaaatagcttaaaaatgtcaagtaaaaatacggcagcatctctagtgacatgcacaaatgtgctttaaaaaacctttgtcagttagcaactcctctaacctctctcctctcatacttaattaactgttttcatatccagcttttcagcaatgccttctctttacctagataataactcgatgttagaaatttttatttaagtatacttatcactgcaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacaggtaaatttgagaatgatttttttttaaattttttgtttttgtaatgttgtgccattgtatcaccaatatattgctttaatcaggaagagaggatcctgtattccagattccatcttgttctcagtttctcaacctttaaatgtatttgttatcttggtcatctctgaatctgatggctaaaatctaatctaacttaagatagttttttttagtatttgaattccgggtctagtgtgctttccttcacttgtgttcttcaggccgacagtggaagttccccagtctttgggtttgcttagtttgttctttataatgtgggttatttttctctaagcatgttgtagttttgtaatgtccttcttaagttaattatcaccttttcagcccaagattttgttcaggtatggaatatttttagtagtatcctactgttaaaaacatgagtcttagagagtaaaggaaatagaactgctcgccagattgtttttcattttcatcattatgagtggcagcttttgtaaaacttctctttatcatcttcaaggataactaaacatcttaattactaacctttcatttccagaatgccatcagtatttagttttgaaatatccttttaaaataatgtgccagttaccttttaaaaaaaattgttttagagatgggttctcactatgttggcctggttggtcttgaactcctggcttcaagcgttccttccgtcttggcctcccaaagtgttaggattacaggcatgaactaccacggttggcccaccttttgatgcattataattttcatgttttttaaaaatgtaaatatacatgtggttcaacagagaaaaatctgaagaaaaacttaaagcatttttggtgatgatttgcccttactcatacaaaatcataattgttgacttaatgaacaaagaaaaaaactcattctgagctaaagaattaataattttttgttaagattataacaatgaaatggaagttgaaggccctgaagatcaaatggtattctcagagcaggcagctaataaagatgtcaacggtcaggagtccactcctggaattgttccagatggtaagaatgtttaatggatatactctgtttttgaagaaaatgtgtatatacaataaatatgtgaatattgactaaaacttcagtaaaagccaagatgcagtcacttaggaagagttttttagtaaaataatcttagacaaattaataggagaaaggacatgcgtgtatttgtagttcagctaccatctagacttaatcataagtacttacttggttaagggaccaagtgattttctattaaaaagcaattcgtatttttatttctttagttgtagttgctaagtagagctgttgctgatgatgagatgtttcatgctgagataatgaaaaatttactgtattggatcatctcagcagtcctattgagggttatttcacttatttccatgatgtttcaattaagctttttgtagtaaatattgataagagctattattgtacttgcagatctggaattaataagagaccatgttgggggaaaactacttgttacatttaatcacaggctcatctgaaagtctttggtgttgtatgtgaagttgtatgttcaattatatagtatacataaaaattataatgtatacataaaaagccactgagatgttttgaaatttattaagtttacgtataataactctcattaaaattattttctataatctttcttgtgaggtctagttgttaaagaaaaagagaaaaagacaattaaaaaatttttaccatagtgcaaagacttctaattttgtcttcataacttactaataagtggtacaatgtttcatgcttatattggaaattgacatttagtagaataaaactctttactcaaattactgttgagggaacagtgttacagaaattttgactccttagagattttataaatgtgttactcacagcggttcaagtccacactgaagagcaacagaagagtcatccctcagaaagtcttgacacagatagtcttcttattgctggtaagcagtatgttcatattgtctaatttgattgagttacaagataatgtctttatcccaaagacatttttgcgattgctgtatgtatatacattacggtaactaaatcttttagttaagagattctggaaaagaattgacaatggatctaaagaaggttagtttctcttgaaaggttttttttttttttttttttttttttggaggggggaggtcatgattaaaaatattttgtactttcagatctgttacttggtagttttcttttatccctacctgtagtctttcaataaagtgggaaagaagatgagatttcagtttgatatcagaacatgtataggcctgggcgatatagtgagaccctgtctctacaaaaataaaaaaagtatctggggatggtgacacatgtgtgcagtcccagcagcttgggaggctgaggtgggaggaccacttgagcccaggaggttgaggctgcagtgagccatgtttgtgctactctactccagcttgggtcacagagtgagaccctgtttcaaaaaaaaaaaaaaaaaaaaaccagataaattttagtcactgattggtaaatgaggctagcagtgtctttttactataacttaaaaattaccttgatgagattgagttaaaggtttaacatactggtatcctgatttaaaatttaccagtgactatgtttctgatatctaagtttatagatttcctgagattagtcttttaatttatagacagtgatgaagaacaaggattatatccaaagaatattttgggtaggttggcaggtatggttaagcaaaataaatattggtggttagtaaatcttttctgtctgtgcttttgagtctatagtaactttgttacatctgggtatctactattagaaaatgcctacacattctagatcactctttactttttaacttaggtacctcacataacatgattgatcctcattttcttaactaaaaaatgagtatgagaacttttcctgtgtaattttcaatccatttggaaatccttaagttgtaaaacataatgttttcattaggttttctggtgtgtggctgattctaatccataaatccttgtgtactttggctttcattcacttaataattgtctgctttgatgaataccttctgatttaagttctagtgtagccaaatgttttatatatctatagttagaaaatttaaaatttgtttgtacattgccataacaaatgttctgaattttgtagtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacaggtagggtgattttaatgatattgacagaaaagatattggaacaattctataaaatcagaaggtatatgtgtagctttggtgtggatggcaactttttctgtcttcagatagaacttcagtgtaatgttgattatgtgtttcagccattattttttaaatgctgttaatgaagaatgccatttattaaatttgaagtgatcttatttggaatttcaactcagttgggccataaagatgcaacctattgataatagtttctaatagaaagaactttaaaaattcttttagttctgtgctgcagtaaatatagagcctaaaatacagtatagttttgggtatacagtaactaacatctattatttccttctaatatatttatttattgatattattcattgtatatatttttaactggataaacatcaacatttatgacaggaattttccatgctggggaatttctcattttgatgtttttattaattgctaactcttgtgggatttcttttttcaagtaggacttatttcagtagtttcatggaaaaaaatcttagaattgtactgttgattttcagtaagtaaagataaatcttcctttgtctgctttacatcatgtacattctaccctttaagaatgagttccatttctttttaagtgagatttaagtaaaactgcatggcaaaatgaagatactgtaggtacgaattatttattgttttacaaaattgctgctttctgaagtgttttttaaaattgcaagataacaaatagtggagaagtgttaattcacaatagtaatttggagttttaagtttcatgattgaaattgcttcaagttaagttttaagtttcatgatttaaatggattaaagtttggctttttataggaataatatattgattttaatcgtataatttttaaactgtaaggccaagcttttaagaaaatcattttttaatgtgaaaattagtctcctctatatcaaacccagatatattttattctctaaagacaaggtacacgaaagggaaagtagttgtcagatgggatttagctgtttctgcatggcaaaagacgtgtgcagtaaaactaggccactctttatatatgcctttttctaagtattttccttgacagttatttctgctctaccatgaaaagtttttcttctcaaaccagttgtgctcctttctagtaagtttttttttgttttgttttgaatagttatataataattatgttgttctgactctgaaaagactttaccaatggaaatttgaatctcaaatttacttttggttgatatatttacattctttaaagatactgcttcatatgtattcctgttaaattttacttatctctccttccttgtagacttttgtttcaattgagaaaccaggttcaatacattaggactctttttctgtagactttatgttccgaaatattggggaggggggtgtatttccaggcttattccatcttatatgagccatgtcctagtattttgctgagctgtctttgattcccaaatccgatgataatctttctatttttctgcccctcttgttactacttcatcatttgctgctactcttgtaagtattttgtaggctgtgttttccctccctccagctttttagttttccaatcttggttttagttatctagcaaacagccttcacttgatgatgaacctgctaatatagtgctgttattagggagagtatgaattgaatagtacaagatagatcttccattggtgaggcactgggaccataacttgcaggaaatattctacagttagcaggaatgtgtatatccgtatattagaaatactgaagttcagtattctgttacatgaatttctttggtattaggcatttctgtattatacttctgtttttatttactgtttcttctacatattcttcacgttggggattggctgtaaaataagctgcattttcctggctgtgattgtgatgtaagcaagattctttggtttccagctattttttgttaacatcactggcattttcatattttgttgaacattaccaattctttggtctttaccagtaaagtaaatactaaccaaagaaatgtagatttaccttaagttctgtttcatggtgggcaaattattaagttgattttaatgattttctataatagtattatatgagcttttctaggaattcacttcaaaattaaacgaacattttaataggaaacatctgaaagatctagtttgtgatagctagtgattggattatcagatgttatctggaggtacaagctagccaactagtagaacggtaagccagtgctgtctaatataaatataatgcagaccatatgtgtaattttaaattttcaagtagttacactttaaaaaaacaaaaacaggtgaaataaattttaatctattttatttaacctggtatattcaaaacaatatttcagcatttagtataaaaatgaacaagatgctttatacttaaaacatcagttctggctagctgcattagaagtgctcagtggtcacatatgatggtggctgccttattggacgatgcaagacaaaacattttgagaaatataaaaacagcagttccggaattattggtgaaattaaaataccaaaagaattcaagatcgacaaactaagactgtggctgtgctttcacaatttttaaggactgaagtagaaatattctttttctgttgttcatggaacacattttaatgcagataattgctaaaccatttgttgctgcaacaaatctttcacattttcaagtatattcagttttaaatatataatccaaataacccaatattggagattttctgaaggtgagatgttaggacacagaaaatggaatttatatctcaggtattggacatccattatcaaatatcaaatcatatagaattattttcctttaaggaggttagtaattaaagtttagttttttgtatttttcctttcatatggaatatttcaggtgctatttagtgagaaatatgatgcttattttctttatgacatgtttcaaatatatctcaaatgtatgatttagaacctaactgactacaggaatagtaacacatttttctgatggctgtgaatagaataagattccttttgttttttgttttcttgcctattgtagacgcaggatttcacaaagatgaggaaaaattagacatgataaggtaggagaagtaacagacagcaaattggatattgtttcatacaaattgtcctaatgacctagttgtattttctcatcttttattgaagttatctattcataaataatttagtatttcatttttcagcatttaaaaatattttttatttttttatagagatgggggtcttgctgtgtagaccaggctggttacgaactcctggcctcaagcgatccttccatctcgggtctcccagagtgctgggattacaggtgtgagccccacagcgcctggcccatttttcagcatttttataggtgtatgtactttgcgacctgggtttaagaaagtgattattgacactgccacatattgtaatcaactcggtagattttagaacatcaagctaatggccctaccctagaccaattaaaatgcacttctaggatcatctttaactgtaaccctgaaagcggagttctgaactagagaaatgtgctacttgtcttactgatttttaaaaatgcattaaactgaatactgtaaggaatgctctttaaaaatggtggaaaataaagtggaaattttaaatttgtcatattaaatcataacatttgtttttatttctgtcttcagtccatttctctcattgcacagttgtattcccattctaattaggaaattctgagataataatcttaggtcttcttgtattatttaccctgtatgtatcatcacgtcttatagaaagatattgaatgtaatcacactactatgatctagttcagacaccttcatgttctaattgctttcatgatggtattgaaagtttttattaagcattttatgaaacgtattatttgcagtagacatttctttattttatttttacttatttatctgtttattttgagattgagtcttgctctgttgcccaggctggagttgtggcacgacctcactcactgcagcctctgcctccctggctcaagcagttctcctgtctcagcctcctgagtagcggggactacgggcgcacgtcaacacacctggctaattttttaaatatttttagtagagacggtgtttcgccatattggttaggctggtctcgaattcctgacctcaggtgatccacccgccttgtcctcccaaagtgctgggattacaggggtgagccaccacgcccagcctacagtaaatatttcaagaaaatttcataaatgaaaacataggtactgtattttgatatctcttggacaaattataagaagtttactttatattataagaagagtactttcagttttaaaagtagccagagaaccatagtgttaaacctaaaaaatacctacccctttggaacaccaagctaacaacacagccgattagaagtaccagactttccttttagttcacttgtgcttgttgtggtatttttggagatattactgttgctagtgccacctaatttgtattgtgaaattattgaaggctaaagctgataatagctgtttctgtagttatcaaaacaggattaggtctaatttcttgttctacttgatatcgaactcaattttatatatgagacttcttttaagaattccctaaatagtgaagtgtttgctgctgtagctccactgtatacaagtgattatatttaccaaaaagacaaactgtaaactcttttgtttcttttaccagttatcttcctttcggctctctctcttcattgctttcacttttcctaaattagacttactgtttataagcaaccttggttttacatagtatgttggaagagtgtggggctggggttgatttaggatttggaggtgtaaagtttgccagtgagacaccaaaccttctctggctgcttttaaaactgatagtactcttgggctgtaagagtgactttgatcatatttaacaaccagcaatagaatttgacttttaatagaaagttgcttctaaatagcctatcctccacgtgtcattattgttctcatttccccatcccacagtccttgtataacttactagcttggacagtttacctgagaaattggcctcaaaacagaaagaaacttaatgctaatattaaactgtttttgggttaaattatttttcttgggttcaaattcagtccctgccaggtagtgtttttttagtttctgtagtatttgatagcaagttgattctatttacaacttaataatgattacattaggaactattttgcttttaattcagtttgtagattaaggaggcattatatagattttttagtaatttttagtaactttttttaagtgaagaaattcaagattctaggttattactggtggaggcattagtgtgtttcatatcatagttcattgtttattgatgaattcatacacatatgcaaaaaaagataatagatgctcagcagaaaaaaagttcaataagtgctgaacagggtgcttaacatagcagtgaacagaaaggggcatgatctttaattacagtgtaaaaagtgctgcaactggattgtaggggaagagcccatacattacaggggcagctaaccttttctgagtggtttgtgtaagttcttgatcaaagctaagatctgaaggataatttaaactttggtaattatagctatattttagttttaaggtctaaggaatatactagataatttgtcagaatatctaagtataatgataatttttcttcagaactataaaattacacaaagtctgtcttctttttgaagtgagataaaattttggcatcaaagctaacttttaaattatgatgaataatacataattaccagaaaattcttacttctgaaataaaattattcaacattatttttatcttagagtacgactttctgtctcatatttttgagaactgtctactgccaacataatattaaactatcgactaaaaggaatttaagatgtatgttagccaaatctcagagaaaaaccaatggaaatattgagagaagtaatttaggtatcttttgcccccactgcctaccactaaataaaattacaaacaataaaacgtcctaggtggtgatgcaatgagaggcactaatggtgtggtaagagagatgatggttcaccgggagcactaaggaaaggtctgctgttgagaaaatatgtaaggccatacctgaagggttagaaaacgccagacatggctggccgtggtggctcacgtctgtaatcccagcactttgggatgccaaggctggtggatcacaaggtcaggtgtttgagaccagcctgaccaacatggtatcgctcctaaaatacaaaaattagctgggcctggtggcgcatgcctgtaatcccagctactcaggagacttgaggcaggagaatcgcttgaacctgggaggtagaggttgctgtgagccgagatcgcaccaccgcactctagcctgggtgacagagcgagactccatctcaaaaagaaagaaagaaagaaaatgccagacatttattgaggggctggaatgatatagtgaagtgttctgagtcagtcgggctctgattgataaagagcttggcatgtttgaaggacagcaaggaagccagaatagctggagcgtagcagcggggagacaaatgccacaaggttagttggagaaaggcattgggaaaggtttgtcttttaagtgctctgagaagcaattgaaggtttgaaatagaatagtgacttgcttgatcacatttgtacttttgaaaagtttctctggctgctgtggggaaaggcttcagtagatgcagggtcggagaagcataaccagcagtagactcttgtagcaggttaggtgagagatggtggtggccacgactgagctgctagtggtggaagtgacaagaagtagaaggattggagacaaaacttgaagataaaaagtcttgaatttgctgatgatttgcattgatgaagtgttgggggagaggactgaaggagcaaaggagagtgacaagggactggatgccatttataaggatggggaagactgggatgaaaccggttaagggagaaattttaaacatggcaaacttaagaggggttttgtgtgagaaaatggaaatgctaagaaggaagttgaaaatcctgctaatttggagatctttgattaaaactagaaataagaatatgggaagcatcaacttccaagatgccctcattgtagataataccatttaggatctaggctcaagccctgggaaactccagggctttggaagtcaaatagaggaagaacacgtacaggagatgaagaaagattagcgaggaaggcagtgaaatatccacaggtggactgctgccaaatccagcagaacagtatgccagatgtcaggagcatgagtaaaatgagaaaagagaaatggcttttgacaacacttccttactaatagtagggaagaagacataggtacagattcaagttgattggaaattatgaaagtgaggtaattgacctgcagtggttgctgctcagtgaaatcagcatagtgattacctgagctaggttagagatttgatgggtaagaaagaacacctaacggtaatcctggagggaaaaaaataaagtgtttgctggagagaatgagttggattgctggacttcaatgtgtgtggattcagtttgtgacttaaaaatgaaaccagtctattgcttgtgtggcttttctcaaaatactgttattccattacctatctcttaccccaagagtagtcacattcttatttctggttattttaattcctggtggtatttttatgtgattaatgagatagtactttttaatttgatgatattctagaaacctggtaagtactatgtaccttgtcttaagttttggttacttaattggtaaaattatagcatgcaccattgaattacctaattcaaaatatattcttttattgtttgacatttgtcttgtttttctttaaaatgttatctttgtggagtaaacatttttctttatgctgtttagcatcttcatcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatgtaatttccataaagtattcatttccctaagtaaaaaccaaaaccaaaccgacaactaatggtcactgaagaaagagtgattaaatgcttagattataatggtatttgcattttaatgttaccagctctctacagtttaacgtgtatgcatttatcgattgcttatgtttctccttgcattctttggcctactggttttggttgtttatagctatagaatatagaattccttatggttatccatttctccttttaagtagagtgatagttgttagaagaaaaataaccccccaatactttcttctagtgttaattcttaaagtgtgattgacttttatttactttttggtgcagtaattgcagttcatgagtcaatgttgatgtcctataaaccttaatttttaatgtttcattgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtggtaaataaaattgcatttacattcatatatcatttctgtctgatttgttttgccctactggatgttaagaattaaatctttcttttctagattgagcttccaagaaacactttttaaatctaaaaattttaatgtaaagaaataatatgcttgcatttaaaaatcaagtatacatttttaatacctctttttatggttaattccttttgttgtgattactactgtttttatgagggagaagtccttgacatgtagaccaaaaggtaattaaggaccttttcattcatgatatcataaaaccttgttgcttagaaaaaagcaaaagaaaaagctccattaatttattatgttctcatggagaagaaataccaaaattgtggcatatttcattgtctggttaataccttaaaatgacaaggctttttcccccatgacattggttgatggctctgccagtccttgaagtgagttaagtagtgtgatgcattttgaagagaaaaaaattaatttgaaaaagtattaactcaaaagttaaaatacttcattgactggagatgacagtttttcttcatattctatatttaatattctggaatatggctgtttaatttagactaatcaaggattttaaggaattctagattatactttattttctttcatgactggaagaactattgttttttaacctccctacctccccctgatatcatccaagatattgaggtataaatatacctcatttgacagtttgataatatagaccaccaattttcacttactttttttctgggtcagcatttcatgttcgagaaaataaattgagagattactgtagtctcgatttttaatcactaacttaatttttcaaaaatcttttataccaatttaaaaacaaaacaaactcggccgggcgcagtggctcatgcctgtaatcccagcactttgggaggctgagggggcagatcacttgaggtcaggagttcgaggccaacctggccaacatggtgaaaccctgtctctactaaaaatacaaagaaatttagccgggtgtggtggcatgtgcctgtaatcccagctgctagggaggctgaggcaggagaattgctggaacccaggagacggaggttgcagtgagccaagatcgcaccattgcactccagcctgggcaaagaagcgagactccatctcaaaaataaacaaacaaaaaaaacccccaaaaaactaacctgacgccatccatctgttgtgcaaagaagctgatgcacttctcaaaagggatctcaaggagagcagggtaagagaagacaggagtggcagtttgaaactgggagctggctgtatttgttacatccaaagggaaaaaagccattcctcccgttccttttgttcatgtgtatctattttatgcttacagtatcaccataaatttttgacttggaaaccattctgctaaatagggaataagttcatttcaaactatgataagggacatcagttgaagatatgacatattatttaacttaactgtgagggaaacatctaagtattttcctgagcatctggataattttaaatatacataattcatctacttagggaggtgccaggttttttcaaggagtaattaattagtacaaacaagggtgagggggcagggaacaccatactctggtacttaatgtctgaaattatcagggaatttaacacattttcccataggtttatttcttgtgtaagaagtcagataaattatttccatttcaagtatttattattcagattatttaaagcaaagctttcacaaagccttttgtcagctttcctataatcctcaaataatttttcctggctggacgctttggcttactcctgtaatcctggcactttgggaggcagaagcaggaggatcacttgagcccaagagttctaggctgcagtgagctatgatcacaccactgcactccaacctgagtgacggagcaagttcttgtctcaaaaataaaagtaataacaataatgataaattttcctctaaatacaatggtgaatgaggtagaaatgttgagttcataagagaactgttgaatagtgaaggaaactgacttaattttaatgagaggaagaatactgttacacaacactagcaaaaatgaactttcacgctgatgtagcagtacagaatatgcttccaaccccgggacgctgcagccagacttgctagctaagtgaccttggacaagttacttaacctttttattcctcagcacactcatctcaaatggggataataaaacctactatatgggattgttgagagtaaaaaatacttagattagtacatagtaagtactcaatagatgttagctattattgtaatcaccgcgagaccagttaatgagagagttcttccttatacttactctatattgaatacaatttgttgcacttcgaaatatctggatcaggctatagttgttgtcgtcaccaagaatgtaggagtgggaaagagaaaaatcatgcaaaggcttgctgatagcattcacagtgacaggcctaaggtatgattctaaggttgtaagcattttatatttagatttttaagttgtggagtatacgtttaaagataaaaataataagccaggtctcttaatacttatctaaggaagtgtttgtgtaacatttaataaaatgttttatctcagtggcatttggatttaaaaattattttggtctgtcacagaatgttgacttttcccaatctgttacatagggccgtgggtctggatttccaggaaagcggagacctcgaggtgcaggactgtcggggcgaggtggccgaggcaggtcaaagctgaaaagtggaatcggagctgttgtattacctggggtgaggcttgcttcatgtatattttctctaatctaaatgtcagttaatgatgaaaatctcatagcaagttattttgatcttaagagtcatataaataggtcaaaatgtttattttactgtcctactttgcttttttttttgagcctctggttatgttttcttgtatatttactttctcatcctttctcttttcttaccttcctctttgactccttatctttctatgccaaccctctctaaaaagtcagtatgtaatatagttgctcttttatttaaaaaattttaagattgatagatatttgcttactatcatgttatgaggctttatttatatgtgtattgcaaatatatttgctaactagcaaatattttatgtaataacttcgctattttattaaaattctgtttttaaaattctgaaatgtcattttaagtataggagacaggtgaaattgttcaagtttactactaaaccaggaataaggaagcttagattcttgtccttttttcaaaaagaaaaattttaaaaccaggcttattgaggtacagttgatataagctatatttgacatgtacaattccataagctttgatatatatatatatatacacccttgaaaacgataccacaatcatgatagtgaatatattcatctcccaaagcttcttcatgcccctctgtaattttctgcattccccctgccatccgtccttgtccccaagattagtttgcattttctagagttgtatataagtggaatcatacagaactgtacactttttggactgatttatttcagcacaattatttggagattcatctgtgctgttgcatttgttaacagtgtactcccttttcttgctgagtattaataaaactgtggatgcaccatggttgtagacctgtgcacttttttttcttctttttttttctgagacaggttatcattctaattcctggctggagtgcagtggtgcgatcatagctaactctagcttcgacctcccacctccgtctcccaagtagctgggcccataggtgtgtgccaccacacccaactccttttttaaaatttttgatagagacagcatctcactatgttgtccaggctggtctcaaacttctgagctcaagcagttttcccaccttggcttcccaaagtgctgggattacaggcgtgagtcaccatgccccagcctgtagtcttacattcttgtaatgtcttcgtctggttttggtatcagcataactacagcttcatagaatgaatcaggaagtatattctcctcttcagttttctggaaaagttgtgtagtagtggaaatgtatcttcttatattatacgttaatttattagtgaaaccatcttggcctgaaattttctttgtggggggtttttgttgtgttttccttttttttttcttctttcttttgagatagagtttcgctcttgttgcctaggctggagtgcaatggcacaatctcagctcatgcaaccactgcctcccaggttcaagtgatttcccctgcctcagccccctgggtagctgggattacaggtgcctgccaccacgcctggctaatttttttttgtatttttagtagagacagtttttcaccatgttggccaggctggtctcgaactcctgatccacctgcctcggcctcccaaagtgttggaattacaggcgtgagccaccatgcccaggctggagtgcagtggcgtgatctctgctcactacagcctccacctcccaggttcaagcaattctcctgcctcagccttctgagtagctgggattactggcgcgcaccaacatgcctggctaatttttgtgttttgggtacagatggggttttgccatgttggccaggctggtctcgaactcctggcctcagatgatccgtctcccaaagtgctgggattacgggatgagccaccagtgcccagcctgtgggacagtttttaacaacaaattttatttctttaataggtacctatttaggttatctgtctctccttgcataaatttgcatctttcaagaaatttgttcattttgtctatcttgacaaattaaaggaatggagttgatcataatgtttcttattattttaatacctgtagaatctgtaatgatttcaccttcctcattcttgatactaataatttgcatcttgtcttatttttttcctgatcagtctggctagagatttatcaatcttattgaccttcttgagtcagcctttgttttcatggacttttgtctattttctttcccctttctgttttattgatttttattatcatctttattttttcctatcttctcactttgagtttaatttgatcttctttttttgtttactcttacgtgtccctgcttggaagggacacttgtgaagtttaggtcagaactttctattctccttggctcatatctgtggtctaggaaaatgaaatttctatcaccttctggataaatcacactattatctatgcaggcaacaatagcacgtattttctcaaagattacctttgccctcaaggtaggttttatttttctagcagtctaacggtcatgaaataaattataaaataaaaacagtgggtcttcaagctagatgatactattttctttcttgcatggacaattattttaaaatattttggtttttctgcacttattatttaaatatgacagtatgactccccacccccacttgaatctagggacattgtagttttctactgcagactttgtttctggtttatactgggaatatattgtttatcattttcagtgaaagcgttcactggttaaatttccttttaaaaataataatggatctttacaatttctttgagctgctcagtgggtataatgtgttgaattttctgttagtggttgggaggtagaaatagatactttatctctattttagccatttccataattatatatctcaatagtcttgtcaatgcatcattagttctatgactgaattaatgattacttttagtagtcacttaatttcttactgatgatgatgattctacttttgtgaatcatcttggatgattctctaaaatcttagaaagctgattttgttaatactatgcatgtaacacatcaatacattttctctattaaaaaaaattaaagcattataggtagatcagaatttaccattactaactcctcagtccttcttatttccctgttatcagtttggtatatttatatattaggttgatccatatgaaattgccaatattatttctgaactgatgaaaagcagcaatttcttatgattcaacctattatatatgcccatagactacatataatgactttgcatgtttttatattatagtgctatacctcaaatactgttctgcaatttattttttcactcaacaacgtcttttgataatttctttcatggcagtctatacaagtttctacctccctacttttaaaatgttgcgtaattttctaatgtttggatttgtcattgctttacttactccctaatgatgaatattggcattattaacacttgtagtcattagggttcatatgactataaattgctcttataaagcattagtactatccattaaaactgcctttaggctgggtgcggtggctcatgcctgtaatcccagcactttgggaggctgaggtgggcagatcatgaggtcaggagatcgagaccatcctggctaacatggtgaaacctcatctctactaaaaatacaaaaaattagccaggcatggtggcaggcacctgtagtcccagctactcgggaggctgaggcaggagaatgccgtgaacctgggagacagagcttgcactgagccgagactgcaccactgcactccagcctgggcgacatagtgagactctgtctcaaaaacaaacaaacaaacaaaaaaactgcttttaaatgtatttgtattgaaaaatactgagatgtagtccttctgtttagttaaccaaccaaacttccttccttcttttttttttttgagacagggtctcgctctgtcacccaggctggagtgcagtggcgtaatcttggctcactgtaacctctgcctcctgggttcaagtgattctcctgcctcagcctcctgagtagctgagactacaggcgtgtgccaccacgcttggctgttttttgtatttttggtagagacaggatttcaccgtgttgcccaggctggtctcgaactcctgagctcaagcgatccacccactttagcctcccaaagtgctaagattataggcatgagccaccacacccagctggttaatcttctttcagttgttcctcaagaaaagtaattcagttgttttatgttttgaccttgaacataacctgttgtgtttcaactctgtctttccaggcttaggttgtaagctttttaaagaaagaggattgtattttatgattttggcaatgccctccttgtcttcttctacagcttctagttcagagctttgttttgtttcataatcactctagaaattattaacaaaccagtgggtacttagttgatttagtcaaatagaactaagtccagactgagcaatattggttgataatcatatggctaatactgaaattttgatgttattcaaaataatattctaaagcagtgctaatagaaatataatgagaaccacatatgcaatttaaaacttcctagtaaccacattaaaaagttacagtgagctgggtgcagtggatcatttgcggtcaggagttagagaccagcctgaccaatatggtgaaaccccgtctctactaaaaatacagaaattagctgggcatggcggtggacaactgtaatcccagctacctgggaggctgaggcaggagaacagcttgaaccaggaggcagaggttgcaacgagccgagatcgcgccattacactccagcctgggcaacaagagtgaaactcctctcaaaacaaaataaagattatagtgaacaggcgaaattaattttaatgccttccatttcgaccgatatatctaaaatattaccatttcaacacgtaatatgtaattatgtgctgtattttatgtttgcaggacatctcagttcagactagctacattgcagatcccaagtgtgtgtcattaaaatagtgatagatttgtgtgggtacatacatatattatcatttatagtttcctgattagaattctgcataatcaagtcttactaagacaggtttattatattttctcattacttcttggtctataggaattctacctctaaagagagaattaggtgaataataaaatgtcacgactccattttacggtagtatcttagcattaatatttggaattgttattctagaccttagccaaaatatatgttttgattatgaattttctgaagctttccagttaagtgtaaaacaagtgaaaaatataacttcgtattctgtgtattttgctttttataggtgtctactgcagatatttcatcaaataaggatgatgaagaaaactctatgcacaatacagttgtgttgttttctagcagtgacaagttcactttgaatcaggtttgaacttgacaatttactgtcttcctcattgaattcctccttgcacatttctgctttatctcatatacacagaagtcattcaatatttagctatagagctatattagttaagaaggtatttttaaagtaaaatttgtaggtttttagcttagtctccatttaaaatatgttctgttttcttaacttcaggatatgtgtgtagtttgtggcagttttggccaaggagcagaaggaagattacttgcctgttctcagtgtggtcagtgttaccatccatactgtgtcagtattaaggtaaacatccttaaattgagttaacaaatatgtattgaatttttatttggttttagtagtaacatgagctcccagttctcacaattaagtattatgattattaaacatatgtgacagtatttaaatacttaaaatactgcttttaagggtttcctatctcaagaaatttgctcctctataaatcttatattgtacaatatacttgtcttgaaaaagtaaaacataaaaatatatgcatttaatttaaaagacaatttatagtattcacaaagattttaggtttagctaattcattttgtctgctgatttaaaaagctgagaactggaatatttagtaaaaaattattagcccattctgttctttcccgcattctctctcctctatgctcactcgtatacaaaatgacattttctccttatagccaaaagaaacaaaacaagtgtcatatttaatgcaattggtaataatcgagagtcagcgctgctcactttgaagcatttcaggatagaggctttctggggaaccttttaagtggtatcgtgtgcttggttttaaatatggacaggtctcaatacttcactagttgtatctaaggttcttggttttttctttttaagaactcagtcttaataaaacttacatatttgaataaagtgtcatggccactggaagcaagcatggaggtatagctgtacagcagaggtcttaaactgtatactccacaaggaaatcttttctagtactgccataccatgtaatataaatactaacctcagtttcagtaacaggttgtgaaccatgagtgatttttatacctttctcccctgcccttcaaacatcactgtattatatcattgtcagtaaaatgtcagtatagtaagcaaatcaacattatctccttcagaattctttgttgataactacactagtatttattttatagggtaatacaggtttttgtgagtttaggaatcaaaatgaaagattgtaattaatactatccaaaatagaagactagtacggttaatttatgtagtcttttaaaattagttgctcatggtatgtgactgaaaaacacagagtatataaagccaattaaaaaatagagttatatatgcataaaacatgtttcttttcttctttgtactttatattctgtataaaagttgctgctatcattagattttgttttttagaatacttaatgttttggacctaaggaaattgaataagatccctttcaagatagtaatgtatttcttttaacccatccaacaattaccgaattcccattttacagatgagtacgacttacataagttaagattggacaattagtgcactatcaaacacatagttactggtagagctagaatttgaattcctgtttttaaaaattatgtatggttccttttgcacgatgacactgttttggacagtatagaatactgcagtctcattgagaaatacagcagtatctagaaatatactagggatatgtgaattggctcagcttgcatttttattgtaggaggcaattgtttgtggataagtttgatacctttgaagcttctttttaagcttgctggggcaagtctagaaagtcttcactctaaggtggatattttcaaactttatggttttagaaccttaacactctttaaaattactggggactccatagtttttgtttatgaggattttaactatggactgttcagcattttagaaattaaaactaggaacattttataacacaagactacagaagcacaacctgtacaatatcaatgtaatattatgatacaacatgtagcctctataaacaccactgtataattgtgaatgaattaaagtgaaaaaaggcaaattaaatcttagtattatttaaacttgttttaactttacagactcactggggttccctagaccacattttggtagctgcggtcctagcattaatttaaccctatacttaagacttggcctttctgggatcactactgaattctgctccctgttcaccagtgtctttgtactctgactggttgtgcttcacttgtctttgagccttttgcaagctgtggtaattgtgcagcttacaaattcccagtagatgtactttcccctggttgtgggtctttgggcttctagaagtacggcttggtgttccaccaaagacttcaggggatcctttgtagatttctggagctcttagtcgttattgcttcttcattttgagtactgtgtcctgcaaattccactgccttgccttccctaacctcagcgaggccattgattgtactctgctgaggttctccctccctgggcagcattctggaaaatgtttctaggcagaatatcataggactccctgagtgtttccttcctctcagagaccactgtctcctgtactatgtgttgtccaatatctgaaaacagttgtatcatacactttgtcccattttctactatcttatgggagaacaggctggtcccacctactccattatagttgaagcgtgtatccgtattagattataaaacatatctgtaacaactttggacatggtaccatggatggaatcctggatgacatcttatttgaaaaaacttttaaaactaaggctagactggttcaacggaagaaaaaaatgatagtacaaccccagtacctaggttaaaaggaaatttcaaagagggagaaattgttgaagtgttgaagtactagaagtcaagaaacacaaacactaatgtttccattagatttgagaataagaaggtcttgacaagcctggcttaagcagttatgagtggatgtgggtgtagagaccagactgtagtgttttgaagagtgaatataagctgagaaacttgagagtttggttataaaagggaccacaggtatctgtgaagaaaacttagtaggaatgaagataaatatttttaaaattctgccactgaacacctcagatctgtctgccactttatcttcaggtcattgtttaagccagggtcacgcagactggcccatagactaaatctggcccatttcctgtgtttgcaaataaacttttattgaaatatggccatgttcttttgtttacatatatttgtagcggtttttgcattacactggcagagtttttataaagttgcaacagatcatatggccctcaaaactttctgtttactctctggccctttattggaaatgtttgctggctactgccataagccaccctgatcttacccctaggccatttccttcatttgggcaaataatacattaacttggtaatctaagacaaattcttaaaaatcaataagctaatcaaaataataaatatacatgtttaaaaatcaaatgacattaaaagccttgtaatgggctgggtgtggtgcctcacacctgtcatcccagcactttgggaggccgaggcaggtggatcacttgagggcaggagttcaagccagtctggccaacacagtaaaaccccatctctactaaaagtacaaaaattagctgggtgtggtggctcattcctgtagtcctagttactcaggaggctgagccaggagaattatttgaacatgggaggcggaggttttagtgagctgagatcacaccactgcactccagcctaggcaacagagcagagcaagactccatctcaaaaaaaaaaaaaaaaaaaaaaaaaaggccttgtaatgaacaaccaactcttgtcttactctacctccacgtctgaggcagtcgcttttaatcttttcaggtctttttttcttgtggttaatgctatagctctaaataatcaactggtttactgctttatcaatgctagattttgttgactttctgctatgaataaataaattctgatttaggtcttaaaatacacctccatccttctcccaatatagttgtattactatgtttagttcaattaataaggtgttggttatgactcagtaaatgttcactgcaggtctaaacagtatactatgagtttcttttgtctttcatggagttttttataacaagaaagtaatagtgactctccattcgttctttgtttttgcctactctagaactatcatataagattagtttttaaagtactgtttttttctgggagaagtcctaccctccttctagacattcccttctcctgctctgatatgtgccagtggcttctaggtatgttgttctcatccttaaacttcctggcctgatgtcctttgttggatctgttgatttatagatcccaagtcttcctattctttataatacatcctcattctgttccgcatatctctaagtaactttattagaaaggagaatgagggagctgaattttgagtcttcctgtgtctacaacgtgttctgtcttcacacatagttgcttgtgtagctaggttgagaattgtactttgaaaagtattttcctgtagaattggaaacttatactcttctagcatctggagttgggaagtttggtgccattctgatgggtgttcctttgaatttaactcttttattttcttctctggtagcttttaggctttcatgtacctcatgatctgaatttttattctgtaccctcattacttgctgttttattataatgtgggcacttgattggttctgtctgaggatcctagtcttttgagatctttaagaagttccacaatcttaatattacatggtgtggcttccttcaggagtttattagggatttggagattcccaaatattctactaacttatacccttgagagaggggagaataaacagaggagtgaatgtgaacttcagaattcctagcttcatagtctaaatagaaatcctctaagatcataaaatgtccctaagaactcatgccttacattaatttttttggtattttttctattgattctaagcatggaaatgtagatggagattttgttgatgtattttcaaattatgtatcaataatagggaagcttacttgatttctttaaaatctggtcactatatctataaatatagtggacattaaatgtacagcataaggtaattatgtggactttaaaaaggcgttaaaatatgtgccattttctattattctgctcagtaggcttctaaaagcgtgtatgaacatgcccaacccagtattgggcctccgtaggtgctcaataaatgttagttgattgcctcttttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtactctagggtttgtttgccttgttagtctttcaagttcagagctttctcataccactttggtttttaaaaattagccacacctatttaattgaataatacacatattctatgatagataccagtaatcagaaaaattttcacatacacattaaatcatttcccccattatgttcgtatgtagcttcctgaattacagtaactgagtaactaagaaaataaaattgagacttttcggggggatttggatttcaggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgataggtattgtgctattttttcatctttttaaagcttttctctttgaaatgtagcaaaaaaaaaaacaaatggaaaatagcttttccttaatcacaagttttaggtacagaactttttgccttgtagatttttagtcacctagaaacttacagaagcgatttcctgttttgaattctcaactccggactaaaattttgttttgttttgtttttaaatttagagacagagtcttgctctgtcaccaggctggagtgcagtggcgctatcttggctcactgcaacctccacctccgcctcctgggttcaagcgattctcctgcctcagcctcccgagtatctgggactacaggtgcatgccaccacgcccagctaatttttgtatttttagtagagacagggtttcaccatgttggccaggatggtctccatcttttgaccatcttttgaccgcccgcctcagcctcctaaagttttatgattataggtgtgagccactgtgcccgcccaagactaaagatttttaatttaggcctttttgagggtttaggaatcccttgaaattagatggagaattattgccttcatctatgccgtttcttatgaagggtttctgaatcttctaatagattataaaaaatatctaacacattctgttctccttaaaccactttttcttaaagctctagatactagatatctagatattagatagcaccttctgccctccctacgtaattatgtggaatttcataatcaagaatgtttccttgctttcattggtatattgttgtactctttagaagttaagaagtgaacatatattattaatagtattattttatcagtagtacagtattcttgggactctggctactaattatttgttccattgcaagacaactttttacttaatttcccgattaccattcaacatcgctttccgtgagatatgtctacttcaagttagatgcattacctggagcacatacctgctagcactgccatttgcagttttctgaatacctttgtgtttgccctaactagcttcctttctgtctttgaaatatttaatatatgatgataaaataattagcttccttatgtaatgtgctttgcttcctctctaatagttgttctcattcctttttatttccttcttagctgtatgaaagtttttctgttaatagagatagttaggagaaaagggcaaggtaggaggagcatgtgaggcttagggcttttaagtttgaagactcagtgttacaggttttaaaaggtagcagttctcagtatattccattttttaaaaaaaatgtacaaatatggtctttttagatggatgcatgcagtttgtcagaacttaaatactgaggaagaagtggaaaatgtagcagacattggttttgattgtagcatgtgcagaccctatatgcctgcgtctaatggtaagagaataatttaaactgtgagtctgcactcttgtaccactcacttgcaccttactgtccataaccaatgaattagcttagctctactctattttgtctttgtgaaacttactttgacaagtattttatgaaaaatattatttttggttatacatgacttatcacaacttgttataaaacaatttacatgaaacaataaaaagcatatactttagatgtaaactataattttgcttccaaggaacatgatcttgtagttattgacaatatgtcagaatccaatatgttgattgtttcttagccaggttttcctccatgacttgagtatttccttcatcacttcttgttttgttgttgctttaaaaagcacttttaactttagtgttcaaacatttattttaataaaatgagtatagaaacagaaattataatcatatataagtatttaaatacactttaccttttctgaaaagaattacctggatttttttttttcgtttcagtgccttcctcagactgctgtgaatcttcacttgtagcacaaattgtcacaaaagtaaaagagctaggtaaaatttgaaatgctttacttgatttaattaatttactttgcttaatttttacataattggcttaccacttgtcaaacctgcttcaatcatatgggtgttctatccaaattctgtaatgttggtaatcatttccacaatgatatataaaatgtcatccagctttactggggcagtattcctataaatttcagcaagtaggcaacaaaaataacagctcttagaataaccattaatgccatacttgctttagtttcattgatatattactgtgcttaattatcagttagcagaaaacacggcctagttagcgaacagatttcttttagaattaattcaatctcttaatttttaaaataattaataagcctagtatggtgattcatatgatattcttattaaacagtcattcttttgaatatttgtatttaatagcacctgatacaaaaatgtttggatagtacaggaattgttctaaggaacaacagttttgtacatttaaaattaaatctgcaggatttgtacttatttattacttctccctattagtaattatgttgatactctgatttttccagatgagcttctggagtattctctcttctcttacgtaaatagatccctgccttttgatcttttctacgaagaagctcatagtggattagctgagcattgcatttagttgcagtgcttctaactctttttattgggacatgaaaatagaaattccaggaagacttttttgagacagagtctcgccctgtcgcccaggctggagtgcagtggcacgatctcggctcactgcaacctctgcctcccgggttcaagcgattctcctgcctcagcctcccgcatagctgggattacaggtgcccgccaccacgcctggctaatttgttgtatttttagaagagacagggtttcactgtgttagccagcatggtctcgatctcatgacctcgtgatctgcctgccgcctcggccccccaaagtgctgggattacaggcatgagcccctgcacctggcccaggaagaccattttttaaaaacatgcaacctttctgcctgtaatccaaggaaatttgacctattgttcatagtttttattgggtatcatgaagttaattattcatgcatttcatagatacgtaattgctttctagaactacagtcacattcccttgacatgggtattttggaacagtaatcagtcaaatttgaaatgaaagtttaaatttgtatccttgggattttgtaattttagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgaggtaatactaatttattttccatgaaatatgtgtgcaagaattaaagcatataaagtaacttttgaaatatgtgtatgatttaccaaagggtaaatcacactgacttagttaacccctgatgtgactgacccttgccatttccaaatgagtgatcttcttagaccttgccttttcaggttctcttcctttcacacattttagaacagacctaccttacagaaatctcaaggagcaccatatctttgaagatcacaggtggggaactacagagggcttgactttagtttgctagataacgacacaaaccttctcagatactgtgagcttggataataccatgtttcagttaaggtagttgatgcatacattctagaaatggaaaagctgtcatttaatgttacttcaggtataacttcatattcaccagtgtgcatcataaagtattggtttataaacattttcttgatcaaagtaaatataaggtttttctagctgaattctttttttttttttcagttgggagacagggtcttgctctgttgcccaggttagagtgcagtgacacgatcttggcttactacaacctctgcctcctgggttcatgcgaccctcctacctcagcctcctgagtagctgggaccatggatgcgggccaccacgcctggctaatttttgtatttttttgtagagatggggttttgccatgttgcccagactggtctggaactcctgggctcaaaccatctgctctgctcagcctgctgagttcttgagatagcaaaatattttaatagtaacccaaaatccaatatgagttaaagaggattactgttggtttgctcatttttggggcggttatttattttcaactgattcagaaatgaagtgataattatttgtttgattatattttatttcatagttttttgttttttttttttaaggggcagtgtcttgttacgttgcccaggctggtttccaactcctgggctcaagtgatccttctgcctcagcctctcaagtagcaggtactataggcatgcgccactgcagctggctttgagacaatagaatttattgaatatctactgtatgtcagatgttggaaatcatatcagtgtacaaagcaggtagaattctctgcatagagtttatattttaatgttaggtaacccaactcttaaaaaaaatcagttaattataatgtgtttggcaagtcccatggtaaaaataaagtttgataagaattgcctggccaggcgcagtggctcatgcctgtaatctcagcactttgggaggccgaggtaggtagatcacttgtggtcaggagttcgagaccagactggccaacatggtgaaacccattctctgctaaaaatacaaaaattagccgggctcagtggcatgcacctgtaatcccagctactcgggaggccaaggcaggagaattgcttgaacctgggaggcggaggttacagtgagctgagattgcaccactgcactccagcgtgggtgacagagcaagactctgtctccaaaaaaaaaaaaaggaattggaagtacagatgggtgtttagggtccatatgaacagaaagcagtatttgagcacagattttaaagaggtgagtgagtgagccacttgattacctgagagaagagcatcccagacagtgaggaagccgatgtaaaggctctgggtgagagtgtgctgagcatgtttgaagaaagagtgttgtggagaccaacagagtgagcagaggggacagtcagaaggtgagaagattagagatgtgaggacaagaaggacggctcagtatatctcacacaaccataaggtgatgtgtcagtagtttgtgcttaatagcaatggaatgggaggccattgaatgttcctgaaaagaagaacaccatgatcttatttatattttaagaggaacactctcctatgatataaatagatgattaggtgcaagagttatgacaggtagatcagtgagaaacaatggtccaggtgagaggtaattgtggctttgaaaaggtatgtcatttgtggccgggctcggtggctcatgcctataatctgtaatcccagcattttgggaggccaaggcgggtggatcacctgaggtcaggcgatcaagaccatcctggccaacatggtaaaacctcatctctactaaaaatacaaaaattagctgggtgtggtggcaggcacctgtaatcccagctactcgggaggcagaggcagaggattgcttgaacccaggaggcagaggttgcagtgagccaagatcgagccactgcactccagcctggtgacagagtgagactccatctcaaaaaataaataaataaatgaaaagatatgtcttttgtatgttcttgataatttttgttttgtagtgtgttttgggtctatgttactgggagaaacactttctgatgcttgtatgtaactgattttcagatacaattgaacaggtaatttgatttgggcagttggagtttgcaaagaagtagtccatatacttaggaggaattgatcagatcagctttaacaagaatttccatttctgaggatgttaaaaaatgtctgaaaaaggtttccatagtctcttaaatttgggaagtgctccatttcacaaaatatgaaaggtttcttgataatagtacacattgtttcccaaattatgagattataataccttttaaaaacaacacaaaagaccttggaaggttttccttgtgactaccacttgtaaactgagaaatggtgatatgtttcaatttcatattttctcattgactcgtatcagggtaaaagaaaatcagttgaaaaattacccttgcttttttaaaatttacgtgataaaatagcccatctgaatttactgaatttgtccttatttttattgaatatgaaaaaagattgtttagtgtgttggatgttaaatgctaagacaattttagaatttaaggaattgaatatacagcattttcatgactagtccctcatgttcatttacgtgccaggatctcacatcctttgcagaaggaaaggtacattcctagggataaaataagtgcatgttacttggacaacatttttgctttctgtttgctaaataaaaatcccttttaaaaattcagtattgccacactttgccatattaaaaatgttttagattactatattatcctgaaactacatgtacacacacacccctaaaataagttttatggtatttcatatgcctgtacaggagaaaaaatagggaaagaatacaatcatcgtaagttcttattattacattatgctgagatttctaataacactgcccttttctgggtattttgtattaaacctaaaatttgtgatgttttagactgtttcactaacgtgttttgataatgtctcagtacccttgggaaaacattataaagtagtgggcaatgatgaaacctactctgggtgtttttaggcaaattttttaacttctttgatgctagtgttctcatttataaaataggtgaaccaggatgagcccataggatagttgtgctgatgaggtgcaaggatgcatgccaggcacccagcactggctcttcccacacatggagtgctcagtaaccgtgagctattagaatacaagtgctcaaccagtgcttgagcaattgtgtcttgtgtccaacagaactcaacagaatcccatgcttgtctttatatgtgaattcagttccttttgagttagtaagaaattatgcctgtgttggggtaattgaacttttaggatgagggaattgtctgccacaattattctatgagcttaatgtttccatgtctttttcttcattttggaagttgtggaaaaattataatgaaagagtatataaacgttttcctctgtattatagcatatctgacagtttcctttattaaaaagtacaatacattagggagagacttgatgaatttaaaattaaagtttgaaaagtattattgactataagtgatcttcagctgtgcagttttcaacttgaggttgtcagaatgtaatattacacattatattacacacatctacagaatccaaactgtgatgttcctggagtattggaacaatacctatgactttttgtttctatttatttttaactcttctaataaccgcttccttaagaaaagtcatacatcatcactttggtgtatcagaaacaaattccttatgcaataaaagcatacttctttctcattcacctcctgggatctagaaaccctgttaatgcaagaaaaaaatcccatacctcaataaaataacactctgtttgtctcaagagtggaaacacaacacatttcctctcaactggtggtcccagatcgaccatcacagtgtatggatgtgttgggaggtgtgggaataggactgcactgaggctctagaaggccagcaggtggggcagactgaatggagggaggggactggcattcagtaactactggagagtgggaagagtgaggtagactatccatctggtgaaggtggctgcttccttgaggtttgttactttctgtaatgttaattccctcaacttttaaaatttgatttttagacaagttatacattcaaatgatttaaaattggaaaataattaaaaggtaaacagtgaagtctctccctttcccctgccttcatgcccccagtttacatctccagaaacctcagaggtttcttgtgtaaccttccagatgtgttttatgcatgtataaggaaatgtgtgtgtgtgtgtgtgtgtgtgtatatatatatattttgtgtgtgtatgtgtgtgtgtatatatatatattttgttccttttgtcttactactatttactgtccttcatttttttatggctgcaaatattcctttgtatggaaatataagcaatttaacttacctgttctttcccctgttgatagacctttgggtttctttcaatctttttttttttttttttttttttttttgagacagagtcttgctgtgtcgcccaggctggagtgcagtggcacgatctttgctcactgcaagctccgcctcctgggttcacgccattctcctgcctcagcctcccgagtagctgggactacaggcacctgccaccacgcccggctaatttttttgtatttttagtagaggcggggtttcaccatgttagccaggttggtctcaatctcctgaactcgtgatctgcctgcctcggcctcccaaagtgctgggattacaggtgtgagccaccgcgctcggctttctttcagtcttttactgtgaatagtacaatgaatcacctggtatatttataatgttgtatgtaagtgggcctgcaaaggtgaattccttgctaaatccaaagacataatgcatttaaaactgtttttggcaggtaggatacagttttttttttcatttatttttattacacatatctgaggtatacaacatgctttgtatacatagtgaaatgattactatggtcaaacaaatgtctgtatccttcaccttccatagttactctctgtgtgtgtacacctaaaatctctttcagcaaattttcattacaatattattaactgtggttctcatgctgtgtattaatttgatctctagaattactcgtcttacctaactgcagatttgtaccctccgacctacttctgcccatcccacccatcccctacctccagacccttgataaccaccattctactctctatacgttcagcttctcaccccgctgcctaccattctgcttattaagtgagatcatacagtatttttctgtgtctggcttactttatttagtatactttcctcccggttcatccatgttgtcacaaatggcagtgtctcctttcttaaagctaactattccattgtataaagtcctcattgtcatcagtaagttcttagaaactgtggttaagagggggaaaaaagtatgacaaaactgatttttttttcattttgcattatgccaaaattagattgaaggaaacagtgttacttgaggacctgctgtatgttcatttagcttaacgtctcagttcccaagaacctattgatgacattaagggaggacttaatatatgtgtatacacacgtcacaatttctttatccattcatctgtccttgaatgggtaagtaaattgtccatcaggacacttagtttgtttccatatcttggctattgggagtaatgtcgccatgaatatgggagtgcagatgtctctctcagatgctgattttattacctttgaatatatgcccaacagaggcattgttggatcttatggtggtagtttttttttttttaaggaaactctatactgttttcaataatggctatactaatttacattcctatcaaccatgtacaaaggtttcgttttctacacatcctcaccaacacttatgtctttgcctttttgataatagtcattctaagagacatgagatgatatctattgtggttttaattttcatttttctcatgattatgatgttgagcatcttttcatataccatttgaccatttgtgtgactttggaaaaatggctattcaggtccttgcctattttaaaatccagttatttgggatttttttgctactgagttgtgtgagttccttatatgttttggattttaaccccttatcagatgtgtggtttgccaatattttcccctaatccctgtgctaccttttcaccccggtgttttttttttttttttattgctatgcagaagcttatttgcttgatgtagtcccacttgcttatttttgcttttgctacctgagcttttggtgtgatatccaaaaaatcattgtcaaggaggatatcaaggagtttttctcctatatttccttctaggagttttatggtttcaggtgttaggtatttaatctattttgagttgctttttatgtatgatgtgtaagataggcatcaggtccagtttcattcttttgcatatagatatctagttttcttaccactacttattgaagacaccatcttttccctattgtatcttattggacttgtcaaaaattagctcataatatatgcttgggtttatttttgggctctgtattcagttccattgatccatgtgtctgtttttatgccagtaccatactgttttgttaactatcactttgtaatataacttgaaatcaggtagtgtgataccttctactttgtttttctttctcaagattcttttggctattcagggtcttttatgatttaatacaaattttagaattgtgttttctatttttgtgaaaaatgcctttggaaatttgatagggattgcattgaatctgtagatcactttggatagtatggacattttaacaatattcttccaatctacaaacatggggatatcgttatatttatttgtgtctttagttttttttctgttttttgagacagagtcacgctctgttgcccaggcagaagtgcagtggtgtgatctccgctcactgcaacctctgccgcctcctgggttcaagcaattctgctgcctcagccccccaagtagctgggattacaggtgcctgccaccacgcctgcctggccaatttttgtatttttagtagagacagggtttcgccatgttggccaggctggtcttgaactcctgacttcaggtgatctacccgccttggcctcccaaagtgctgggattacaggcgtgagccaccatgcccggctgtgtgtctttagtttcttttgtcaatattttatagtgtttagtatataaagctttcacttccttcattaaatttgttcctcagtgttttattctttttgatgttattttaaatggaaatgttttcttcatttttttttcagatcattatttgtataaagaaatgcatctgatttttgtatattgattttgtatcctgctacttgactgaattcatttattctagtaactgtggaatttttgggggtttctacatacaggatcatgtcatctgcacacagggataattttacccgcttttttctgctgatgccttttatttccttttcttatgtgattgctctggctaggactatgttgaatataagtgttaagagtaggcatccttgccttgtagcagatattgaagaaaagctttcagtctttccctgttgtaggtttgtttttgaataggcaatacctgtgcatgatacaagaaatacagaggtcttaaaaagagtgaacagtgttaagttagcctaccttttgaccatcccttccttggaaagaaccagtgttttcttatagctttccagagattagtcatctagatacaagtatgtatatatgggagaatttctcatatttgggtgatatggtctttttcttttctttctgtctgtctttctttctgtcctcgtctcgtctcttctcttctcttttcttcgtttctttcgatggagtcttgctttgtcgcccaggctggagtgcagtggcgcaatctcggctcactgcaagctctgcctcccaggttcgtgccattctcttgcctcagcctctggagtagctgggactacaggcacctgccaccacgcccggctaattttttgtatttttagtagagacgggttttcactgtgttagccaggatggtgtctatctcctgacctcgtgatccgcccgcctcagcctcccaaggtgctgggattacaggcatgagccaccgtgcctggccgatacggtctttttctttatttcagcctgtgggaatcagaaggcccttgtgaagatgttggttagaagagactttagcctacagtgataccacctgtgtgagggcactgtatgtgctactttatgccatttgtctcaacatgtatgcttactggtgtcactatgaacctcatcaataaaagtgctctcttggtttttactgtccttgtgtgcattgtttcaggtgaaaggtggcctttgtactagatccagtgttatccttggccacaaaccattacatatgattaacttggggatttcctcttcatcatcctggagatcatcttctgttctctcctgtgttacatgtgttttctgcaatttcatgaatttctctttattttttccctctatttgggtggaacgtatattccatagctccctgacagagaatgtgtggaaggtaagttttgagcattatatacttctgaaaatgtctttattttaccttcctacctgactcatcttttccaggttggaaatacattttcatttatcaattttagtcaattgatccactgtcttttagtttctagtatatgaagaactcggttctctctatgtgacctgcgttttcttggaagctgttaagattttgggaaattctttgtcctcagtgttctaaaatttcatgaggataacgtctgtttttgtctatttttgatttttaaaatctgttttgttaggcactgagtggtctctttcagtctgctgtcttatatccttcagtggtaggaaatgttcttgaactatattattgataacaattccctctgtttttccagaattctgcttttcagatgtgaaacatactcagtttttctctgcttctttccaattcatgtccttattttatcttcctctactgagttttatttctatttcagttatttcaagagctttctttcctccctttgaatgtttcttttgtagcatcctattcttgcctcatgggtatcttatattatccctcagaggattttaatcttttttaagattttttttcttcctacttagtctgttaattccaaattgtcttttatgttctcaggtctctgtctttcatgttacagatcaggggtgttgcagatcttctggcttccatggcccacaatggaagaagcattgtcttgggccacacataaaatacactaatgatagctgatgagcttttttaaaaaaaaaaaaactcataaaaagtctcataatgttttatgaaagtttatgaatttgtgttgggctgcatttaaagcatcttggctgcaggttggacaagcttgttatagaccatagtcggataatctttatggtacatgcatgattaaaagtgaagaactaaagatggagactggatagatagtatttttattttttaaaaaaggaattaagtagttgattagaaagctttctgtatgtggtggtgcttgtcgatttgtaagtttagtggggtgatttgtgctgaccatttggtgaaccctctggtttccgtatctttagatgttcttcttgaactgctcaggttccccactgcagtcttttcaaacctcatacttggaggctagagatctggctgctagctttctgagaattcagtggggaaacgtggggtctggcagcgggagcaggatggggttgtccacatttagtatgcccatattttcttggtcctattttcagtcttcatcccattgttccatttaaggtcacccaggaatcctgcatcccacaaatgagagtagcagcttctcagtgtgtaaacctaggaagcagatgtagggagtatgacttctgcagataattaaatctcttgttgcttgggttttctcccacttatttccaaaggtggccagttttcctagtttctcagccttctgaggagtgttataaactggattctttttttcagttctttctgctctcaactgagaatttgcctttgttaagttgtttttctcctttcctattgtctttttttttttttttttaaaggagattgggtctttctctgttgtccaggctagaatgcagtagtgtgatcataactcactgtagcctcaaccttctgggctcaagcaattctcttctcccacctcagcctcccaaatagctgggattaccggcatgccaccatgccacagcttgattttatcttttaaaaatagattatttcagtgtgttttttagtagggtttcaggagaatgtaattttaacatatgaatttagtctgccatcttaactcaaaattccctgtcattttttttttttttttttttgagacggagtcccgctgtcgcccagggtggagtgcagtggtgccaattcggctcactgcaagctctgcctcccaggttcacgccatgctcctgcctcagcctcccacgtagctgggactacaggcaccagccacctcacctggctaattttttgtattttttagtagagacagggtttcactgtgttagccaggatggtctcgatctcctgacctcgtgatctgcccgcctcggcctcccaaagtgctgggattacaggcgtgagccaccgtgcctggcctttttttttttttgagagttggaatttcactcttgctgctcaggctggagtgcaatggcacaatctcggctcactgaaacctccgcctcccaggttcaagcaattctcctgcctcagcctcctgaatagctgggcttttaggcgtgtaccaccacgcccagataattttgtatttttagtagagactcaccatgttggtcaggctggtacggaactcctgacctcaagtgatccacctgctttagcctcccaaagtgctgggattatgggcatgagccaccgtgcctggcctataaacttttcttttcatggcttagtcataagccgatagccattatcagattgttatggaattggcctcaaatatagaccaaatataataaaaaacaaaagacaaataccctgttcatgccattactgaaatatgttatctctaatactgagaatattgaaggagttaacaacttgattttaaaatgtatttgataaacatgtctttttcctgtaatacaatgtaaagcatatataacttggaaaagtttgattaccatagtgttaaaatagcattctctaaaatagcattctctaagcattccatttacctcattcagtgaagtatttattgaacatgtattaggtatcctactaacaatacatctgttactaagaaaatctgtgtacctgttctcatggagaatatagtctagcagggacacagattttaaagaaccaataaaaataaagcatgacattaatacataggagcatacaactgtttgacataatcttttctaaatatcaggaattctttaatacagtgaagtttagaataaatcctgaaagataagttaggtagaaggcagaaattggggaagatagtggaagaaagagcttgatacattcaaagaactgagtgtagttcactggtgggagtgagatgaagctggaaagtttacaagagactgttgtaatgggccttgcaatttaaagtttattttgagggcattgggaagacatgaaaggattttaagcagaaaatggatacatatttatagaaagatcatttatgcagtaatttaaagaactgattggagagaggtaagctttaaggtggggaactagataggagcatgttgtattaatagtgagtcatctgaggttggactaagatggtagtagagagtgataaaatgcatttcagaggtattgagaagtcttggttgtaggaggaaagagattaggaatgattgaggtggtcttccaggcctctgtcttctccgggttacatttccatgccttttaatgatgataggtaacatgggaaaaaggagaaagtttattttaaattagtagttcattttggatatacagttttcagtaactaggtaatattcaattatagctgtggttgaagctcagaagagagttctagtctagagacctggacctgaagacataattaaaagcaagtgaatttgttaagtgcaaatggattgcacttaacagaactctgagttctgtgttccccttctctgattatgttttatttcatgggaacactgcactaagcagcacaatttctacaaccatttggggcttcttctatctcctttcatactttccctaccaacagggatgtacaattaaaatggctcagcaacaaccctactttttattccccattatgtagggattatatatttgataggtttttccagttttgtgtatacatttacttttttccagaaggagaacttatggattgtgatggaaaatcagaatctagtcctgagcgggaagctgtggatgatgaaactaagggagtggaaggaacagatggtgtcaaaaagagaaaaaggaaaccatacagaccaggtatagtgcctgaggtagacatttcaatatcatcaacacttggttaattaaagaaaaatacaatactgaagacttcaattaaaattaaatattcaggcttcagaactgtctaaacaaaaatatgtgcacataaattaaagaactaaactatttgaatacgactttttagctctagagttctttattttgaatgtgtgaatacttcacaatgaatcattattgaatgccttgtcccaaatgttaaccattttattaaaggctttactagattggcttttgttcatacttggactttgaaggccatttatatagttcctctggatgtgtacttctgtaacgcttttaattttcagtattcactttctaatatctttttttgaaaaaacttatttcagtgtttatgcaggagtgccagtaagtatacagtgtgaaggggaataagacagagttattatggctcctagaatttatagtccagttaaaaaccatgactgattaaacactcatttcttatctgcctcaggagtggagagaaaagcggtcttgcttgtcagttttatttgccttattggaaaaaattattaaaattgtcacaatacagaagttgtaggcttttatgtatttatttaaaaaatttttttcccgcttatcacacgtgttgagtaggctttccttaggcagtttattaatatcttgtttaccaatgaggttttaaattggatttgtacaatctttatgcttcttattgcttatattttattggtaagagtgatctaaatcccttttgatatggaaggaagaactttcttacttcattcgtattccatgagaccttaaaagataacctatcttttaaataggtcatatctataataaggacctaagattagttgcttctgaattgttttatgaaaatgatttcatttcttcctgatcatgaggcttataagtgtacttttttagacattgcagatttcttccaggaacttgtatttaccgttttttttttcttttcctctgcctcacatggaagtcaaccctctaattgagggacccattaggtcacggagtaaattgctagacaacgatatcatttcacaaaagcttatagtgttgactgtgtaccagacctctattctaagcacttcacttatgttatttgtccttttaacatgtgtatgagaagctgctttgcctcacccccttttttaaccagtgaaagaactgaggcattgagaagtatttagtaagcagaattacatagtctgactccagattccatgctgttaaacacagggctctatgtgtcccatgtataaatgccctcataccttggagtaccagacaccgtccccctgaaatcatatcagtcaaagaatatttgtgtcatctaggtagtttgtgccttctatcctccagctaatgtaccagttagccggttaatatacagacagtcatccatcacttaagttcagagaaatacatcattaggcattttcatcgttgcgtgaacatcatagagtgcacttccacaaacctagatggtatagcttactacacatttaggctgtatggtacgctaaattcatttaaaaaaataaagtaattgtgctacggtgttataactacggtgatgtctgtatgtggtgggaatttttcagctccattataatcttatgggaccactgccttgacatgcagccctttgttgaccaacatcattatgcagtgcatgactgttatgtgatgtatgaggcactaatatttgtcaaatagataagccagcgtaatttagtgtttgatatttacactgatactgttgagaagaggaagtgcacacaggtctttttgtattctgtttgataagtgataagagtggctttgccttttttttttttttttttggtcgtttttaacttctattttacctaaaaatcaggttattgatttagattagcacagatttaattttggaaaatgacttactattcaagataaagcagttttatcctgtgtactgtggaaatgtagggagaaattacttatcagtttacctaatttcttttttggataggtattggtggatttatggtgcggcaaagaagtcgaactgggcaagggaaaaccaaaagatctgtgatcagaaaagattcctcaggctctatttccgagcagttaccttgcagagatgatggtatagtactgacttaaaaaaaaattttttttttaatgtaaccctttggtcttgatatttctattggaaaaaactatcctaaataatgttacagtcaataagagccttattgcctcttattgttactcaataagagtcttattgccttttattgatgaaaggatttgagtgcgtatagagttcatatctgtaatacagtaatcaggttttataaggaaatggtttaaatccaatagactttattcttttgagattttttgacaagctcttttttcctgtatcaaattattaaatatattttctatatttaaatataaatggtttagggactgaataacttagttacataaggtactttctggtcatctccaaagcctttctttgactgccttagctacttatcatataatttgaaattctcaagtgacagtgcacctcagtttttatctatttatgtatctgtctgtctatctatctatctatctatctatctatctatctatctatctatctaggggtctcactatgtcacccaggttggcatgcagtggcacaatcatgggtcactgcagccttgcactcctgagctcaggtagttctcctgtcctcaacctctgatgtagctggagaccacaggcacacaccaccatgcctagctaattttttggctttttgcaaagacagggtctcactttgttgcccaggctggcctgcaactcctgtgctcaagcgatcctcctgcctcagcctcccaaagtgctgggattacaaatgtgagcccagctgatatctaaaaaaaattttgtttttgagacagtcttcctctgttacccaggctggagtgctgtggtgccgtctcagctcactgcaaccttcacctcccgagtccaagcaattctcgtgcgtcagcgtcccaagtggctgggattacaggcgtgaaccactgcatccagccaggagttgttttttttttttgctattggtggtgagcaggaggtggcaagtgatggtttgtgtgaaggtgtatttcttattaaactgaccctgagctttatgcaagtcacctctggcctgtctgccttggagagaggccttaagctttgtcttctattccctattcctcgcaatgctctgaaaattggagtttgaggtcattggatttcagcaaatttcggagagcttttacttttttgcttacttctgtggttccttatttatcttaatttttgtttttcatggattccttatgttctggctaggttactggtgcctttaaaaagattgttgtaaaaaatgtttgtctatttctagttttcagaagagtcaattcacttacgtagtctggtggtagagtgcccatattgattttcagaagggatgtgccatttgccctgccattatgaagcatctgagaatatcatttgattgtttatttgtcaaatttaagctgtgttcttgtttctttgctagtttcatagtccccaaatttatttccatttctgatttcaagaataagtgttcattgcatatttattagcatattcatcgtcatgttttcacaatgtgtatatcctacaaataatttataataaatttctgaacttggaattgctgtattaaaggacacactttttctttaaggtttttgttgagtattctcaatacaccctacaaaaaagttacacccacagaatttctcttaatagtttataagttgccatttcgtcatactcatgagctttgggtatttattattattattattattattttactctttaacaaaatatgtttaaataaatacgtttttgctttgtaatcgattattaagaaaataggaaaaatgctaatactaagtagacatgaaatcaaaattttatggcacttaaaagtaacaaacttgatttgagatttttttgttcaaaaagcttgtttgtttatatgaaactgtgtgtatgttggtaaggtataaaattaccttcagtgggtttgtctagaaattttaaatgtcacatatttataaatgtgactgttgtttcaggctggagtgagcagttaccagatactttagttgatgaatctgtttctgttactgaaagcactgaaaaaataaagaagagataccgaaaaaggaaaaataagcttgaagaaactttccctgcctatttacaagtaatattttgctttacattattttacatggtttgttaattgaggaaataaaatgtattgagttttaaaacataggtttgttgtttttgttaatgttttacttgttttgttgtcatttagtcatcataaatgccatttttacctttcaggggtccataaaaattaaatttactttttttgtgtgctttgatacttgtcataaattgcttttttaataccagttgttcacttctaagcattctataagatgtaacaaggacactttgggataggaaaaactcaatcttccaagtcattgatagctatgtataccccacacccaagttctgttgaaatttcctttgccaatacaagttacattaattatattcattgattaaagataggcttttcagccaaagttatagctttaataatcgttaccacttttagaggcctggagaaccaaagatttaagcagtattctttttgttttccaaaatacacatcagaaaaatacctttcagtacgaataaattatgtttgatagatgtagactacaaaaaaaatttttttctagttcatcttgtaaacattaagtcagagtttaaggccatgtgatacggaaacagctcaatattagaaattgtactgagattaaatatctggctctgcatctaactaattgtaaattcctaagcgtgttattcatccttcctggcctctatttcttcatgtgttaaaattgaactggaacagactatcattgagaggccatcctcatttcattgtagacaactattcatctgatctgttcctcctaagaaactatggcttacacagataacccttcattgcctgagttgcatttattttttacatcaattttccagttaggtattactagtttaattggttttaaaatacattgcctttcaactagcatacaacttcctcaattttcttttttgtagctactaacatcttaatggcagtattcatgttagagctcagcctataaagtcaggatttaaacaccattccactaccagttagctgtgtgattttgttctgtttaacatctcttgtgtctcggtttcctcatttgtgacatagtggtgcctctcagaaatgctcagaagttcagtgagagtatgtatgtaaagtgcctagcctgtgccttactttttgtatatccttcatacatgtttttcccctcaatctcttatatcctaggtttgcacctttgtttttttttaaacgatcatttaattggtcaggaaaaaaaatccatttataggttggcttaccttttttttttttttttttttttttttcatctttgttgttgttttctcctgggattccctttacctcccttcttaatagtcctttctaggaatattgtgatggcaacctacttttcctcctattgatccttctgtaaagtgtaatataaatttaagaagctttctttaggtgtttctgcaagtatgaaaactagccatttaatactttggcaaaagagtctttaaaattattaggtctaatttcccaattactgctgtgatcttagtctcctgggccgtcttgttcccctgttgcacatcagtaactttcagcgtgtgtgtgtgtgtgtgtgtgtgtgtgtgtgtgtgtgtctgtgtctgtatgtgtgacatgagggaggcctttttaatggtagttttcttggacttttagagacgatatggatggagccccctctttatgttatctacagggaatgtaaaacacactaaattaataagggtgacacagtttttgataaacaccagtaaagtcatgagtcattagacagaattcttgctgatgatggtgtaagatttctcagatttatactgaaggcattaaataaatgacctctaaacttctaaaacgctttctgctgttcatcattttttctaatgataaaagcattgcttattataagaaatgaatcctcttctacctggtattctagttttgtgaatttttagatttttcatagtgagatgactttttcatttaaaatgtgaacatttcaaatcagatatatcattgcctccaccagacttcacacactcccaatctcttttctcaaagggtagtattgttaataatttggcatttgtccttcagaaacttttttataatttatttttgcaaacttataatagtcttgatttgaactttctaatttttttttgagacagcctcactctgtcactgaggctggaatgcagtgatgtgatctcagctcactgcaacctctgccttctgggttcaagtgattctcgtgcctcagccttccaggtagctgggattacaggcatgttggcgcatgcctggctaatttttgtgttttgtgtagagtcaagagttttgccatgttgcccaggctggtctctaactcctgggcctaagtgaaccacctacctcggcctcccaaaatgctgggattacaggcgtgagctactgcgcccgacctgtattttataatttactgtatgtgtaattcaacttactttcttttagtaatgtattttagggctttttctttgataacatagaactatatacttttaaaaaattgttgtattttgtaatataagtgtctataatttggatagttctatgcctgttgatagacattaaggccatttttacttcttgacattacaaaatatgctacagtgaacttttttgtgcatgtttggcaagaatgtgttaaatgttgtattgcaaaattgtcctgtatggaggatcctttttccagatagactacatcataggatatagactaaagcagagttcctgggttgaagcagggtaaaggggtggaactgtgcttcccttttgtctttggtattgatttttgagaaattttggagagatcttggagttgcaaggaacccagcttgaaagtatattgaaatggaaaaatgttaatatgcctaaataaatagaaaaccacaagcctttagtagctgtaaatattgcacacatagtatggctaaactgactataaaaccgtctttcagattgatgatgtaagtagtcttatagtgtaagtgtggttatatgaatcaatagattacaaatctacctgaagtaaatattaaagccgtagatcaaagtcttatgctgtcctctgcaagtaatctataaaaattaataatactcatgaagctattctgcagtttctagaaacctttggtataattgtgtggttttatttccataattttgtctctagtaaagctaccaaaaaatcttatttttaaaataaggagaatctatataaaataattgacaggatatttctattttttaatacttctgtattcagtttctatattgttaaatataaaccttttctgttatttctgcttccttgtcaaaaaccatgacagaataatctattgtctttttagaattttctaaccatttttgtatgtgcttatcttcatctaggaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtatgtagaattattcacagatattttctttatatcatataacatacatcttcctttcagttaaatctttttgaaatgtttttgtttggcctcatatgcattttaaaaatcaacagcattgaagtataacttacattcagtaagtggaactattttaagtggacaggtgtataagatgtagcaaattaatttacctgtgtaactagtaccaacatcaagagttgtgaaggaaaacatttggtttacactttgctgagggcaatgtgaggggttataatttggccaacagtgactttttgactaaaaatctaagatagatttttgttaatcatacagcttaaattcaaaacagagaaaccgaaatggatgtgggggtacttgggaacttgctggcatactgtgttactacagtgaagtctgttgccctaggtcatggtttcttactgctgacagtttgcaccagtaattctttgttgtgggagggagcctttctggtgtatagaaggatgtttaacagcatctttggcctcatgatgatcaaaaatatctccagatattgccaaataccttttggttttggtgggcaaaatcacccccggttgagaaccattatcctaaatgcaggaactattaacaatcagagaaaggtatgagaacttgatgtatttacagagttacagcaatgtcagcaaggctctaggagtttaactcattgggtaggtaagtgtcttgatcagtgtttctcccacttctcccctatggttctgtcaattgtaaatcattgttcttttggtaagcttcctttttttaccattaattgcatttgttactcagttaattttataaactcattttgaaaaacaattttaaagcaatcttccactgaaaaatgactttggatgttaagtagttaatgcttcattaacttggcattatcctgaattgaaatactgacaactatttttgattttgactttttgaaataattagaagcaatcttaccccgtgttggacacatgtgcatgtccagtctgcctcattgttggtagtgaggtcatgcttcttgtttgttcaatcttacatattttttacctcctactttaattctgttgttttaagtatgacctgctcttgtccttgtcagtatgttgttaaaaataatgtataatgaaagacctgtgggtccttcaaaggatattttacgataaagtttatcttataactctcataactagccactttgaagacttaaataggagctctttgcacttgagttttaaaagcaaaaggattgaaattggacagagaacatataggaaagatattgatacaagtttttttttttctttatttatttttttccacaaaaatactgaagagagaacagttttacaataaggccaaaacttggaggactagaaaaatatacccatttcaaaacctagattaattgttctttgcaattgaactactcttttcactttataatggaaaattaatgactaaaggcttttttttaacatgtcattcattgtagcctattatatcaattttaatgatttattcagatataaaatcctttaggtaggggcaaacttgtaaaacagtctttaaaaaattagttataattgtatagtagaattccattactttaaaacaaaaaactgctatatgactcctaaaaaaattatccagattttttttcattcaactacagtgttgtcattattgaaataattttctctaaaaagttcctggatatttgggcacgcaaaacttaatgtgatatgttacatatgaattacattttgaaaactatataatgggaccaagactgtttgacagaagtatttgacctggaatattacatttatgccctcctcccccttttaagtaaaaataagcttgagatggattaaaaatttcagtttctctttactgaatgactaatataattattaaagctagcctaaacaagagttccaatagtttcttggttaagcccaaacccgtagaatcctccttgacttttctttccctttcattcatccacgtttgtgtctgccttcaaaatacgtcccaaagccgaccacttgtctcagctttccttagaaccctggtgctgtcatcacctcacctctcagactgcaccagtgcccttttctaatcttaccagcccctctctaattcccacccctcatctgctctacatatagcagccagtatgttccctttaaaatattagtcatctcctatctttcagcctcccagcaacttctcattacacttcagaataaaacccagtcttccccataatctctaaaatcttaacataatcttgccctagctgcctcttttttatccttaccacagtttttcttactgttaacactctggcctctcgttggcaaacccggcttgccccaggggctttatgtctgctttgccttagtttggagggttatctccatctttgtgcatataacttactccctcatttagttttatgctcagtcatctcctaaaggtcttcatagaccactctgtctaatacaacatccccgcagcttatttttaatcctttttccttgttttttctttaaatagcacttacagcgatgtcgtttatttactaactccccctgagaaagtaagccctctgagggcaggcactttgtttcagtcattactgagtgggcaatgcctgatacgtgatccatagacacagttctgtgggtagtgaaatactttttaaaataaatgagtgagtaatcagtatgaacagcaaagctgcaagtagttactagatggtacctggcttgtgctccatatggaatttctggcttgtgctccatatggaatttctaaagagtgacaggtttgtctttcatattttaacttttcctactgtgttttaatttctcaatgtcacttttagacatgccactttcttaatgaaaaacttttttttctttgctttgtttcttacagcatttattctgtttcacttttattgcctacaggtctttaaattttgtctcaatatacattagtcacaagacaaaatcgtctgaatttttagtaaatttttgtaattcaaaacattatctcctttgctatggaaaatttttactgtaaaattaagagtctcaggtttttattccagtacttgcctcactcagtatctgctgtactctaggtttttagcaaatggcttaatatctgagaaaatactgaaattttaaaaaacatatttactatatttaggtcctgctgatgacccattagctgatatttctgaagttttaaacacagatgatgacattcttggaataatttcagatgatctagcaaaatcagttgatcattcaggtatatatgaatactgtttaccctttttctggtttctgatgtgagcgagaggtgtatgatgtgtggaacaagtttagccttttgtctgtttcccagtaactgtgtttttgtttttggctttgttaaaggactcagcattttctttgatctgcctcagctttcctgctttaggaggggtatagcaagttagttaatttctgtcgtctttctaattgcatcacatttaaggcatgttgccttaaagtcttgctgtatcttttttcttcttttgtttgtattttccctcacttcctgctcctgtggtaatcatccattttatttggtttgggtcttataggtcttgatttatgcactttccaggttgagagctcaccttttccatttggtaagaaactgagcaatggatgacggctgactagaagtagtcttctttttttatagtgatttcagctgaaacaacctgtaggtgcatgctgtttatcagtagtgctaatttgtcactaatccatactttgcttttccctttttgtgtgtggctaaagcatagtatagctgtactgtacttcgggtgactttctcagtagtttttctttaatgaataattttatttttgttaatatgtggtttacaatattacctaaatgtcgtagagctagttcctaatataagatcaaataagaacagactaaatttttactttttaatagtaataatattgagaaagcatgaaaaaaatgtagatgataaaccacttttacatgtgactcttacaaatttgagctgcagcatgttacaattttataaaatgtaatgtacataatcagaatgtgcctatagaatactttaaaaatattacctataattgaagttatttacaaaggataatattaaacactgagcattttagggcttttcattaattcatatgaaacatattcctttttacatactgtgcataataattgaactgtacatttgataacactattttccaaattaaagcaattatttgcatatcgatttctcataaactcctatcttaagcttttttttttttttggcaggagttggcaagttaaaatcagatgtattcttttattcctcaggaaatgtttttacttgaaatagaactttacatggcaccgaatacaaatatattgtgcctaatttttactgagcgactctccaaattgatatgagaattctgattcagaattacagactttatttctctattttaatcatattgttatatactaagtacaggtaaatagtgctatacatttttgtgtgagtattctgaatgtacctttaaatttattttccttactcttgtagatattggtcctgtcactgatgatccttcctctttgcctcagccaaatgtcaatcagagttcacgaccattaagtgaagaacagctagatgggatcctcagtcctgaactagacaaaatggtcacagatggtaaaatatttgccctacatctaggctttctaaaagacctgagtaaatatgatttttaaagatttttgcatggttataatttaacttctaattatttctgtcagttaaatactattttatatcagtatattgaattagtagctgttaatgtttcttttttttttttaatttattctaggagcaattcttggaaaattatataaaattccaggtaaatgtgttttgattttctagttaatgaaaatggcgttccccataccaggaccctactagtcttttaatcttgttactattattgttttatctcctagagcttggcggaaaagatgttgaagacttatttacagctgtacttagtcctgcgaacactcagccaactccattgccacagcctcccccaccaacacagctgttgccaatacacaatcagggtatgttatgactttataattctacattatattcacacacatgtgtatatatgtgggtacatatacacacacaagcaagttttgccctattctttagtagccacgtatacaaactgatagggagaaaaacccttttgtaatgattgaaaaatactgacttcacatagcggtctccctgaaattctctgtaattctgtaattatccttatgtccagtggggaggatgtaacagtgcctgccctcttccctccctgcaagtcccattcccagctcactccactctagtcatttgccacataggcacttgctgtgtgtgtgtgtgtggaactgtccccgctcacctggctgcctgtactcattgatctgccctcggtttcactgtcatctctcagaggttagctggtcaccaccccacccccatgtttttcatttgtagcatatggcacaaatataatacctgtttgggtaattatgtcttccctttagattgtgagctctttaaaggctagagttgtccatgtcttgcttatatgccctgccacagagtatgtgttcagtacatactttcatagtaaatcagtgacctttctatccctgtagacactatgaaattttgtgaatgtttgcctattttgttcatttttcttctgcctacttacaactagctaccaatttctccccttttctgtagagctgaaatttgatagcctaggattaaggtctgtatgagtagatagggaaattggtacaggtatgggaatctataggaaggagtttatggagttgcatggtggcgtgtatataactctatctatatgtatttttgttttgttttgaaacggtctcgctctgtcacccaggctgacatgcagtggtgtgaacacaactcacgtcagctgcgatctcctgggctcaagcgatcctactgtcctcagcctcccatgcagctgcgaccacaggcacacgccatcatgcctggctaattttttgattttttgcagaggtgggggtctcactttgttgcccaggccagtctagaactcctgggttcaagtgatcctcccaccatggcctcccaaagtgctgggattacaggcgtggccctctgtgcgcagctagtatatatttctgatgatttgagcataggaacatctctctctatcctattgtcactgcctcatgactataccctgaattgaataacatgaggatatcttctccttttcttgtgtaagtgccaaagtgtgtgaataatttgtaacctttactaacaactttgtatatacatgaaaattccataatgcacataatggaaatatttgtgtttttaccagtttagcctctaaacataaatttaccttgatttttgctaggctaaacatgtgatttacatttgggtaatatacttatcatataactattcttgccttaattgttcctatgtgctttttttttttcttttttttctgagacagagtctcacaccttcgcccaggctggagtgcagtggcgtgatctcggctcactgcaacctctgccctctgagttcagcgattcttctggcttagcctcccgagtagctgggattacaggtgcctgccactgtgcccggctaattttttgtatttttagtagagacggggtttcaccatcttggtcaggctggccttaaactcctgaccttgtgagccatctgcctcagcctcccaaagtgctgggattacaggcgtgagccaccgcgcccagcccccatatgctgttttaacgattaagaactattcagtatttctcttttcaacatataaaaatgacctgtctttatgttttctgaactgaaagtgcatattttaaaaatcaaagatgtatttctttataaaaaacatcttacaatcattatgaaaatcacttcattgtgcagtctcatttttaaaaggtcttgggaggatgacttctttttctttttttttttttcttttgcaaggtgttaatgtgtaatacaaggtgaatcaggttgcctacccttaggagtttgtaattctaatactgtagactttcaggtatacaactaatgtgtattatagtacagtataattcaagtacagccttgtgaatcactaagatttcattgttcttgtttgaaggaatagtagttctaatgtaagggcaaagcatgatcaagttacatatagggcgacacatagttattcaagaatggcaactttaatgttttccagagcaaagggagtgggcattgtttaaggaagcaaaactagaagtggacattggtgctgattgtaaagggctctgagaaataggcagaggcagctagccttttccctagaggcttccaagagcctttgaagaccttacaccactggtgtgatctgatcacttatgtgttttgctaaggtagctctggtgtcaatattgggaataaatttgggacgagaagaattgtactaatgaggttattgtggttgagactaagttaaaaagtaggttccatgtaaagatacttccgtgctgattgaaaggaaggaatagatacgagagaaaatgacattagaacaagtaggactgtgctactgaatggatataaggtgtgaggaaagggggaaattaaagtgaattagactatgtataaaccaggggcccagaggataatcatgaaacagaggaagacttagtgtgtgtgctggtagaaggtagtggaggtacaatgaatttagttttagacctcttttaggttggtagaaatgggacatatacactattttgacttacaggcagttgcagttagtcaaggagatggatgaaaatgtaggaattatctgtgtaattgtgctaattgcacatgtgggaaggatgagatttattaagagaatatactgccagtagagtatagaatctcgaggaatgctttttaattaaatgtaattaagtatatgcttaactcatctgatttatattaggtgtgcaattacatgtttcttatctttcttccttttaaaggttaggtgaaagtaaaaaaagtggtgagagatttgagacattgagtgagaggtataggatcttggaaatgaatgatcattagagacaggttgtacagttaagtaacatgactacttgaaaaacattgtttcattggaccatgggaaggttgttgctaatcttcagtggagtaacttcaatagaattgatgagaaaggggaggcaaagtgtaatatgttattatgtaatatgtaatatgctttattgtctgatggtaataaagttcagaaagtagagaatagaattttcaagattgagatagagtaacttgaaatacctttatgtaaaagttgtgaagtaacttttgaacttttataaactaatatgactagtttgggtagatatggtagacttggaaaaaaaaaagaccacttcttgaataaaataagaagaaatactttgcttttacttatttgtccttgaacaaattatttaatttctgtgggtcctctttgcttaaatggagctgaacataataacctatttcagtgggttttcatgaagctgtaaagcttttaagacagtgcttagcatagcataaagtacttaacaaataatagctaatattactattgggaaaagtttcaatatgttaatattgtagattattacaagattattattgtaatatcggtagatggcactgatacctagctacagtatggatcacattctccttgtcaataaactcttgtttctcctaattacatgaaagacatttgatattgtttattaaaattgcacattccttaacgcagcagtccccagcctttttcgcaccagggaccagtttcaaggaagaccattttttcacaaacccaggttggtgggttggggaatggttttgcgatgaaactgttccacctcagatcatgaggcattagattctcataggaacatgctcgcatgcacacttcacaatagggtttgcgcttctatgagaatctaataccgccactgatctgacaggtggagctcaggcggtaatggtcacttgcccgctgttcacctactgtgcggccgggttcctaacaggtcatggactggtaccagtctgtggccccagagttggggacccctgccttaatggaacctgcttttcactgaagttgaaaatagatgtggcattctagtttgaaaaaagcagaaatcttgccctttaatccttggagtaaatgtaagtgtcatgagatatttgtcattgtgaaaacctgatccagtggacccagctgtggcatttagtagggtaagcccgtttgtgaaagtcagagagttctaggaagtctttgagacaaaatcttttaaacttgtcagtgatcatccttagtatctgcacatacatactggagctatgtaggttttagtgttgtaacattcaaatgatgtggtttaagtgaaagatcattatacattgtaaaatgtacgtgtatgagactttttttttaatctaatggaatgacattagataaaaaaaaatcaagtgatcaggttaggaattctctagttataccaagtattggtcaactctgtattgccatttgtgtaattaattggtgatgtggatctcctgtaatagtatggctctaagtgttgcaacaattaacagaggccttgtgtatttccacaaatcatcaagtttaattgggagggctttttgaaggtaaacaaagtttttgttgttgttgttctttcttttttctggaaactgctccaatatggacagttggcttagttccaaatagtttagacaagtagactttcacaataaggactggagttacatgcttaaaggagtgttgtaaagaagcataagatggtccttttatttgcctaatgtctattcagaaagaaaacgataaggtatttgatgtttgtgaataagctcgaatgagaattcaaatgtgtttgggggctgaactgtaagttataaaaattaggccaaaaccagagtgtatgtatttttaggaataatcatctgatttttagtgatagatatattgcttactcaaaactaatttagagaaagtatcaatttaagaatcataggtggggtggacacagtggctcacacctgtaatcccagcactttgggaggctgaggtgggtggatcacttgaggcaggagtttgagatcagcttggccaaaatggtgaaaccccacctccactaaaaatacaaaaattagctgggcatggtggcaagtgcctgtgattccaactactcaggaggctgaggcagaattgcttgaacctgggaggcagaggtggcagtgagctgagatcttgccactgcactccagcctgggcgacagagtgagactccatctcaaaaacaaaaaaaaaaaaaaaaaaaggaaagaatcatagatttttttttttttttggtattaagaggaacaggaataaaatataagaaacatctgtttgtaaatttttaatgaagagaaagaatatttgataaaacttactagcatttgctgtgattcattagtgttttttaggagttaattgtgtcgaatagttactgcataccaggaactatgtttagagctgtacatacattatctcaattaacccaaataacagaatacctacggtttacagaaatagaaattgattctgcttctaacaggtaaaattgaggttcacaccctgggcttttggactccagaacacttgctatttctagtacacaataatgaaataatcacagctgtagagatcatatttcaaaatcttatagccaaaagtcactctttaagtattataaaatactgaaaaaaatcctacttttaaattgcattaaaggttttgatttagaagtataagcatctcttctgtacttggggctttggttccaggacccccaggtataaccaaaatctgagaatacagaagtcaaatgttggccctatggagcttggcatacaagaaaagttggtcctctctatgcatgggtttccctgtgttttctatccacattcagttgaaaaaaatgtgtgtttatgtggacccatgcagttaaaaaccatgttgttcaagggccagctttacttcaactccttgttacttgtgaatatcatgccaacggaattatttttttctctgaagatgctttttcacggatgcctctcatgaatggccttattggatccagtcctcatctcccacataattctttgccacctggaagcggactgggaactttctctgcaattgcacaatcctcttatcctgatgccaggtacaagccttattttctatggaaacttaaattgcactaatttctgtttgatttatatataaattagtctgcttaaatgattgtgtatgatattattgtatgttgcgtttattgtggcttttgctataaatatgttacttttaactgttttgtaataggttttaatgaaagctatacttgaacatatattaagaagttattttatgttcataaagtaaagatatttattttttcccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctggtaagccatgaatatattatttctgttttaccaacattttcacatgtgcaataccttttttttttttaactgcaatagaaaggtagcttaactaatttttgtctatgatgacccacaacatgaagattccctagatgtctagaaacatcttgcattttactttgtcctagaccctgcatccatcctcatatttcccaaaaattagtttcaattagtgaaatggtccgtttttcagctcctagcagtacttattaatatgcagaaatccgtgttatgtgattctttaaaaaatttctagaacccaaactatcatttaatcaaaaatactgctaggctaaatcagtgaatcctaaatagtgtttttatgaaacgaattcaatattgtcttcccttcttcccctctcactttccctgactgcccagctattaccactgcctcttgaaaaaaacagatgataatagtacagtttgtgaaaattctgattaaccagtgaatgagaaatttggattaatgaaatgtcaattattgaatatatgcaagcaatgcggttttattattttgagttcatggtatcagacaaactaggattgaaaaagttattcaaactcagttttgcaatagtttcccagctatctatcaatacacaaactcttaaattactagaggggtacctggaagtgacttttcatttggatgacccctgtatttaggtacctttttggattggcgtcttcatgggactttattcattatgtattgtaataaatgaaatgctttttatctaacaatagaaatcagtggtttgatgcagggagacctgtgaaggcagtatcccattcttcagccactttctttccatgcttacatttgctgtttatgaacgtacatgggtatgttgtcattttgtgtcagcacaaattgtccttacagcagagctgtaacttttttaaaagtaattttctttaataattttactttgtgattcaagaacctcatgaaatactgtgttaaagctgttggtctgtgaactgatttttcattttcattggctttttggaagcttgctttctttttgtaatgtggaataaataatttctgtatttatcattaactgttgatcttacccaggcttcttcattttgtataccgtcatgacactgagtttcatataaatggtttgaactcattacttttccatgtgtttgttgtccacaaatgctagtgagatgcttatttatgactttgtttacttctggtaggtcaaattgatagatttctgtttagcacagatgttttacaaacttgtactttggttctggtggtgtcttaccaccagagggaatttattatgtctggcttgcatttttgctactttgtcccttgaatctaaaaacttcccaactttacaagctacgttgttaataaggcagcacttcatttagaaaacgtttgtttggcctacagtgtgccacgatctttgttctttgtaaaaaacttaatataggtctatgacctcatgagaatacggcctgaataagattaactgtcagcagttcatcaacattctttattacaacacatcattagcatggctctgagaaagtgttatactctgttcttttgttgcagattggactactagagtgaagcaaattgccaaattgtggagaaaagcaagctcacaagaaagagcaccatatgtggtattttaagaaactcctctatcttttaaatatttaaatacagtgcttgaaccttatttgtattaggttaataaaaaacaaatttccatttcagaaaatgcttgttagtacctgtacaacaagcaactttatttttaaagtgattttctaactccttatgtcttaatagagagtgtgacatttttataagcaagttaatagaaccaaaacgttgaagattgaaaatcagctgttttaggggggaaggagtaattcatttcactttaaaattgttttatctcttcagcagaggtacagttggccgtctgtatccatgagttctatatctgtggattcaaccaaccatggatcaaaaatattttggaaaaacatctatactgaacttgtacagactctttcccttgtcattgtttttaaaacaatgtaacaacgatttacatagcatttatattgtgttaagtattacaagtaatctaaagatgacttaaagtatacaggaggggccaggcacagtgacccacacctgtaatcccagcagtttgagaggccaaggtgggcagatggctttgagcccaggagttcaagaccagcctgggcaacatagccaaaacctcatctctataaaaaatgaaaaaattagctgggtatgatggcgcatgcctgtagtctcagctacttgagagacttgagaggttgaggcttcagtgagccagaattgtacgactgcattccagcctaggtgacagagcaagaccaccctgctaggtcaaaaaataaaaagggagaaagtatacaggaggatatgtgtaggttatatgcaaatactgtgacattttctataagggacttgagcatctgtggattttggtatctgcagggaatcctggaaccaataccccatggatacagagggacaactgtactaaatttggagactggattggcatgcctcagtgtcttccacagtcacctcttttcttgttaggtttcatagagaatctttgtgcatcttgaaagagaaatatttagacatgtttaaagagtttttgacacatgatctttgccatgaactattaggtaattttataagattcgcagttcatatggtaaattattttctcccaaagagccaaattaagattgtcagctggaaccaaatccttgctttcgttttaaagcatattaaatctgtattattgttggaaaatatatatagttattttccagcttgttccccagtgcacatattttcagttacagtgattattttggatagagcatatatgtgtgtatatgctctatcacatatatatatatagatgtgttaatatgctgtgttttattttgacttgaattaggtaatgacagaatttttaaatttttaagtgatttctttaatgatacgtttcaaatatccagatttttttttttttaagactgattggatatttttccttttttctaaatttttttttttttttttttgagatggagcttcacagttgttgcccaggctggagtgcaatggtgcgatctcggctcactgcaacctctgccttccagattcaagcgattctcctgccccagcctcccaagtagctgggattacaggcatgtgccaccatgcctggctgatttttctttttctttttcttttttttgagacagagttttgctcttgttgcccaggctggagtgcaatggcgcaatcttggctcaccacaacctccgcctcctgagttcaagtgattctcctgcctcagcctcccgagtagctgggattacaggcatgtgccaccacatctggctaattttgtatttttagtagagatggggtgtctccatgttggtcaggctggtgtcgaactcccgacctcaggtgatccacccgcctcagcctcccaaagtactgggattacaggtgtgagccactgcgcctggcctaattttgtatttttagtagaggtggggtttcaccatgttggtcaggctgatctcaaacacctgacgtcaggtgatccacccgccttggcctcccgaagtgctgggattacgagcatgagccaccatgcctggccccagccccttctttctaaattgaaggagacataatttctaaggatatgttaagaaaactaggagctaaaatattaaatcacacctaggatctttaagcttaattcaaatacatagaaatatatcctcaactgataggtactatgcactgtaaagagagaagatgagttagtgtccagatccttttttgggaggtgccgtaagtatttcagctattttacctgacttttttttcttttatttgagaaagttcatgatagttttattttattccttaaaacatttaacataatctgggaaatttttttctcttcttttgtcaaagcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacaggtatggaatttttggataatctactttttgaagttgcatttttgttttgagaagggaggtctttgcattattattttagaatatagttcttagaccatgaaaatttgatttaggatagacttgtttctcttttcagtaaaatatatttaaattgatttgagaaatttattgaaatattataaacaatatactgccctaggcacaaatggaacataccatgatgagtaatttctcttcttcaggaattcataatctaatatgggagcaatctggtagcgctgacatcaaacaaattaactttctgttgctttttccccccatgatggtagttttcttccttaacctaaatatgattgctttttcttttctattttaatagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacaggtaaacacattgtatgttctcagttttaaatgtattatttgaggaagctgttcatttcatcaaactgagtaatttctacacaggagttaatgttttattttttttattctgtagagtttgtcatactgcaaaaaagaaaaatgaaattgatgaaattaacaccagtttaatttattctgtatctgatttcagttttcacgaattcgcaggggaatccttaaatattaaagctttgttttgtgatagttgtctggcaaggaaaaggacccaaatcatcaaattatttttcctaatatattgaatagttaaatgtaactggtatttcatcaaactttgaaacattaccatagccacataatgaaagtatcaggatttaaaaagccactaacctgtcaggcacggtggcgcatgcttgtaatcccagctacttgagaggctgagacaggaggatcacttgagtccaggaatttgaggccagcctgggcaacatagcaagatcccatatctaaaaataaaaagccagtaacctttaaaaagccattaattaccacaaatcccagtgatttttgtttcttcccatttagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttaggtaatgcttttaatttcctgccgaatttaaattgctattagaagagggaaacagagctgggtgtggtggcttgtgcctgtaatcctagctactagctgaggcaggaggattgcttgaggctaggagtttgagaccagcctgggcaatatagtgagaccacccccccccccccccaacctcttcaacaaatttaaaaattttttaaaagaaatagacaaatgaagttagtattaatcaggaagctgttactgctttctacttctttctcccctttgaaatatatataatctgctatttagtgctaatgagaggtcatagacatttttttcctctaagaactctacagactctgaaaacattacctttgtttttaagtattaactgtgttagcattaccttgcacccttaatgatgcagtttatcatatgacatcctcaaaatgtagctattctgcgtaggcaaagcctcctacgatgtgatgagacttgtcctctctccaaatttctaccttttaactttacattctaaattaattttaggctgggcgcagtggctcaggcctgtaatcccaatactttgggaggccgaggtgggcggatcacttgaggtcaggagttcgagaccaacctggccaacatggtaaaaccctgcctctagtaaaaatacaaaaattggccggctatggcggcaggcactgcacctgtattcgcggctactcaggaggctgagacaaaaggatcacttgaacccaggaggtggaggttgcagtgagccgaggtcacgccactgcactccagcctgggagacagaacgagactctgtctcaatttaaaaaataataataataaattttagagatttccgaactgaaaggactttccctttaggaactttccatggtgagatagggttgtaagttagtggtgatgaatcataagaatgtttcctttttcaaagtggctaaagtcaaagccaaacctatgccctagttataataaggaaatagttctttaagatatgctttttagttttatgtcttttagtcttatatctctacctccatgttatattcttttagtttccttttcttctaccttagttgtaatttatgcctctttctgcattttatattttgtgtaagttgcctgtaatcttactcttaatttcccttttttcttccaccttgttataatttatgcctcttgctatgctttgtattctgtgtaagttgcctgtaatcctgtctagaaggaagtacaatataaaatagtccaacaatttatacatttacttaatctttatagatgaggcctacttgtccttttctctaagtttattctatcccatcatcaaacctgtgcctttgtagtctcatgtactgaggcctgtaagtccctcaataggtatgaagacctatcttcattcaaacatcatccccgaatcagcttcctccatcgaacctccctaaatatagataaaagaaactcttcctgaaaaagtccagtagtattgttcttatctctgaacaattgatttcatctgcttggttgttcttcctttgtcttcatttttgttatctgttaaatcttaagcctttagagctcagatatggtgttcattataggattcttagcaaaatcttacttgcatatgaatactgtaaatactttttaatggtgatagctttgcttttgtaagtcatagtatttggcaacattttgtatgtacagtttaattgaagacttttctttttttcaacttaactctaaatttaacataatacctatttgctttttttttttttttttttttttttttaaaagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattggtaggagttttcttgagtctcaacgtatattactatgggtattagagtggcatgcgatatgcttataagattttattattagaattacagttggaataaagcactgagtttttctattcctccttgaggagtttgtttgttttgttttgagacggagtctcactgtgtcacccaagatggagtgcagtggcgcgatctcggctcacagcaacctccacctcctgggttcaagtgattctcctgcctcagcctcccgagtagctgggactacagacacgtgccaccatgcctggccaatttttgtatttttagtagaggtgcggggtttcaccatgttggccaggctggtctcaaactcctgacctcaggtgatccgcctgctttggcctcccaaagtgctgggattacaggcgtgagccaccctgcttggccctccttgagctttagaatgaaagcagttggctgggcacagtggctcacggctgtaatcctagcactttgggagaccgaggcagacagattgcctcagctcaggagttccagaccaacctgggcaacacaggacatggatgaagctggaaaccatcattctcagcaaactaatgcaggaacagaaaaccatacactgcatgttctcactcataagtgggagttgaacagtgagaacacatggacacagggaggggaacatcacacactggaacctgtcgggggtggggggctaggggacggatagcattaggagaaatacctaatgtagatgacgggttgatgggtgcagcaaaccaccatgacatatgtatacctatgtaaccagcatattctgcacaagtatcccagaatttaaagtataataattaaaaaaaaataacaaaaaattagctgggcatagcagcgtgcgcctgtagtcccagttattcgggagacagaggcaggagaatggtgtgaacccaggaggcggaagttgcagtgaggcgagatcgcaccattgcactccagcctgggggacagagtgagactctgtctcaaaaaaaaaaaaatgaaaacaacgaagagttttagattctttccaggtaaattaagagattcaaaactgagttacaaacttccctcaattctattatttatggaattgtttaatagaaactaattgtcttcttagttcctacattccaaccattgttgccatatgttttcagtcatggaaggatgaatttaagaaaattatgatggaaataaagcttcttactgtccttttgtgtatgacaaatgcttggcgattttttgctatataaacctctttaacttgtttctaatggtttactgattctaaaaacaacaaaagcaatgcagtcaaaatgcctcagtgcctctaagaataagaattagcaatcaaagggcacgtgtctaagcagtgtgccttattctaaataataaaattgacattccattttatatatccccaatttcatcattttgctccctttttttcatttagatgcaaataggttttttcgtagtagcttcttattgagaggttatacccttaagaaattggtgcatttttcttttaagagtgataactaatttagtagaattccttagtattgcaaattcttatttgtgatgttatatttactaaagaagccattctgattagcattgcaaaagtttggatgaaaggaaattaattgcattgctttagattattgcttataatctcccttaaacttgactttttgttttaattcctgcaggactaaggtattaaagcatgattcagttaaggactactgagatgcgattaaacccaggataaggttgccatctcagaaatctgtaatgattattaaataataaaatttaagagcttgtaatatttgaattacttcttagtgtacgttgaactaattactatgaaataagtaactttatatttcttttctagattttgatgcaattacagatcctataatgaaagccaaaatggtggcccttaaaggtataaataaagtgatggcacaaaacaatctgggcatgccaccaatggtgatgagcaggtaggtggagtggctgcttgtttctactgggcatctagacattcatgaaatcattactagtttttagaaaaaacatacagaaaatggaaagcccttgtctaggaatgaacaacactatttaagttgtcatggcatcagctcgatatgatcagatacaaaatgctataccaatttaagaaattagtgtaagaaccagtttaagagcattagtctcaaggatggtaaatgtaaaacatcttaaaaagatttggaagattggatttcctgattactcaagtcaaagtatttaggtctgtgctcttttaaatacctttagaattgttcatgttatctaagatttttttcagttaagacactgagtgattaaagcaattataaattcagttctaaaataaaatgttcccaaaccggttttgaatcagaaaaagaaagttacaaggaatagataagaggacagttggaagttggagttacagagtttgtcttttctctcttaggagaaaaacagaaattacgcattaaagaagacagtaggggttatttcaatatctgaatttttgaaattatgccctctaagggttgttaaccacatggcactgtttcttaaattttgatcatggaccaccatgagaattatggggtaatttttttaaaatgcagattattttgctctactgcagacctactaaataagaatatctggagatggttgcctgtgtgtctgtatttttagcaagcgtcatgaatgagtcttacgtgtattactatatgagaacctctgtcaataaagtaagcatagagcctcaatttagtctagttatcttgttgaaaaacttttatataaaaaatgtggatgattatagaattgaatataaaatttgcacgaatttaagatgtatatatttcaaagaaatttgaattcttaagggtataattcttttcaattgttgagatactttggacatggttaagaagcatttttgagatcaaagtagagatagtggtttccaatgattttcattattgagcaatatttattaacactatttctctatcatagagattcctaactgttttatgtcttgaatatttttggattccagtgaagcctttgaaattctcagaatgttttatatgcagaaaatttaagacatagcattacgaaggaaatgattatacttgaaatatagttattaaaatataattaaatttatgtatatatgttccttaaagtattaacaaatttagcaataaaccataatttgaaagtaatgatgaacataactaatctattaggtgcctgcaacactcgataggaaaataatctgtcttctattggtgatagttgtggtacttgctaataatattgtagtttctatgtatattcaaaacaaggaaatgctgagttttatttactacttagttttgttttggtttttgtttctgagacggagtttcgctgttgttgcccaggatagagtgcaatggctcactgcagccttcacctccaaggttcaagcgattctcctgcatcagcctctggagtagctcggatcacaggcacgtgccaccatgcgcagctaatttttgtatttttggtagagacagggtttcaccatgttggtcaggctgttcttgaacttctgacctcaggtgatccacctgcctccccctcccaaagtgctgcaattacaggcatgagccactgcacccgaccagcacttagttttaaatatggacctcagaatttgaggcctttcagcatctgatgctcttttagcatcatgcatctgccggttagatacattagtcatgtatcaggtatatggcttagtattctactgactgctttttagaaatggaagtgatagtcccttcttagagtagtgtgatatgttgagttaggatgatagaccatgtgtgatattcagattagaagatcatttagaccagacctgtagcagtgggtagggtgacagatcaatgaaaaacctgagtaaaaaatttaaaaacatattctatatcctaatagtacttaaatagtaatatacagcttttggaatacatttttaaaattgtatgtatatcttgatacgttaaagcatttgataatgccagaggaaatactttcatgtaagcagtaatgcttctgtgaagtttttatagttttaattagaatgagtaacatttctctaaacacgtttaaccatgcagactgatcttggtcagtcgtccatttttgatttgctttaacattagatatagaaatgtatgaaaatgtatgaaaattcttaaattgggaaatgtcttttgttttagaatataaaataactaagctctcaattagtttttaacacagactggaatgagaaaacatttccttagagttcgttataaaactaaatcaacttatttttattctgaagtcttgaattcattttatcgtaaagtggagtgaggcacataatagagtaaaacctctagagtcagcctagctggcttcttattgcagccctactagtccttgtggggaaggttacggaatatctctgaatcttactttcatcataagtaacatgagggtgctaagagcacacttcatcgaattacagtgaggatcacatctgcccagtacatgaaaggtagggctttagtgttttgatgaagaagaaattgccactgttcttctctggaagagaaaactgttaagcacctaatacagtttttaattaatattaataatttctaaacgctcatcacttgatacttgtgtaccctgttttgacaggttcccttttatgggccaggtggtaactggaacacagaacagtgaaggacagaaccttggaccacaggccattcctcaggtaacactgcctgtaatgagtccctctagaatgcacgcttttctgtttcccagcaaactcatgctttagagtaagtcccctgctagagagtagtactaggtttgtgcagaagtaaatgcggatttcaccatatgccatttgccagtggcaaaaaccgcaattactttttcaccaacctaaatagtagccttatctatcagcacagccaaaagtaaccaaaaagacactttactgctttttaaacaaaagacaaattaaggttaaaaaaattggctgtgatttctgaaaaggatttatatacttacgggtaaaaagtcacttgatggcaaaaccacacgctcaggacttttggttttatttttatttacttatttttaactccagaaggacattttcatgtcctgcattttagaattaaacccattatatttaaaatgtaaaacttctataaatactagaaaatggctgggcacggtggctcactcctctaatcccagcactttgggaggccgagatgggcaaattatgaagtcagcagtttgagaccagcctgaccaacgtagtgaaaccccgtctctacaaaaaatacaaaaattagtcaggcgtggtggcgcacacctatagtcccagctacttgggagactgaggcaggagaatcgcttgaacccgggaggcagaggttgcagtgagccgagatcacgccactgcactccagcttgggtgacagagcgagacttcatctcaaacaaacaaacacagcaagtagaaaacaatatgctatatttgttttttccttttttcttcccatccttgttgaaagatatgctatatttttaatataatatcaagcagtatctggggaagtaaaactcatgcagtatttttgtcagtgattttttttttataaagggagctacctactataatgtatgtcctgttttcttccttgccctgccagttatgctttagatttattatgctgataattatattcttctcattattaaaagaggaaacagaagccatttgatataatgggaaaagcatagcctttatagctgagtttttttaaagaaattatagttccactatgaatttactgtgcaactttgggcaaattctttagcctcttgttttttaatatgtcaaatgttaaaccaactgctttgtagtattgtgaagattgcacataatacattctggctgctagtataagtttataattattaccttgtatacagctcatgttaaggagaacttgtgacaactggataaacatttttcaacattaatttgttaggtgattatcagggacttgtgagattaataactgcttgttcagtcacctggaagaaataagacttttaacttgaaaataaaacgaattaaatactttttatttattttttttatttttttgggaacaggatcctgctgtgttgcccaggctggcctcaaacacctgggctcaagcgatcctaccacctcagcctcccaagtagccgggactacaggcgtgtgtagaaaataagactaatatttttattaacgtatttttcttttatatttgtgcatgttagagacattagtttttgttataaataaccatgctgtggagtggcatttagtcaatctggaacttgtgtttgattgaagaagaaaccaggtaaacttcatcaaaaagtgagattttttatatagatctctcgcttagtattagcagtaattgatttgccctgtattatatttctgatgaataatcctttacctcaagcataattgttttcagccaaaatctagacagtatagtagttcagagatagtaataagaattcagaattaggttgccaccactaaattcactctactttttataaaaaaacctttaaaagatatcttaggaaattaaagggttttttcttccatttctttttttctttctttcttttaaagttttttcccccctttaactgaaatgtggaataaacatatttgtaaattttacttattttaggatggcagtataacacatcagatttctaggcctaatcctccaaattttggtccaggctttgtcagtaagtataaatctaataagttaatgttttctggggattgcttgtctgcactctatgtgtgctgttctaaacctgaagtgagtgtaggtacaccagttcaagcccaggtgccctcctgtcttattaaacatcactgccctattaggcaactcttcttcaaggcgtgtgttttcattgcttttttcactgtgcatgaagaattatagttacagaaaagtattttaatacagaaaaaccatcttccccattctcttcaatattgttgctgtttttgtatacagattgggcactttacagtctatagaactaaaccacgttttgctctaagaactgtcttcctaagtgacaaggacactaaatgggaaaaacaaagggattatacttagcagtaagttgggttagcagcatggtgtaaaggtcaggtatgcaaggtgcccctgaatcctttctagttatttgcaggggtcccaaggtggttcaggatagtgtttaaagttctccccaaactgaacctttctgaaatcttcagactgtttagctaacttttttttcaccattatttttcattttgctcacctctgctctcctggttccagaaaccagaaaggctttccttgcggtaggtctcattctaccagaagcagaacttctgaaatcttgtgaaaaagcctgttcttaaaaaatgcccttcaaatttagtagactagatttcaagttcatacatgtactggaacttctgggtttaggaacaaacccaaagtctgaccttttgaaattccccctacattaattgttactataatttgaatacatatttgcattaaaaacaagtaaagaactataccaactggctttttctggctttattgtgcccattggctttggttggattcttaatgtatgacaatattctgttatcattgatgttattttcagcgaatgtccttcttagaaatgtatttattcatttctttgtcttgtagtgagtcaaaaaggtatattcagaatttcactacatacgatgactttttttttttccccttggactgggtatcaatgaagtaaagtgcccttaaagaataaagaagagaatattggtacaaaatgaagagatatagccatttggggagaattactggcagttgtaaaagtagaaaatgttttgcttggttaactattccctccccttattttaaaaaatataactacagaataataattaccaatgttttcaacttatggatttcctttataagtcatagactttaaattattccattctaaaacattctgggttccttttctctctgtttaggatattttttcattattaagaaataggaaagaacttataaactcaggaaaattaacatgggaagtgatttcctagtctatgcgctagaccttaatgggatatgtctttgtctcttcaaaatctgtaaaatcgtattcataaaatgcatgtataccttagtatgtagtttggcttgtgggttagagaatttgtttagtaaaaaaaaagaatttcattacataagtctgcttttccaagattggatttgtaatatttataagtgctaagttaaccagtatctcaagaatgtgcattctctggctttctcaattaaatatttttctaaaatctgatattttatcattacataatcgtctaatatttagtattgtgttttcaaatttcctattatgtggtcatggtgaaactacttccttacaaaatagatttgtgtaacttataatgttggactctttagaaaattaacacaactgaattttaatttttcctcagatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacaggtaataaataggtttgcaaaatagaaactaccaacaattaatgagtagaatgttttggtgtgttgttcattagtgactttgactagtgattttttttgactagtattaaatggcattaaaagtacattgccaaaaagtgacagctctgagacctcttagtaactgcagccataacagctccagtcttttacttaaagtgacggtcacagcacatactaaataaatgacacaaaagagattgagtctcataatttcgacttcgaagaactattttcaactttggtatagttggagacgttatttttttctgcactaagaaatcactgcaaagaccatgtttctgttatacatcattgagagtattcgacttaactgaggaccgagctcatggggagatactgggtttagtttggaataagaattgggggcccagggagtatttttgtttacttggagttgatattattattatttcttaatgttttggtcttaaaatacattggtatgtcttatgtgaagtactgttccagaaaaatgaaatcattttgccattatcttctattataaaccagaagtttatcagaatatttaaactgaataatatactggaaaagaagaaacatgtaaaaattgtatttaaaataaaacaatagtagtgtacaaaatgggttcagagccaactcctaggtatatttacccaagtaaattaaaaacttaaggttcaggccaggcgtggtggttcatacctgtaattccagcactttgggaggccgaggtgggtggatcacttgaggtcaggagtttgagaccagcctggccaacatggtgaaaccccgtctctactaaaaatacaaaaattagctaagtatggtggtgtgtgcctgtaatcccagctatttgggaggctgaggcaggagaatccctgcaccaaggagtcagaggttgtggtgagccgagcttgcgccactgtactccagcctggcgacaaagtgagactccatctcaaaaaaaaaaaaaaaaaatgtgagtgctctataatgaacactgtaggaagcacttccatttacgttgtcttatctacatctttctgaaggagttagtattatccccattttacaaactgattcattgtaaaggttataaacactgtgtacacgtggccaggcacggtggctcacgcctgtaatcccagcactttgggaagccaagacaggcggatcacctgaggccaggagttcgagaccagctggccaacgtggcaaaactcgtctctactaaaaatacaagaagttagccaggcatggtggcaggtgcctgtaatcccagctgcttgggaggttgaggcaggagaattgcttgaatccgggaggtggaggctgcagtgagctgagattgcaccattgcactccagcctgggcaacaagagcaaaactcttgtctcaaaaacaaaacaaaacaaaaaaaatcccaaaaaatacccccactgtacatgtttgcttataactattagattagggatttggactcacgtgtcttatcttcaaaccacagctaccacaataatgtaccaacaataaggtgatcataattccagttgtttaaaactaggattattccagaatgaaaggtttcttttctctttaaatctactctctgggttcatgtttactgtaggttaatattcttgtaaagatatgtttaataaagtatattttttttagcactttcattgccatctggcatatttgtacaaggtcttttgatgagggcctaatttttgcatatccatagatcaaatcctatttagaagctaatacttgaaaaatgggatacatcatctattacatagttgccaaagatccagtataatcatattaagataagcagttgatggtaatgttttaaaaagtattataaaatatcatgggaaagacatggatgaccaccttatatatcccacatagtgttgtaggtgctttctgtactttcttactacttcaccaaccaatggtaatttctcagttctaaccagtaaactggccaggaaaaataagaaaataggagttacacaactgttgaagaagagatgaaacacgattatttgcagaaagtattagtctacctggggaacccaagaaaatactttgaaaaactattagaactcctgagtttagtatattaatatttatctaaaaattgaatgatgttgagagatatacacatccttttgcattccttctttccctagcttgctgaatgagatggtgaggttctccagaacatagtttgcgtcttgattgatatctggcctgtagtattgagcacattgggacacaaaggtttttggaatgaattaattaattgatattagccattatattaagagtctatttacagactattcaaaatacttcctcggagcttgtatagatttcagaaattataatttgagtgttagccattaaattgaaagtgttcaacaaatttagtctttttaatctgggtggggggtgtgatattcgtgctggtaattcatcttgtcttaaaatgttgtacaggccgggcgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaatgttgtacaatttatatatttaagaaatgaaatcttaacatttaaatggttcaagtttgagttaagtctgttattctaacattgtatattgtaatttctaggacatcaaaattagctgcttgtgtaaccttttttattgtatattttttatgtatagtataaatagtatatatgagtttcaccataagattttaatattttactaaaccgtttttgatatttcatatgtgaagcacttttacagataactttataaaaatcctgttgttaaagagattgacagttgttagttaaggcttatcaattcaatttttttgtgacttttgcagttacccaagcaaaatatgtttgcttctgcagggccaaactgccctctgtgtaacctcaaccacagtcatcagccagtgttttacttcagtacctatgctgtatagaaatgagtaatgatgcattttgttattccagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactggtaagtgtaaatcataaaaacgacaacttttttcttttgttttaaattatacttacagcagattagtaccagcaactgtatttccacattattctacaacctttttattctaaaggaccattttttattttgtcatttctacctctctggaacccatgtttttacttatatctaaactatattaaataataatttgtttactattttttaaaaagcaaaggcatgtattgcatttcatatataacgtgatgtgtagcaactggttattaccacattgagttgatatgactaaagcaaagtaagtaaatgtctatgtactttattgtaaataagtgattaatttccattaacctctttaaaatgcagaggatagcccatgcacccctattaatacccttggcactcttagggataccacactgggaagctattgtgtggttacagtgttgtattgatacttaatgtaatgttacatgtagatactgttttgtagttttccatgtatcaattttctatcagttttaagttattaacatttaatttgctttttttttcatttacatgaagagctaacttgtaaatatacctttacaagaatctgtcccctttatttcagttaacttcattaagatagttccaaaactggagtttgagtcatgggaattggtctgcttaatagctcttgcctgtttatctttcagaaggtgcagtgccattaccagtgcattcataaagctgtccctagagagcttctcaaattggatttcattttcatattttaattaagggttgagtggtatatttagttgtccagttttttcattttaagattgttaatgaagctcatctttttgcaagtgttgctttttttcttgtctttgaccattcagtagagattgagtgttgacttgatagatttgtgtaatttttgtaaattttactggttatgcttttacagttgtcaccagtaaatataggcaactctccagcacagtctccatccactttctccaagacatcttataccctgaggagtactgaataacttgcagccttctgtctttttacccttctatgtataccacatgctgctgcttctgcctgttctgttctcccttcttatatacgtctggacaatatatttttatcttttgaaatgcagttcttgagtcatctttttccagatacctttctcacctctcccaatctcaaatatgtgttgatgctcgtgttctcacatagcgatttctgttgtaccacttaacattatttaaatagctccttgaaggacgtagactacattttgagcatgtttatattaaaatttgtgggtgtaagaatgtttaatggcatggggaacaaccacgtcaagtttaaaaagtagcccctccccccaaattaaagtgtgatttaaataaatatatagtgatttaaatatatataaatatatacatctatatataaatatatatataaatataaatatataaatatatatatataattaatttttaggttcttgccactcagagtgcagtccttggggatccgcagcatccacatcaggtgggagctttgtaacacatgcagaatctcccgccacacacctgcttctcagaatgtagacttaggaagatccccaggtgattcctgagcatctgaaggggagaagtactgctctaggcaggtgattctcaaagctaaagtgtgaggagcaccaggagggcttgttaaaccaagattgctgggctccagccccggtatttctgattctgcaggtctgggtgggaccagataatctgcatttctagaccagctctagatgctgctgccgccctggagaccccttgagagccacagaactagcctggagatgagcagtctaagcctgctttcgcctccctccatgagctaaaaatggcttttacatttttaaatggttgaaaaaaaatctaaggaagagtagtattttgtgacacataaaaattatacaaaattcaaatttgtccgtgaattttaaaagttttatttgaacgcagccaagctcattgatttatgaattgtttatggctgcttttgaagtacaagggcagagttgagtaattatgccaggggctgtatggcctacagaggcttacaatatttatcatctggctctttacataaaaatgttgccatccatgcgctaaactatttagaatataactggaaactaattttcagaaccgtcagagattcaatgcagaattcattacagtaagttcagctactataatcgtctatagcagagtactgctgttaaatttagaaataatggagcctgaaaatattcctgtgttttaaggtactgataggactacccttaaaggccttttcagggcttggcttattctcactttgtaatgataaaaataaagaaaaggtttatttgttatcatctacgttctctcccattgactttaagtatgtggccattatttttcagtcaaatacggttgtgaactaatttgaagaaccagtgttttttctttttattgttgtctggtgctatctgttctctcacctaagatgcataggctgtaaagcttttctggagcctgtgaattgtttcagcacacctcatatttcactagttcctaaggggaaccaaaaataactcaccaagaccactatgcagaggctcctatagccatctacaagcatttccttcccttctgcagtaagtaagcaggaataaggggttccccagccccagggaggtcagcatgaggggtaatgctttgccagaaagggctgtggccttactaatgagttctgctctttcctcaagcttcgcagcttactgatttccatactcgagaataacgtttgaagaaaaggatggtgtttttggaaaaccagcattgacaccactctatcttccctacttatttaataccttttagtgccatgttaggatgacgcgtcatagcttggcactgcatgaactaaaaaccaaatatgcaaattgttcacttattttttaccctttccaattacattagcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacaggtgagggtgagtcatttagagcagcctcttttaaaagtcaaggatataggctgggggcagtggctcatgcctgtaatcccagcactttgggaggctgaggcaggtggatcacttgaggcatgagttctagatgagcttagccaacatggcaaaacctcatctctacgaaaaatacaaacatttactgggcgtggtggtacacgcctgtaattccagctacttgggaggctgaggcacgagaattgcttgagcctggatggcagaggttgcagtgagccgagattgtgccactgcactccagcctgggtgacagaatgagactgtgtctcaaaaaaaaaaacaaaaaaaaaacaaacaattcaaggacacgagagatcaaatgctaaaagacatctggacaaggaacctagtagactttttccaagcagaattgcaccgtatcctattggcatctgaaatttacggtaatacaaatggattgataggtgatagtcaagattttcttatgttcataaggagtagcctcagtaccaagaaaaaaatctgtcctcagtactttgttgtgactctgaatccaaagaaacacattgtgaattctgttctacacctttgtggttgttacagaaggtgggagacagttgctaacagtgctgttggtggtacccagcctcagttgatgccccagtttttgctgagcatagataagaaatatgtttttcttgttagatgcctggcagcattcatttagtacagagcttatttttaagtctcaaaggtctgtagtctctctcacttactccagcattttgatacttgaaaattttaagtctcatttttctgaagccttattcaacaaagttgcttcgggtcttagaaagttgagctacactgagttccttttatcatgtacattactcttaaatgtgttttttaatagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaaggtatgtttctctgccaaggtgttgtcttgcttcatctttgggtaacatgtcagaattgatagagcttgtcttatttttgtatttagtttacatctactcttccaagttttattaaaacttaagttcagctacagggttaaaattttacctggtgaagtatttctagcataaacatttgaagttgtttttataggtaagaatacaaattgcaagaaatatctattatgtacttccatggtagtggaaatccttatttccttataacctttattaacacttaaaatgaattcaaaaatcattgtaaatggtggggatttaaaaaaagtagtagtttaccttgaaaaatgaaattaaacaattttaagtatatctaataatttaggtattaattacaagtaattcctagactattgtaggttttttttttttttttgagacagggtctcgctctgtcacccaggccagattgcagtggtgcaatctcagctccctgcaatctctgcctcccaaattcaagcaattctagtgcctcaacctaccaagtagctgggactacaggcatgcaccaccacaccctgaggtcaaggctgcagtgagcatgattgtgccattgccctctacctctagcttgggtgacagagcaagtctctgtctccaaaaagaaaaaaaaaaaactatcttaactcataagctgttctccaaccttattttatcatcctcatgaaattctttatctttgcaaaatttgtaatttgactttgcacttgatttgcatggtgttattggtagattccaagtctctccttgagagactaatcagtaaatgacaaattggtgataactgttaagctgggagaggtgtctgaagaggaactacattaatgatttagttactttagtagtagcattagtactgttgcttcttttaaaggtcttagtcaatccagattctcatatctcggatgtgagttgtattacaagtttaagaccagaaattcttaagtttttcatagaactagggcatatcttaatgagaacttaaaggatattttgataatattttgcaatttcttgattgcattttaaagttatccttcactagctataaccacgaaacttgaagaattgcataaataaaatcaggtagaaaggaaattagcttcttaatttcagagcttaagtagtcaagctgggtaaagtaagcaagttggtatgtccataaaatcacgagtatctgttccactaagaagcctcctggccttgtaggtattgttttcttggtgtgcaagatacatcttgattacatttctgtagccttgcttctatgtgcaaaaaattcacagaactacgttttagcaaggtcattgcatattcgctcagtagcatataatttaaattttttggtctcctgcagcagaataatttaagtaatcctccaacaccccctgcctctcttcctcctacaccacctcctatggcttgtcagaagatggccaatggttttgcaacaactgaagaacttgctggaaaagccggagtgttagtgagccatgaaggtatgattatagcctccaaatttcacacctcggagaaatgtgcctctgccagttgtgtattgtgaaatggcaatagaattgtaaagttctacccatttatcaatattgactgaatgtatttatggttttgtgtttttgcttttccagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggtacaggttatttttttctcaaataattcttagttatttcttcttttaaaaaaaataaatgtatgtatgtggcataatgtctttaggaatagcatgtaaaaacatttgaagagtacaatttggtgaataatcttcaggatttaaagtttataagacattgttaccattaaacataattagtttgcatttttttaagcctacatcatatagagagttaaataatctaatagacagttaagtattagattatttaatctaattaaataatctaatagacatgaaggtagtggaaaatctccatgcaacatatttcagaaatcattgtcctttaaagggtattaatgtgatttattgggtttattgttgtttgtagatgtctaaaatgaaagagcagaagttgctatatcagagaacgccgtcgtggaagagagtttaagaactgtctggggtttgatgtctttgtgtcagttctttaactgtaagattctaattggggagaatcaagttcccttagtagatgatcgctagccaactctttagatccagagggttcttacaacttcatcaaataattatctcttctttggaaaatctgcccactaccctctatttgatgagacatttatttaacctaagtcccttactttattaatggggaaactttggaccgaagtggagaataatctgtcccaattgaggatccaggtcctctttctactgtacctcagtaggccagcctttcttgggtctcctgcatgacagctacttctctgcgtgaggagtgggagacagcagttccacagggttgtggaacttagtctgagacctcacaattggcctggtagactcaaacttgaactcaacagaagggaccagtcttttgtttttctcacctcactttatcagttaagaaaaataagggccgatcaagtcaatggctaagttttctcccatcttgccagtgtaaagagcagcagtaggacagctgttttcccagtcaggtgaatgcaggtgtgaccattgcatatgtgttggacttctctttccttttttttttgtctttttaaagttttccttttttattgttaaatccaaccagcagctctttccttttcaagctgcaggagtgctgccctaggctcaacgatctgggattttgaaaaggtgctttcatgctctctatgttacatgctaatcagaacatcttcctctttggcaggtcttcaaactttggtgctgaagctttcgttaaaaggaaacataccatttaaattattttgtaactaaatattgttcttgtatttttttcccagtgtggctctgagctgattcatttgctgctcatcgtataggtgctgcccagagtatccttacagctgtattcacagatgtcagcagggttggtacaggaagcccccagtggtggatttgcagactttgatgtgtgtgtttatgttttttcaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagtaagaacaacacttaaccttattatttccctttacactacgccaatttactaatgtaaatattttgattttgaaaatccattaacactattttcctcttttttttctctctttttaaaggttcagaatcaagaaggaatgacatcaaaactgagccaggcactttatattttgcgtcaccttttggtccttccccaaatggtcccagatcaggtcttatatctgtagcaattactctgcatcctacagctgctgaggtaaaagattaaatgacttcttaatgttaaacagtatgtccccaattttcaaagatgggtcaggtgtctaccataaaacacacacaaacaggatcactgaggataaagggtcagagagcagagctgatgctcactgcagacctctcagctgcctttgagtgccatcgtttgtcattgaattggtctcagcctacgtcaagtaaaaagggaaattagagctcacattttcttattaaaggatgtatactttagagaactctttttttttttttttttttaatagagacacagtctccttctgttgcccaggctggagtgcagtggcacagtcatagctcactgcagcctcaaacttactgggctcaagtaatccttctgctttagcctcctcagtagctgggactacatgtgtgagccatcatgtccatctcagaaaaaacttctttgtaactgttaacagagaagaaaattaagcaatgaaaaagaactttatcaacagtaatagttttgcagaagcaatagaaatgttcttcaagtagcatctgcttatatcaaacataagtaatttcctgaggattttttatttttttaactctgaattctgtgaagacatttcagtagagaccaaactagaagtccaatgatgtgatattttggttatcaacaaaatacagcagtagcaagacctttgtctgttcttacgggttgtgtcagagctggagggaagcccctggaagtaagctttctgaccacctgtaggaactgacggggtctgtcagatgttacaatatctaaaatagtttaatgtgttactagatatttaatgttaattggaatccctttatgaggatttctgtttataaatttctttttttggatattagttcgttagagctaatttttttcctgaggttctttaagtctaaataaaatttgttggattttcttagaatctatgtatcatgcaaagaggatttatcctaagtgtgtatttttcttcagtggttcactgttgccttctgggtgaataatacagcatttgcatttggttttagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtgagctagtgagctttttgttaaccccaaatccattcctgattcaaaagttaagcttactctttgagatactgattatcttttaacaacggacaggtaacatgctggcgtatagtccttggtgaacttaccatgtgtgggtgttctgttttctgtgctgtgattttgacctctagtgctttggcctgtgtattctgtcatgctgtcaccaggggctatgtgagtgccagccatctgtgcaggctgccagaagaagcctgtgacgggcttgcccttgagcagcttttgttcttcctgtctcccaacccccatcccgctgcacctgggccacctggtacagatggggctggtgacctgacgtgggttctgtttcctgttctcctctgctttccatcctcacctacctcttgttttacctctgcaccagctctatagggcccttctcttcccacagaggtgttcatgccccccatctctgagaatggaacaacttccttagaccgaccatgatgtcgctttccttcctgcctcactggcaatcttacaggcgtgctcagtccaggccctggcttcctcctcttggcttctagctgttctgtcactttttccctgctcctttttgccttcacactgcacctgaatgatgctttctaattcctgagtccttatttaccttcttatccttggccttggctctttcctcatttctgactctgcaagtcacacttatttaagactcttatacatatgtcattgtatctttcataaaatgtttttttaccatcttaacctgcaagcaaaagtaatatctgtttccctctctgtcttactttgtacttagactgaatagtaatctctcttggtgacttagttttattagattcttcttttatactgccattgctttcccagctatttgagaataggcatgtttctttatttttgccctagtgtcagataatcgactctgtaaccattgcttagaagataaattttttttattaattaaagaataatgttaatgaaccatgttgtaatgagttgatactgcataatttttcaccatgtgccaccttgtgtcatcagtcagttttaattactaacaaaagttgattgcctttaggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggtactttgctactccttttatgaccccacctcctacctccagcgaaaatgtccttggcagtgtctcttccaacatcagagagagacaccacttatggtggtgtgatggacacatgttcctggtgatggcaccagcgtatatcagatgtgcttgggctgaacaccaaagagctacaacaggctgttaaagggaatattatgaggactacgtatttttaaatagagtgaaccgtggaccacatagtttggttttatacatgtattttttccctagctaaattatcacatgctaaatattggaacatagtttcctttctactattaagataaagaaccactgtcacttttgaatataacataaaaataatgtatagatcctgtttttattaaattttgacttgttgagattcccacacatttctctttgcttttcaggattcccgagaaagcaccaagagggtagagaaggacattgtcttctgtagtaataactgctttattctttattcatcaactgcacaagcgaaaaactcagaaaacaaggtgagattaggataatctcagctgataacaatgtgtaacgagtgacttctgtgttctgggcatatgggagtgaataaagatgtgtccctgccttcatggagctctgtgtggggaatccaaagcaggtgctgacccggcagaggaggagagggtgtagggagccttgagtcgtgctactctttcaacttagttatttgacagaagtgggcagagttatgttttaaaagttcagtaaacagaacactaatattaaaatctttaattttaccagtttaatttttttttgagatggagtctcattctggtcccacaggctgaagggcattggcacctcttggctcactgcagactctgcctcccaattcaagcaattctcctgccttagcctcctgagtagctgggattacaggtgcgtgccaccacgcccagctaatttttgtagtttagtagagatggggtttcaccatgttggccaggctggtctcaaactcctgacctcgtgatccgcccacctcagcctctcaaagtgctgggattacaggtgtgagccactgcgcccggccgtaaatatcttaatattttaaaatcatttttattgatgttaccccaataggaaaacctgtttaaagataaaatttaagactatttgtgcattttaagagaaaacactttgctcacagtatggtgaaagaggtctgctttacttgattttatgtaatttgagtgtgtccaactaatggttgatacaaatgatatgtttataatcatgttttgaaggaagcttttcctgtacagtaatactgccagtcattcctccatccaggttattgctctggtatgtctttcacagaagaacattctgaagacttatttttaacaggtagttgtttgtagtatgcctgtaataaaatctaggctagatgacaaataaatttagatcttaaaatacatcagcctaaatgcaagaaggattttttttttcaccagatagtttaagttggtgtgcagtccctgcctgatttggtataaggcatgtcttttttcagataccttgtcaggattggggcatgtgaaaagagggcagcctgtgggttggtgtttattagtttatgatactctgtaccataaagtaaataagctattggagatttcccctcagctcaactgtttcagcagccggatcagagctgagaagcctcagagaaaagttagtatgattcatttgttgacaggggctccttccctttctgtaacatttacaccaattgattaaggctgagattaacagatgtgaattttagagtggagataagctctcaagaaacgatgctgcagcgttcttatttggttaaacaaaaaacactgttccattgtacaaattatattagctcttctgacagcattgtgagtgtgtgtgtgttttttctttttctggttttaatatagttagaaaggggattgtcccagaaagtgtaagagcagaatattctccagaattatggctttgtggaaaaggcctcgaaaggacgcggcacagctgccatcacccgctctctatccctgtgcaccttagagcatggtcagcttctgcggtgcatgagcccccagcacttactgctgactctccctctgcccctcaggtcacccatcctcttcagtcatactgctcagcttcttgtcttaacaagaattgctttccgggcttgtgaattatttttctttgtcatggtttctttatgttgcccaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtaacgtctgccgttcacatgctgtgcagtgctacttactctgatgtcaggctaatgaatgtattttgtcaattttccatgtttgtctcatgttagttttatattttataatgtgtatttttcatttacaaatgccaatgtttgtgttctcacaccttgctctctttgctatacagttgtctaaacactttcataatcaatatatctttgaacatacgagttggtgaggtaaatccgagaatgatttgtagataaaggttgcctgtcatttgcattggggacctcctttttctttttctttttctttttttttttttttttttttgagacggagtttctcttttgttgcacaggctggactgcaatggcgcgatctcagttccctgcaacctccgcctcctgggttcaagtgattctcctgcctcagcctcccgagtagctgggattacaggcttgcgctaccatgcccggctaatttttatatttttagtagtttttaattttgtatttttagtattttagggtttcagcatgttggccaggctgggctcaaactcctgacctcaggtgatccacctgcctcagccacccaaagtgctgggattacaggtgtgagccaccgtacctggcagggaccccctttttcttaaagtcagtttctagaaggcaggaatgacatctaaatcatactgtatacattgtcataagacaatgtataggaacatcagatattacgtaagtttagagatggaaattaaacacttagtttggacctccatggttaagtctagattgtcacttttgcttatgtagaaagtacacaaacaaaagtatgtggagctgctttcttaagtttagcacttaaaaaaaaaaagtctgaaaatactctaaagataattccaaagaaaatatcaatttaacattttaatttaaatctgaggggaaaggaacatagctatagacattaccaattagactaatcattttaaaatctggtatgttatatggccactatgaaagtaaatgaactgtttgcatgaatttcagttacattaagttttttcactttaatgtccttaatctattattttccccaaaatttaggtctttaaaaaaaattgctgccatttaataaacaggttcattagattattaccaaacagatttattagattattgcccaacaggatttatttggaaattagtaaatccttgtgagtggttattcttcattttgctcttgttttttatactgtatcctatttcctataaaaattatgtttttgtccctgtgtaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcagtgagtgtcttggtcaggctttgagattggaattgctttcctgattcagtgtgaccacttgaacacatgctgtaacatttgtggcactcttcagaaagtgactgagcctgtgcattaacccgtttctcttagaggaataaggcattggtgattaatcgggagagctcagccgtgttggtattcacccagttgaggtagttaaccaacttcaggttctcttccaggctggaggcaagcaggggtgaaggacaccaggcttgtcacatcttctgggtgtgctggatgggtgaggacactctcctcttcccttgcctttctgaagtttctcccacctcagaatgtcagtgtgcccatttcctgacacttgggtatttatggccactctcctgccctcttcctaggatgaagtcactagagggcagtagatcgcagcagcactgatttctgtcctctcttgacatttctttgcttaaaagattacaagcctgtttgtcagtgagtctaactgaaccatatctacacaatagttttagaaaattgtatgattctaaggcattgttttcaagaataaaaatatcattggtgtgttttctttggacaggcagaggaaaccccaaaagccactgagtaatgtgcctaattgttttctttggaatcgccctgcctaaatgatacttatcttttatgactacagagaaataaatttcacaagcaatgtattccagaaaagacctttaacatgtaaatgactttgagtaaagcttgagttaacacctatgctttatgctcccaggacatggagagcgataacctcatcacatcagagtcaaattgaaaggagtgagaaacgatcaagaaagaaaccatatagatgattttttaactgtttttaattgtaaaattccagacagagatataaaagttggcattaatacaggggaaagaactcaatgcgaatcattacatgccctgtgtttgtgggtattgtgtgtttcagtcaggccctgaaatcacacaagcgtgtatattggtcagccagtgtttgttgcatgggctaatctttttcttcaaggagcatttggcagggtttacctaagtttggctttgaaactgaatttgcatactcatatttaagtagatctacctgcaggccaatagtgttaacataagctagaagaccattttattatcggggaaaacgctgatgagttatttctgtcgtgggccatcctttgaccagcttgagattgtctgtagtctccatcagatggggtgactttgtgtctgctttgcttcttttcagcttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggtattttgttttaacttcacatagtacagcccagggtttctaggcgtattagtggtttcctgtgcttgatttgtctgctgcttacaaaccctgctgtctggctgtgtatgtgcccaactacataagagaactcgccgtgtgtctctgctaggcagctttccatgtatgtttctgtcagtaagaatctgaattaacctggttttgggcattactcagaggtatcttcagttttccttgtatttttttcctgttgatatgccattgtctgcaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggtgaagaaatactttgtgtacaggaagtggagagacagggtggagtctagcaatctgaagctattgatgtccagtatgtgaaaatgatttcacatagctgcagggacagaaacgtgttttcaaaatcgtatcaaatcctgtcccttggtaacactagggatttaatatgtagtcttgggacttggtgattggcttccccaaagggaaagcagaccagtggaatccacatctttgcatcttgttgagagctcctgggaggcaggtagcattgtaatttgcacacactggatttgtggagtgctcagtagagctgtttcaagcacttgagagaaatacaaatgaaaatattttccaaaggtacaccaattttggaagttaccttatcttttggaagctaccgtttcatgaaatcagtgcatgttttttggtagactgtggactatcttacaagtaaggccgtgtataggctaagcatttaagtttacacctatagtccatacttcctgagctgcagacccaaatatccaaatgcctgttcagcatttttctccttggatgtctcagaatggaattacaaagctcttactttgtcaaacttgtccagctcctaaaccccgccatcctacaagctccttgctgagtgatgttaccgtttgtgtacattggcctcagtactgccagattaaacctaaagcatcatcgagttctgttttctcctaaaaattctctcagatccactcttaggtttaccagccctatcttgagccacatatcacttgcctgtaccactgcaggcctggctgtctcctcccatccagttccctctcagcagccagcaaagtatctttaccctataaactggatcagcgttcctttgtctatactcattcagattcttgttcctttgttggaacccttttactcctcactagaagtttgtaggatcttctctttattgatatttggacatttcacagaactacacctcagtggaggtctttttgttgattgctttcctcccttgatgagccctttcaacctggagcatcgtgaccttccgtctgagaaatgtgttttgtattcattcttttgcaagttctgcccctctgtttcctctgtgtttgcactaaaacccctgagattcaggatctcacagtgtggacctgagactagaagcagcagtgtcacctgggagcttgttaggatgtgcaggttcgggggccccagcccagcctcactgaatccagctctggaggtggggcctcctggatgattctcatgcatgtcagagagtaatttctgtcttatatcctttctccccttctgttctttgtttccttgtctctctgttctttctgagacttcctctactttatctgctaatctttcttgtctatttttagagattagctacgagccctttctgctcttgatcttgtttgatattttgtttttacattatgagtggagtatctgtgttttctctgctgttgcccctctctgttgagcctctctcggattctgtgggtgaattagtgctttgcctctactccttccagttctagctttcccctgctaagtcaattacttttcattttaaatagtccattcactcttatacccattcgtgttctcgaggagtgtgcttttactgtgattttagtgggtatcttaactgtgttcaacctgtcacctttaacctgaagcatttttgagagctctggtttctgtctctttacttatttcatcctgccaccctcccatctgtccacctccctggggatcccgtggatgatctaatatgtatcctgtttttctgtgctaatatcttagaactatatacacttttatgtacatatataaaaatggaatcatgttatatttatttttctccgtcttccttttctctgtaataatcagaggtccctctcgatcaactgacgtagcttcatttcattcttttgaatggttacctgatgttccatagtgttgatgaactgcagttaaaccattgcattactgatgagtgtgtatttgatttataatttttctcataacaaacagtgttgctatatcttgtacaaatatcacaatgaattaatagtttcactcctatggggtatattcccaaacgtgaggtttctgtgtaaaagcgtgtgtacttttcatttaaatagatattgccagttttctaaaaagtctcttactgcacacttcttcctgcagcatgtgagactgttttcttgtttcccatttgtagctggtgttactatttttttgtttagttggtctgataaatatagactgatgttaccttaattgaataggcagcttttcatgtccgccatttggatttgctttcataggaattgcgtattcatatcctttgtccatttttcaatttttagcagtttacactattcagaattttcccctacaaaatatcctttgcctaccagcaagtgtgacatcttttttcttgtaaaagttactgtttatataaacaaacatacataattttctgttgcatctagtcttggtcaagaccctagattatatacggattctagaggttttcttgcataacatttttaaaatacaatttcgctttcttccattggataaccagttgttgaagggccatttagaagtaacccactcatttttaactgattttctttcttcttctttgagacagggtctcactgtgtcgcccaggctggagtgcggtggcacaatctcagctcactgcagcttcgatctcctgggctcaagcgatcctcttacctcagcctcctgagtagccagggctacaggcgcatgccacaatacttggctaatttttaaaaatatttatttagagatgaggttttgccatgttgtccaggctggtcttgaacttctgaactcaagcaattcacctgcctcggcctcccaaagtgctgggattacaggcatgagcccccgtggctggcatgaattttttttttttttttttttgagacagagtcttcctctgtcacccaggctggagtgcagtggcacgatctcggctcactgcaacctctgcctcccaggttcaagcgattcttctgcctcagcctcccaagtaactgggactacaggtgtgtactaccatgcccggctaattttttttttttttttaagtagagatgggatttcaccatattggccaggctggtcctcaaactcctgaccttgtgacccgcccacctctgcctcccaaagtgctggtattacaggtgtgagccaccgcacctggcctttttcttctaaccccacgaaatcttgactataaactgaattttaataccagttactactgtacgttagattttcatacatgcagggatctatttctcttttctgagatggagtctcactctgtcacccagactggagtgcagtggtgccatcttggctcccagattaaagcgattctcatgcctcagcctctggagtctcactctgttgcccaggctggagtgcagtggcatgatctcagctcactgcaacctctgcctctggggctcaagcaattctcttggctcagcctccctagtagctggaattacaggcacacgccaccatgcccagctaatttttgtatttttagtagagacggggtttcaccatgttggccaggctggtcttgaactcctgacctcaagggatctgcctgccttggcttcccaaagtggtgggattataggcatgagtcaccacgcctggcccatttggaatctcttcatttccactgatcttgtttattcttaaaccacactctattgatctccatacatactttttgtgtgttctggttcattcacttgtgagttgtatctggagtagaacagataatcaaagatgcttgttcagaggataaatcagttcacatactaaagtctctcacatggcccttcccaccatgtgctcccggatgtgcttcatgaggatgcagctggggcagcacatggtcctcctagtaattccgactagaatgcagttgatttctgcattctagaattcagttcaattctagaattgcattctagtctagtacttctgattcagttgcatctagtctagtacttttgcattcagttgccttctagtcagaattaagtgcaaaaacccaaaattgggacaagaaaatacaactatttatggcaaagacccatattttgttagtatgtttctctacaagttgtgctaccaacctgaatagtgcacctggcaggccaccagcacgggagtacaagctgcgcagtgagagctgcttccatttcagcccgttcaaacttctttcccagcctcagaattttgtattagtgaaaaatttaccttccccaagagcttcatttgtttccaacattcctgatatttacagcagagtgacgtttcctgtgtctgctctttgccctggctgctgggaaactcagagccaagtctgaaccctgtttacagtatcagtgattggttatagttagcctgatttctatgttattgaatttattatgtcttttttgaaatagtattggggtaaaataaacaccacaagtcaataagcttatttagttggtgggaactcagctatctcatctggaaggttagatagcctaatacataagacagccaagccacagtactactttatacatagactctaagaatttagtgctaaaaaagatgtaggaataagctagtgatggcatagttttaagtagtaaaaatgtccaatttttaaaatttcagaaaatagcatattcaaaaatgatttgagttcaagtgaaacttaagtatggcttctaataagacccgagggtgaaacctttgtatgaaaaacagaaaaaagacttgttgtcacataaattggaagtatgtacacacttttttttaggggctgggcctgtatgctgctcgagacattgagaaacacaccatggtcattgagtacatcgggactatcattcgaaacgaagtagccaacaggaaagagaagctttatgagtctcaggtaggtgtctggtccccgagattgtatacacagcaccatcatcctctccctttctccgtgccagccagacaccctggaaggcagaatgaaatctgtcatgctgcattcagctttaaacaaaagccatatctgtatattagtgtatttttatcagttgtatctctttcaattggtgttacagtttactttgatagacaactgtaaattaatgagcctggcttcacacacaacctactgattccatgctttccattcgtgccatgtaaatgtcatctgtgcctaatagaatatccacagtaaggatgatcaggctgccgttccgttcagtttcgactgagtcctcctggtgtggataggaacacagaggggagtttcaggtcgacattgatgacttactgactgacttttccctcagaaccgtggtgtgtacatgttccgcatggataacgaccatgtgattgacgcgacgctcacaggagggcccgcaaggtgagacagcgaggaacctgacggggagtgcttttgcttgtggggccagtgctggtggagagaacactgaagccaagggaaaggctctcacggcagcctggcggtgactaaacattcagagcaaatgagttgagaatttttatttaaatgttatatttgtgcttctaacaatgggcaaatagaaatttaattagcaaaaactgctttatcaataaatgggaagtttttaaagctgcttctagctgttttacaatacagttttctgacatggtggcttgcaggtatatcaaccattcgtgtgcacctaattgtgtggctgaagtggtgacttttgagagaggacacaaaattatcatcagctccagtcggagaatccagaaaggagaagaggtaagagtgtgagagattgcatctgccatgttgttcagatcctgggcgaatagttccctcctcacacaggtcacttactcacttgtttcccaattctttgttgtgataaaaactctgtccataataggccagatgttcccaccctgcagtatctcacccttcaggcactccagttcaccttcctccacatggcagctctgtgagcatttgctgtcacctctcccttcccttctgtgccacgggttcagcatccccatggcacccaggtggtatcatttctgtgtgccataggatccttctttatccccttaacctggacacagtttggcagtgtcccctctgaagagcatccccgtccttctccaagggggccgtggctcctgagatggcactgttgggctgtgggcggcaaatctgggccgccgtgctgctgaggattgtgtgctcacgctggcgatcagtgtgtgcttaaccaagtgcccacatcgccacattcttcagcagttcaggtgtgggttgttgtcttcaaaatgccgagtgccaagcttgctgtttgtctccgtgctctcagaggtgactctggtccggcggctcacccattgggattatttttggccttaattgctgcatttgcttcccaccttggtctttcccactgtgattcaggtaccttggttctggaattggcatttcctggaaagctgtcactgagcagcaggcttggtttctgtaggaaacgtcccgcatttggggagtgaggcacctgagtgacttgactttgttggtgctcctctcccttcgtgaacatagccatgggattcgtgggattctatctgtattttgggtctttgtggaatctcctttcttagtcaagaataaggatccgactagacccaaggcccgttatacatctcaaagtaacgtgtaaataagacagtgtgtgggagccctggcacagtgccagtaaccaatggctaccatggtggtcagaagagactcagcccagggccacctgcctccttcctacttgagtattcttgagtaaatagtttaatatgagcccctattttatcttctgcaagatagagaaaatgacttccttaccaggctcttggaaggactcagcagatacctgaaagaaagcagtggaatcattgccaagaacagctgctcaataaacactggtttccttcctttctgtgtagaaggtctttccagctagcgtctagaatcatttcactcagaagagacctagaaattcctgggcctccccttcattttgcagcatcggctctctctggggtggtgggggttgcagggccgcgcactgaggcttgtaccgtgggactcacgcagactcccacctaccttgattggtctgagatgttaatttggtgacctctaaatagaaagacatcctttcagtcttgagtgaggaaaaatgaaggagggaaaacagagttagctggcagttcatctcacccagaattgcatgccccattcagtaaatcaggggaggtgaaaggcttctgggttttagggagagggctaggaaagcagttgcccttccagtcccctccatccacttgcagggacagcattatgagaagtcacagaaatacagctttctctggtcaggctcccgttctcagatctcgctgtttaaaaatactgcctccctcatttcctctgtgcaagcacaatgcctcttttcagggttcccccagggtcccatggaacctcaataaatcaggtcttccttaatttacgtctgtttcgtttgctggttttaaaatgcaagggagatggaggcagaaacgctattgccttccttgctgtcctttcttaccctgtgtctttgccgtgggcagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctataaaatcacaccgccatgctttgcccacaacagtctcctcaacctgttccctcattccttctcgccagaatctatcaaggctcggcacaaaggtactctcccaggaggccttcctgaattcttctgtgaggcagactacttcccgagctgccccggcccttctccggccaagtctctccagaaactcatcccattcgttctcagatggaaggggacccacacccacgacaagcctccgggtttgcttaatgactcagacagcgagggtgctcggtaagccccaccagcccgcgccctactcagcaggtaatgacggagacctactaggtgacgggcgccgcggtagacgctgggataaggtccctgctccagggagcttacggtctattcactaacgtcaaagagcagtgagtgctgttacgtgtatgggagccaccagggtctccgcctgcctgcagggccacgcgcgcactcgacgcttcgcgcctgcctcagtttctccgtgaggccgcacagccccagtctcgggaggcgtgacacaccctccccgcgcgctctcgcgttaccaagtctgcgcagccgcacacccccagtcccggcgggccccgcgcgccaggccccttcccgacaggccccaggagccccgctgcatgccggggcttgaggtctcggcgaagcggcgcggcgcggcgaagcgcggcggccggcgggcgcgcgtggcaggaagcggaagcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaagtgagtcctgtagggaagccctattgaggccgggacggaacagatcccccttccccacacccgtgcggtcgggcgcccgccggccaaccctgaccggccccctgcagaacgcggcccgtgcccccggcccttctcgagtatccccacgcgtccggggtgcggccggctcccctggcccctgctctcactcgtcgtgggcagaaggcgtccctgggtagcgcggaaggttacttctctgtgtcccaactcttcctgttttgtttctcccatcaaagtcaaatttctggaagtcatcaagcccttctgtgtcatcctgccggaaattcagaagccagagaggaaggtaagtaccccaaatcgccaacaaagaaggtttcaggaaactgtctggactctggaagtttacagtatgattaaaaatggcttcagcacggcaatggaaactctcccttctcttcccttggagtgtagttgtgctctgttattccggagagctgtcgaaaggtgacctggttgtgtggaaatttccactgaaatcactgtgctttatttggagcatctttggtggatgttgctccgagaacaaagcctccggttgccctgtcccaaaaatggatccgggccatgaatgaataaggcctcagttaggatagcagattgagttaccctccctttttcacctccaacgggagcagatcacgggttggttttttttcccaggagatgccctttgtatccagctgctaaagggaagggctgtcactttagtatttacaaatgattttgtaccttttatgtaggctgtcacaatagggggaataaaggctattcttttgtgaagtctgctgcttttcacagacggtgtattaaaacaaggaaagattaaatttagagctgtgctgaatcagaaattgtgtggagtgagtgttgccagtgtaactacagctgtcaacgaaaaaaagtttcattaggttcctaggttagagagtggggaataaaatgtttgtgtcctcacattatttttcaaactgttgttaaagcattcacatggacacttgggtgcttggaatccactttcatttttttacgtaaaatagtttcatataaatgcccatgtgctgcttttaatggacgaatttgtaaagctttaccccctcaattccagtgtagcgaaggggcatggctctggaggcaggcaagcctaggtcccaccctttacatagcaccttaatagctatgtgaccttggccttgtaactcagtgtggtagacggaacaagggaaatacgtgcaaggtatagcagtggctcaggaagggattaactctgggagacatgatgtcttatggtggttttgaaggagaaatagaagtctccttgaagggacggaaaggaattccaaataaaaggagtatatagtttgcaaaggcattggtgacaagagtgtagcatgtttggatgggaggttattagatgtagttgctattgatagaacataattgtaggtggggaacattaggagatgaataacaagggccagacatgagaatgtcactttggaagaaaaggagaggactagagttggtttagaggcttttcacatcagaggatgaactgtggtactgagcaagaatggatttaggggctactaagaagcagaggagacaggacttggataaagagcttttggggttttgatgttaaatttgattgtaaccaggagagaggacttggtgattagaaagggagttttgaaaaaattgtctgctctttgtttcccatcaagattcatttcagacaggttactctgaaatggcgttgccttctcttggccactttctaatttcttagtgtggtgggatggtaggtgggaagaggaccattctcaagagaagaagagtcctgtgaatgcccccagctttggatggagtatctgaacactgattcacccactgttgtgtggccgtatgactgtgtcctactttgcctgcatgtatagttagaggactgtgactccagttctggccagagggccaggaatgctgactcagtgcctgcctagaagtgtttttaaagaacacagttttgtcacttaatactgtcagtctctcacaaggtatttcaacctcagaatcttccgtctgtacaataattaatgtttgttaagccctctaaagccattaatgtagtgtaggcagcaggtattagtgaagacactcagtttcagaggcagaaaacctggaagagttcccactctactctttagtgacagaggttttgggtgggaggttttctaatgatacttaatacttaatagtcatctttacagtgattcttgtcacctatgcaacctatgtacctgagaagatgtgaaaatccttaaacaaatgttactagtaggttaaacatgcaactctcctgcccttccccaatatggtttattacactgttttacccttaattcatagaaaatacactattgagcaattccaaattacttgactctagaataacaaggttttgtgactgaaactcaaatgaaaagtggttgctcgtgtgttttacaagtcatgttctattgtgacattctttgttcttgagtcttaactgttaatgctaatggttaaaagcacagtttgggactcaaactcactttagcattggggtttggtacaaattatttagctcttctaaggctcagttgtaaaataaaggtaatgctctgtggtgtgaggtgagctggggtgatgcctgtaggtccttgcattgtgctctgtgcagaggaagttacgcagtacatggtacttatgtttggtacatggtttggcttctctgctgaacagagaaaagagtctggttggagtccatttttagagaaaggggtctgattggagtccatttttattaatttgcttttcaaagtaactccctgcttcaattcattctctcctactctagattcagtttaaggagaaagtgctgtggaccgctatcaccctctttatcttcttagtgtgctgccaggtaagctcaggcttgtatttcgtattggggagggggataagagtggctggaaacaggagtgctgactgttttgctctttgcctgttcccagattcccctgtttgggatcatgtcttcagattcagctgaccctttctattggatgagagtgattctagcctctaacagaggtaggactctggctctgtcttttctctgtagagtgtaggcttacctagcttcacttagttaaattaataggctttggctttatatggaacttagagagtgacttggaaaatagagtgaagaatgttaaagtgctgtgttgaatagccttattaaatgctgagttcagcaccaaggcataccatcatatttggaattgtatttgaatgcagtacaaaacctgtaatgagaagataagtctatgctatagagagaataaaaaacatggaaaaactagaatactttttgaatacctgaaatgatgacatttccattgataacattcttcagaatatgtaatttgtttttcagctgtatctttttcatatctataggttacatatagtgtcaaaaaatatgtaacagtgttttatatcctctaaccagttacttatgggactggggaggattctgaatgtgtaggttgatactgcatttgattaactcatttaaaaaatatagttcaattaaattccaaatcagttggaagtgtagctcattttaacataatgggaagtagaggcttattcacaactagatacaattgtacaggctccttttccagactctggaaattatttgaatgttatcctttttttattaactgatgaagagacgaacatttcttatctctaaaaccagaatgaatctgtttatggtgaatttaaatgcagcagtctgtttagacaccatgtgacttcctaaacagaataagctgttgcctggcaggctgaacagaatgaattgaattatatactaatcgttgatattttggggttctaaattaaacacagctaggaaactgaaacacattggttttatataaggggtacccagtcaaattttgcgtattcatttttaaaataacgtactacgtttccaagctgatattgactgttttgcttccccgtttcctcaaggcacattgatggagctagggatctctcctattgtcacgtctggccttataatgcaactcttggctggcgccaagataattgaagttggtgacaccccaaaagaccgagctctcttcaacggagcccaaaagtgtaagaaagattgtgaataatctgatgtctatagttggaaaatttgaatttgctataagattttggtatcagtttttctttttttatttattttttatttttttttttttttttgagatggagtcttactctgttgcccaggctggagtgcagtgacgcagtcttggctcactgcaacctccacctcccaggttcaagcaattctgcctcagcttcccgagtagctgggattacaggcacgtgccaccacacccagctaatttttgtatttttagtggagacgggatttcactacataggccatgctggtcttgaactcctgatcttgtgatccacccgcctcggcctcccaaagtgctgggattataggcgtgagccaccatgcccagcccaaacagtattttcttttgtgctgcaacctccttggcctgccaaccctgcaggagctccatgccctgtgttagcgtgagagagcacttctggtagagcagaggtggtgggtgctggggatgggctgggcaaggcaggggagagtgtctggagtgcccctgaggccatgtaatggaggagaaggatcagagcttggaggtcttagcacccttggccaccatttcattattgcttaaaaggaagtaatggctacttcagagctgtcataaggattaaataatcactgtcacaatgcctggcacatagtagttatttggcaagtgttttataaaagaatttaactgactggggggcggtggctcacgcctgtaacccccagcactttgggaggctgaggcgggcggatcatctgaggtcaggagtttgagaccaacctggccaacatggtgaaaccccatctctactaaaaaaatacaaaaattagccaggcgtggtgacaaggtgccttaatcccagctacttgagaggcagaggcaggagaattgtttgaacccaggaggcagaggttgcagtgagccgagataaagccattgcactcaaacatgggggacagagcaagacttctctcaaaaaaaaaaaagaatttaactgaagaaaaggtgatcctgtcagtccagctgtataatttaccagctctgtgatctggggaaaagttagatgatagctcttatgtttcactttcttcatctgtaaaaatggggataataatggtatttgcctcatatctaataagtgttactagtaacaattactagtcatcaaaattagccatatttagcctctgtttgctgaaaaacattaattaggaaatgatatttacagtctcctatccagtcatcttttcgcctacaccagcatgttttacaggtcttaaattagtatggtggataattgaatgagaaatacgtctatttttttttttttttttttttttttgagacggagtctcactctgtcgcccaggctggagtgcagtggcgtgatcttggttcactgcaagctccgcttcctgggttcaagccattctcctgcctcagcctcccaagtagctgggactacaggtgcccgccaccacgcccagctaattttttgtatttttagtaaagacggggtttcactgtgttagtcaggatggtctcagtctcgatctcctgacttcgtgatccgcccgcctcaggctcccaaagtgctgggattacaggcgtgagccacagcgcccagccaagaaatacatctatttaaacttgtcagttttagataaaaattaggattctaaaatacacacatgtggctgggagcggtggctcatacttgtatcccagcactttgggaggccaaggcaggatgattgcttgaggccaggagttcgtgactagcctgggtaacacagtgagagagaccccatctctacaaaacaacaacaacaaattagccaagtgtggtgatgcacctgtagttctagctactagggaggctgaggtgggaggatcacttaagcccaggagtttgaggctgctagtgcaccactgcactcctgcccgggcaacagagcctgtctcttaaaacaaaacaaaaaacactaagaaaacaaaaaaagtacaagcacaaattggctgttttctctttggtcttcacaatgttttgaatgttttcctgcattaagaactaattgttgtggagcactttttaaaaagtcaaatagggactgtatttgatggccactttggagtaaaattaattttacatgacagattaaataggaaagctgaaactgaaggtcagactgtacttagaggacccatctagtactgtggaacttgtcaaatgtgtccattcccttgtgcctaacagtgaaatagagtgagttgtaagaaatgaagacaccctacaaaaaggaaagcttttgccaggcgtggctcatgtctgtaatccccgcactttgggaggctgaggtgggtggatcacgaggtcaggagttggagaccatcctggctaacacagtgaaaccctgtctacactaaaaatacaaaaaattagctggctgtggtggcacgtgcctgtaatcctagctactccagaggctgaggcaggaaaatcgcttgaacctgggaggtggaggttgcagtgagccaagatcatgccaccgtactccagcctgggcgacagagactccgtctcaaaaaaaaaaaaaaggaaagcttctattagaccaaaatagcttggtacctaagggaatgggaagagcagccaaatcaatggtacgtggggttttccttttaaaagcacattaaataaaaacttgagaagggatcactttaccccagagctaataattctgtcctctggacccagacctggatggtgagcctagagaggtggcccaaatctgtagttcagctcttgagccatcgagaccccaagtgcctgacattgagtttgggtgctgcaggtgtgacatctccagattgtgtctccggatgctgtcaggagtaggttctactccctgattttctttgaatagaacaaattttccaagtttcacttttactcctcccatgactaaaaagcaagtgaatctaggaaaaggtaaaactaaagaagaagtgtgcttttgttaaaaggcttttgattcatcatgtactttgctgatgtgatggtttagcgcgttctcagccgagccccttggaggtagtatcactgctcttcatctttgttctcccccgtgcctggcgttgaattggtgtttcttaattgtttcttttgttctgtgtagtgacccacttggaaaacacttctttctttcaattctagtatttggcatgatcattactatcggccagtctatcgtgtatgtgatgaccgggatgtatggggacccttctgaaatgggtgctggaatttgcctgctaatcaccattcaggtaattattatgctaacatctccctttgagtagcccctcacacttacctacaattctcacataacgaatctcaagcacacctaaaaggaactcctactgaaaggaagcagaagcctaagactctgggttagccctctgaattcagcagagaaaggctttactgaccgctctctggggctgaggatgtgatctcattccgtcttcagcgtttatatcagagaacccaattactgaaggacggaaccatgtccgtggggagcagtaacacatagtcttgtatttttgaatttttacagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggtaagggccctgtgctcccctggtggcgacagctttcagcaaaaacaattgagcaatgcaaagcagaagacaaaaatccccccattccacagaaaaataatgtcagttttaggtttatctcttctggtgtttgggtccatctgcaaagttttaaaaacacaaataggcttgtaattatgatgatacctaacttgcacttttcatataaaaatatctcctggacgtttggcacgtcagaatacacaatcctgcctcacttttcttagcacagtataagcttatattgcaacgataaagcaacgttaagtcatttccaggtttttttatcgttaacattgaaaccatgactgtcctcatatgttcatctttgtatattttggcagctgctctcagtgaataagtttctaaaaatgaaattcctaaaccaaagcacttggtcatgcaaggggcagctttctgaaaaaggcctgaacttggagcttagcacctgcgttcaaatcctggctgttcctgttagtcatacatacgtggctttgggcagattcctgcaccactgaatcttggttaccaggatgcagtgagaagcaacatgaaattacatgatgcctggctcctggtagatgtgtatcaaacattggcatgctgtgctacatccaccaagtgccgtggaaatcttgtaacagcatgtttttaataaaaagttcaaaacatacaagggaagccttagagagtgtgacttattagggaaaggaaataaacattttttggcactaaatatcttcttcactgaggagcattccaggagaaataatcatgcatatttgagagttttcttttaattgaatgttggaaacagagtccttggcctccagagaccatattatctcattaatgagatggaaaactggtccccaaacaagtgaaggctgcatgtgcctaacaggttacaaaggagagtggagcttgagatagggagccatagagaagagtgggcaagatcacatttgatgcttccttgagtactttgtataaatttaggaaatccaaggtaaattgggagaagcaggtccagaaggcaaagtttgacaggatgtgaaaaggcaagagggggatggcattgtaggagttcaggtatttgtcaagaccatcatggtgactggcttttggggagtgcctgagtgggaaggaagtaaagtcagaggggagcccctggtggcttagcagcccagtagtagccgccagaggctcatgttccattctgcagcagggcattgagtaatgggagccagagtttggaagaagtgatttgctctgcactgaaaggcagagagagcagctaggtgcgtgcagcagtaatccagccccaattaagccatcctacaggagagcactgtgtgagggcatttggaggaagcaagttgagagaggggaccagagaggcactttcaaggtgggggaaaactaagaagcaaaggtggatttgtctggccttgaagtcagtgtgtctacatgtcagttgctcgtgtttgggacctggctgacacgagatgcattcaggaagggctgtgccccatggcctgcatgtgggcagtgagtggtgctagagggagagcctagggaggggcagggagagccacacagagggcacagctgggacggcagctttgcagctgtgcctggagatgttgcagcttggcttgggacaggggaggctgttgaatgagattctacaggcagagacagtaatcactgctgcttccctgggcagcaggaacaatgcagaactgggaattagtcccaaatttgaaaccgtggggaaacaggccagccttgtcacacaggaccaaaaggtggaaaggatgggaattgacgaaagaccgccacagggtgagatgaggacatgatggccagttaggatatggtgtctctttcacagaagccacagcagaggaggtcagtggtcatattggttagatggtctgcctgacatgtcatctcggaatggtccaggaagatgtagcaggtggtcctagctatcacgtgttagaaacttgggaacagtgcttttgagttctttagtttcaccttttcctagattcacttgctttttagtcatgggaggagtaaaagtgaaagttggaagatttgttctatgaaaggaaaatcagggagcagaacctactcctgacagcatccagagacacaatctggagatgtcacacctgcagcaccgaaactcaatgtcaggcacttggggtctggatggctcctgagctgaactacagatttgggccacctctctaggctcaccatccagatctgggtccagaggacagaattattacctttgggttaaagtgatcccttctcaagtttttatttaatgtgcttttaaaaggcaaaccccacataccatcagtttggttactcttcccattccctcagctaccaagttattttggttgaatagaagctttcctttttgtagggtgtcttcatttcttacatctcactctatttcactgttaggcacaagggaatggacacatttgacaagttccacagtactagatgggtcctctaagtacagtctgaccttcagtttcagctttcctatttaatctgtcatgtaaaattaattgtactccaaagtggccatcaaatacagtccctatttgactttttgttgttgttgagacggagtcttgctctgtcacccaggctggagtgcattggcgccatctcggctcactgcaacctccgcctcccgggttcaagcagttctctgcctcagcctcctgagtatgggattacaggcgcccgccaccatgttcggctaatttttttgtattattagtagagacagggtttcaccatcttggccaggctggtcttgaactcctgaccttgtgatccgcccgcgtcagtctcccaaagtgctgggattacaggcgtgagccaccacgcccgactcctatttgacttttttaaaagtgctcctcagagtactgataccatgaccccacactgcccacagagaccctgtctctggaagtaatgccagcttcctgccagtagaagcagcgtgagttgccaggcttccattatgggatggttatgctgtcctggaacggcagaggttatcacttgtttctttttttcgctttttagttttttaacgtaagtaaatttcttgctgatgtctaaaacttaggccttaataatgcaccacactccccgccttcctctcacttgttactctgttgtctggttcttagattgggtccctttcctatatccctcagtccctcagtaagctcactccacccctaggcctgcctccctcaggagcatctcctggcagggtgtcatttggatgggaccacatggtggacgcaagcatatcctctgtacttgtatccttggtgtgagaagcagagagctggagcctccccactcaccagccaagggcagcctgcacttcatagctgttgaatgggtacttgtacttctcaagattgtccaggaaagtagatttgccagctctgagccccctcttcagtggatgacccctttcagctagagttcagcagagtctgcttttatttttataaattatcatcgttccacacctctggtggccactgactcatgtgcctaagaaatgagaccaattaattttaaaaagtggaatagtggttgggtgctgtggctcacacctgtaatcccaacactttgggagggtgaggcgggaggattgcttgaggtcaggagttcgagaccagactgggtaacatagtgagacccccaactgtacaaaaataaaaaataaaaaattagccaggcgtggtagcatgcctatagtcccagctattcggaagtctgagataggatcacttgagcccaggaggagaaggttgaggctgcagtgagctgcaaccacaccactgcactctagcctaggcagccgagagagagggaccctgtctaaaaaaaatcaaaaacaaaccagaatagcccgtttctgtagtttgaattctctacagaagagaagggagggatgagaataatacatgctgtatccctgtggctatgggcaccatgagtctaataacttaagtttgttttcctctttttatttgtctgctaagaaggctagaagcaaattgagttgcctgttcgttccttcatatatgtctcctcctctgccaacaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccattaacgaaacaaaattaaggcagttctaacgtaagtgaaatcatgttcttctgggttgggcctatcgacaggtaagatacatttttaagttcttagttcaagagaagcaaaaagtactctagctctgaaacctcattgctctcttatagaaagtttgtatgatatttataggtaacttctgcatctcggaaacggcctatcttcttaagctgtcttacctttaaaagtattccatctcttaaacttgcttctgagtaagagacctgaactgctattgttttcctgtaattggattgatctttgtattttttgatggtccactttgtattttggtgtttatttaaaagaagggacagagatgaaaggcagtttgatgtttgtgaaaggtatttatacgagctacatgcttttcccattccttctgctgagactaagccacattcttgcttaataaaaagctatctctttaggggctttgccagaatttgcagtcagatcattaagaattttttttttttttttttttttgagacggagtcttgctctgttgcccaggctggagtgcagtggcgcgatctcgactcgactcactgcaacctccgcctcccaggttcaagcgattctcctgcctcagcctcccgagtagatgggattacaggtgcctgtcaccacgcccggctaatttttttttatttttagtatagacagggtttcaccgtgttagccaggatggtctcgatctcctgacctcgtgatccgcccgcctccacattacaaagcgctgggattacaggcgtgagccaccgcacccggccttaagtatttaatttttaaatcctctgtattccgagccctgttctaggtactgggagctcataaaaataaaccctttctagtctccaggggtttcagagggagaagttgtattcctagaaaagtttagcttttctgtttatgattaaaaacactgtaaggaactattataaggtgtgaggccactgctgtagtggccctgcctcagagccagtgtaaaagcttaggaaacatcaccagctagagagaagcgcccttgggatttgggtgtgtggcctccaggcttttctccatattccacacagatgtggatgtaatgtgataggctctgtcttttggaaaaaaaaaaagtgggggtggggatcattccaccgtgcttgcttccatgttttgttttgtgtgagacagggtctcgttgtgttgcttaggctggaatgcagtggcatgatctcggctcactgcagcctagacctcccaggctcaagtgattgtcccacctcagcctcctgagtagctgggactacaggcgcgcaccaccacacccggccagttttgtttattttttgtagagacggagtctgactgtgttgcccaggctggtatcgaacttctgggctcaagcaattctcccacctcggcctcccaaagtgctgggattacaggtgtaagtcaccacgcctagccttcagtgtatttttaaaccagcttttctgggccccttctggatgtgccaagtgcaggagtgcagtggtgggtaaggagtgggcacaagctctcggaactgggagccccagaaccagcacacaggatttcctcccttgtggcccactggacagtccccggccgggctgtgtttctgtgcagcaggctgaaatgaggcagtgaaggggatttggttctgtttggcttctcagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggtaagtaggctctttgaagatgagctagcaatgcagctaagttgcagtggtttctatcagtgtcttgctcatgaacagatatttcatccaaagatattttccattgtgccttttacaaattcagcacattaaattatcttttcagtaaaaaaattgtactgtgggcaccgagtaaaattgcattctttcatctgctcagaactatttttgccttgatgctaaagtaaaatgaaggagcactcacatgcgtttggtttcttcttccccaggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgtaagtagaagcaaaactttctggaagggtgatgaaagtgtgactggtataaggggtgtggacttgtcacctcatcataaataatggtctgtgacgtgtgcagatagatcgtcgtcctttagggggcagttcagaagctttaagggctgacagatggagtccagcagtagatcagctgtgggtatgagaatctgaatccacactgtaaagttagactttttcatatgacttccttgcggcagttttaaagttctctgtatgaatattgtcagtgctcgaagaggcgatctgtaactgttcagtaccacttggaatgcctatttccccttcagcctccaattccaacttctcccctgtgggcaccctgcaggttgcaaagcagctgaaggagcagcagatggtgatgagaggccaccgagagacctccatggtccatgaactcaaccggtgagtggtggccccaggtccccaacctcccgtctgtggacatgtgttgtttctttccatgcagggcatcctgataggccctagcacttactgggtcactaaatcttatccttgggttacaggacagaattaaatgttatatatttataaacttgctaagtgctggacactggagacgtaaaaataaacacttacagcccctttcctccagagggagccactgggtaaggagatggaagcatgtggccaggcggataggagacagtgcagtaagggtcctgagagcaacagctgtgactggcagcgggaccctcaccctggctcatgccggtggggtgctgaagagagcgccctggaggagggtcactctgagctcagagcaggcaggtcctggcatctgagcgcattttggggcctgtggtggcattaaggctagagaggctggcagtggctgggcacggaaggggttgatgtgcatctgaagcagggcagaagggatggagcctgcagtctcttaggaaggtcagtgctaatacatgaaaccacgctagagagggagagggggaggccacatacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctaaaggaagcaaccacaggaaaagccagaattgcaaacttcagatcattttctaatccctagcagggatggtaggcaatttagttcattctcttaatattaagctgctggatttacagcactgtgcagtagaagtagaattcaagtcacatgtagtttttaaaatttctagaagtcacattaaaaaagtaaaaagaaacaggtgaaattaaatttaatatatttaacctagtatatccaaagtatcatttcaacattataattaatgttaagaaaaaccatgatgaaatattttacatccttgtcttcaaatctccaaaatcttatgtgacatctcagtttggtctagtcacagtcccctggccacgtgtggccagtgtggccactgcctggacagcagcgccttggcctagagcgctagcatgttagtagatgactttctaggagacagcagaggggcctttgaggcattaggtcccaaagtctcaggtgagcctgttggccgcctggctcacggggagctctgtgggtgtccaggagctgactgtgtcccctcccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggta

SEQ ID NO: 374 - DNA, 117428 bp, Homo sapiens
gtttgcatcatcttgacccctgtgcaattagaacaagtggtttattgccgcccccaggcctggccaggacctggggtagggggaggcatgctggcatagagccggtgatagcagaccttggatgccagcggcctcctacctccttccctactgctgtttgtcttcaggcaagttacttaaccattcagggccccagtgtcctcatttgcaaagtgctgctggtaataacgtgtctggcatacaggaagcactcaagaaatgctggctctgactgtaatcgccctggctattttctgcttgctgttgcctgacacctgtaagtatgtccatgcgtgtagctttccataattacggtggctgtgtacaaactgcattatatttggcgtcccccacgcaggaggctctgtatccacggagcttcctcccttcccacttgtcacgtggccccacatctccatccactcgctccgttgtttctgccaggccagtcccctgcggggggcaatttgggttgtttccagttttcttggttataaatagcactgctgtgcatatctttattacaaattccttctttcctctgaaaccctgaataactgagcccacagggcatccagtacccagcgcaggctgtcttacaaaacccacagcacttcctggcctgctccattggcattgcattgggtcctgcagatgggccccagggaggggagaaatcagggtggccctcgttctccattgctcagagctgcggggcagcctcagcactggcccttcttgaacctgcacggatgcttgacatcatctaagttcacagacatggtaaaaaactaagcaaaaacgaaagagagaaacaccccaccagtgtttctgaacttgctgtgcccttaaatgtaaaaagatctccttggtatctggggctgagagaggctggggccctggctggctgcagagcaggccctggcagtggagaggcccagcctcattttcttgtcagggtttcccccttgccttttttgttgttgttgttgagacagagtctcattctgtcacccaggctacagtgcagtggcatgatctcagcttactgcaacctccatctcccagattcaaatgattctcctgcctcagcctcccgagtagctgggattacaggctcctaccaccatgcccgactaatttttgtatttttagtagagatggggtttcaccatgttggccaggctggcctcggacacctgacctcaggcaatccacccaccttggcctcccaaactgctggggttacaggcataagccaccacacccagtcttttttttttttttaaagtagtacaaatatagtaagtggatatgttctttttcttttcttttctcctgagacagagtctggctctgttgcccagactgggatacagtggtgccatcacagctcactgatgcagcttcaacttcctgggctcaatgctccccactcagcctcccaaagtgctgggattacaggtgtgagccactgtgcctggctgtgaatacattcttattgttcaaggttcaccacagtttttacatatattctgtgattttttactgttttgggggtcaatatgagtaattcacatttccccagaaaaaccccatttcaactacattttctttcccttccttccttcctttcttttctttttttttttttcagagtctcactctgttgcccaggctggagtgcaatggcatgatcttggatcattgcaacctccgcccaccgggttcaggcagttctcctgcctcagcctcccaagtagctgggactacaggcgcttgccactatgcccagctaatttttgtatttttagtagagatgggggtttcaccaggttggccaggctggtctcgaactcctgacctctggtgatccacctgccttggcctcccaaagtgctgggattacaagcgtgagccaccgtgcctgtcccattttctacttattagcaagatgttgtgcagaaaattcttttataattctttctctctctctctctttctctctctctctctctttctttctgagatggagtctcactcttgtcgcccaggctgcagtgcagtggcgcgatctcggcttactgcaacctctgcctcccaggttccagtgattcttctgcctcagactcctgagtaactgggattacaggcgctcgccaccacgcccagctaatttttgtacttttagtagagacggggtttcgccatgttggccaggctggtctcgaactcctgaccttgggtgatccaccggcctcagcctcccaaagtgctgggattacaggcgtgagccactgcgcccagccaatctttatttctttattttatgttgcctcttttatacctattttttggcttattttttgttgctagccagacttgtcaggtttgtctattttactctttaattttttttcccaaagatctagcgtttgtattactgattagttgtggtaatgattgtttttctttcattaatttctgtttggcattatcacgctcatcctttcacctttcttggggttgttttgctattcatgtctagcttcttgagtggtaagccttagtttattttcagtcttgcctgctgtctgataagggcacgatggcctgtgacatctcctctgatggctttggccaggcttgtaacacagagatcacgccactgcattccagcctgcgcatgtttgtttctaagtttcatttctgtagtctccacattctgtcatgtaaatttcctgctgagcggatttatttggctttcctttagttatttctttttacttttattgcagtgattcctgcttttgtagaattttttttttcaatttcctttgtctcctagtactttgtctcctagtacttgtctcctagtactaggctcttccatgtgactgaaaaaagtatattctccatatggcatatgaacatacatttcatgtcattttaaagttgaggtatactttacatacataattacacggaacttacatgtaaattacctttacataaaacacactgattttaagggtacagttttttccaggtttttgacaaatatatacccttgtgtagccacagaaaatatacagaacattttaatatcccagaaaattcccttcagctcctccaagtcaatcccagcaccaccccaaccctctgccgagacagccacttttctgatttctagaaccattgattagttctagaatgtgtagaatggaattatgtggtgtgtattctttgtgtctggcttctttggttcagcctcatgtctgagcgattcattcatgttgttgagtgtactagtagttattctttttaatttatttacaccaatttgtttacctgcattcctgtttatggacattaatacattgcttccagtttcacctactgtgaataaagctactataaatgctcttgtacaagtttgtttctttgtttttcttttccttttttttttgagacagagtctcgctctgtcacccaggctggagtgcagtggtgcaatcttggttcactgcaacctctgcctcccaggttcaagcaattctcatgcctcagcctcctgggtagctgggattacaggtgtgcaccaccatgccaggctaattttttaatttttagttgagacggggtttcaatatgttggccaggttggtctcgaacacctgacctcaggcgatctgcccgcctcagcctcccaaagtgttgagattacaggcatgagccactgcacccggcctctctttttcttttcctgacatatgtttttacttttttggggtaaaagcctaagacgaattgccaggtcatagggaaggtatttgtttagctttataataaactgtcaaacagttctccaaagtggctgtcctgtatttatgcacattctcttttatagtgttttgcatctgtcaacaataataatcctaacagcaattagatattagctcctatcacaaggcagaacccagaaacagctgccttgtgctccctggactttggttccttagcagcgagggctggagaatgagcgaggcactgcatggacgaggcggcaaaagccacattttccccagcatccttctccacttcttcagtcatagacaccccacaacccagcctcccttgcagccaaatgaaagcacgtgattcagctgtcagcggggtcatgtggcagaaagttgaccagtgcccaccattccccctccctttctctatcctgctgctgggaacatggatatgacagctaaatctccatgtcagagctccaggaagagggccagcgccagatgcaggagcagaaagctggaggcagcttggttcctgagggctttgcgaccaccccaggtgccacccctgatgcttaggggaatggctgccttgtgttagccctggctggtgcacacaggcctgtgtccatgctgggaactccaggctggtagccaggctttctgctttagcacagcctttgtgcctgcagttggaagctacacagggtgggatggaaggggcctgagtgcagagtcttctgacacatgctaggaggccatttccacgatgacaaatccctggtgtccactacagggaaggaggatctgggagccacttatgggccatctgggacctgctcctatcagcctaactactcctagctgctagatatacctgcgttgggggcctgcctgggctgggacagtgcctggacttctggggcctagggcctgaggcaactccaggaggatggaggtgacaccaatgaggacagctaaggtggggtcagtcaggaagggtccacctcgcctggtagccagagagtgccaggggtgctccagggagccccagccagcagaggggggggtggcccagagcctcagcctggcagcagacttagcaggggttgctctcacttccctccctttgcccaagggcacagtatctccgggacaggtgctggtgtccaacttatgcttggatgcttggtgagaagggaggaagtctagggggttctcaccctatgttctcgggccaagcctctgagccaagcctgtggatgctgctcccggcccagggccataatggttagttggctttatcactttgcttgttagtcatcaaggtggttccaaatcccttggaggactcaggtgacatctgccaataagccactgacaaaatgcccttgctgggtctgactgcttcaccctcttccccaccgtcttcattccctaaacacaccagctagtgcctgccacagggcctttgcatggcagcctcttctgccaacaccctgccctttggctctcaagggtagcctctctgtttcattcagacttcagcttagacatcacctcctcagaaagctcttccatggacttccactctgaagttgccaccctgtcactctctagcacaccactttgttttaaatctacatacaacatgagtactagatgcattcttgtttgcttgttatcaagctctgcaaaggcagaatccttttctatctcattccctgatgtgactgagtgcctggacagagctgggcacacagtaactgcacaaagaaggctggtggacacccctaagcaggacacagtggttaaaggaaccagccacaaagtcaggcagatccagatgccaatactaaactagctgtctgacctgaggccagttagagtctgtgtctcaatttcctcatttgtaaaagggaggcaatgataatgctatgaagtttattcaaaatggtggatgttggacttttagaatggtttagggcaggtgatgagtgaattgtaaattgtagctatggccttcatcatcaccatcaccatcaccaccatcatcattgtcaccaacaccatcattatcaccaccaccatcaccatccccaccaccaccaccatcagcagcaccaccatcaccaccaccatgaccatcaccatcattgtcaccaacaccatcattatcattattaccaccaccaccagcaccaccattaccatcattatcattatcaccaccaccaccaccatcattaccatcattatcgtaaccatcaccaccatagccactccatgtgcttgccactgtgtcctgtatgggctgccatgtcaagggccagatgatgggagatggatggactagggtcttcctgctctgggaaccacagcctgctctccctggtggatggctgggcctgagagaggaggtgcagtgacacccttccacatgacagcagtccctggaggtgagggggacaggggaggcgtggctttctttgggataatgaaccccatgtgcagcacttttggctctgcagatgtgatgcttgttgccatggtgaccgtcctaacaataacctcccagaactgatattccccacaccctccccagctgccacctgggagggagagccctcctcgcttacgaaagcaagcttgaaaggacaaggtgggaggcagagatgacacgggggttggggtggaagtgggcccttcctgaaggcaggggtgggaagagggggaagtctgggcctctctgaccagagccaaagccagatgagagggcttctggaatctgggaccagagagtcatggctggaagtctttctcccttctacccattttcctatgatagggagaagccgtctgggtctgagggtggggactgggctgttttttgagtgttagtgtggggtcaagctgtctgggtagggacagtctggctgcctctgatagcccagcccttccccactgtctggtgcccaatcatgccaaccttcctgcgctcgccagggtagctctgcttcatacctctaatatttcagctcggaggagggactgcctgggggtcccaggtgctaacaggtacaaaaggcgggaagaagtataggatacaatgaatctcaaattgcatctcttagtgaccccacattcttgtgtaaccctggtcctgggcagcttctcaacttttgaaaggtgacctcggccgggtgcagtggctcatgcctgtaatcctagcactttgggaggccgaggtgggtggatcacctgaggtcaggagtttgagaccagcctggcccacatagctggggctgtgagccactgtgagcttgttacaggcgtgagccaccgtgcttggcttgttatttgtattctgttgtgtggccctacctcgtctttccagagctcagaaagggaaaatatggatgcatccagcaggtgctggaagaaactcctgtggggttaaacacaacgccaagaacaaacctcagacttggcctccagtcctttctcgagcccatgccagtctgtctgttaggatggcccaggattctctgagtccaagtctgacatagacggggtctcccttcctgctatggtcctgctgaagtcaaggccaggatccctctgcttcctcagctggggacttccccaggtggcccagcatttgcctttggcctgagaatttctcgtcctctagtgtcttctgggtgcaggtgggtcgatggcagggacttgttgccgtgtggtctactaattgcccagcagtcccatgccaaatgcatcctggcccagaagggccctggctgccagcactcagaatgcctttatcccctcccttatccacatgacatttattgtggcttctggggcttgccctgggctggccacgaggtgagagggatgagcaggataggcccagaattggtccttggggagcagtaaggaagtcatatcagggcagcagcgtgacccaaatccagagctggctgctggaaaccccctcctcagagcctgcccaggatggaccccgtcagagaagagtgtggggatgctggagcccagtggtctaaagtcccggttctggacagcagccctggtgccaggcctcagggaaggctgttttgtgggaaaccgggtcgccctgcctcctgcctgcctccctgcactctcctcctccttggctgctttcaggagggggttggggtgtgtgggccctcctcctccaggcaaaagcagggggcaggcaggtggaccgtgctggaaaaggagagaatgtgcacctttacctgatcagggtggctgtgagctctcaggccccccaaattgctggtggagcagcccctgttcccctggctcagggtccgttggtctggactccgaatgttgcctcctgggacctccattccagacaacccagcaaccagtctttggagaagtgagggggaagggaggggctggggccaaggggagggggcaggccccaccctttcactttctcatgctagtgacccagtgtgtacactgccttctgggcggttcctcctggccaggcagcctttggggcatgtgtggctgatggagactgggcagaagggatctggcagcatctcttcctgagggtgtgaggaatgagtcctgtggagggcagcacatgagccctctacctccatgtgggccccagtcccctcctgctgtcaggctaggtgggccttcgagagagagagaggaggctgcgttcattatgtgcactcttctgtgttatgtgagagcgaggggtcggcagcagcaagtggcctgcgtgcgcgaggtgcgggcgtggtgcgggtagaggatgaaggcgtcagtacagggcgcgggtgtgtgtgtggggtgcgggggcgggcgggggcgggcgcgcgtgtgagtgcaggtgcaggtgcaggtgcgttgcgggtgcggggcaagggtgtgtgtgcagggcgcgtgtgcagatgcagggcgccggtgccctgcgggtgcgggtgcaggagcagcgtgtgcagggcgcggggaaggcgcgtgcagggggcggcgggcggggcgggcgcggcggcggcggcggtgacagcggcgcccgcgcctccccgcgcgtaggtgtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagtaagagcagcggcgcgcgcgggctgggccggggaccccagagggccgggacctccgggaccctccgcgccgccggctccaggcgcactgcgggcccgcgcgccgccggcttctctgggctccgggcccaagcgcacggccccgcgcggccccgacccgcgagcccccggccccgggcctggctgcctgacctcagcgcgcgcggccctgcccagctctgcccagcgcggctgccgggccggggctccgggctcgcgacttggcgcggcgggggcggcagcaggtgtccccggagcgcccggcagacgtgacgcatttggcggcggggaggtcagagaggaggggcgcgcgggggtggcccccgggcctggagcgccgggaggggtcggctgcggccccagagggtcgtccccgacgcgggtgcgctgtccccacccccacccgagcggcaggcggcgggggtggcgggacctgcttgcgcctgctcctgcgcgtggccccatccgcgctgggggtgccggcgtgggagagcctctgctgtaggtcccctggggaatctgggttctggaggattttcccccagattcttctggaaacaggaatttggaggtgtggggaggacgaggtcagggagcctggatcaggtcatggggatagcggggagagactaagagcctgactggattgcaaatttcagggtcatcgaggtggatgggggctggattttggactgttggcgggggcgccctaaaggggaaggggctttgaaggtttgtttgaagtgggacctcacggggaacaggtgctgtggctcccgttctctccttggcagtatgagcagtgtagggcgaaggtctggttcgtggtccccggacccggctttgcccctggggtgagatggggagcgcctcaggggcctcctgtctggcctggggtctcccgttctgagaatcaaggtggctgcacctggcatccctagggctagcttcagaactcctgaatctccagcctgactgggccagagccccatcctcctgcgtcctcccccatcctcctccgtcccttcagtgcaggcggtgggggcgctggcggtgctggcgagatttcctcttacacatccagcaacagatcctttttttcctttactaaataagtgtctggtgaaaccttgtggtgggtgagggacgctgatcattgataattgtggagtgcggagctggaggagtgtgggggtgtgttcattccccacttctccctgcacgtgtggagagaattctggtaggggttagggatgtggagcccagccctgcaagaagcccatgctggatgggtggggtggggggccaggctggctgggggacccttccttgggtggatctggagagcaccacagggctgagacctcgagggagagggcgagcccagcccccttcatgcggatccctgagtgggtggctggctccccggtcttcacccctcagatgcaccgatctacccccgtctgtcctcttggcctccagaggtgtcctggccactggaggggcaggtgggtggcagttaatgtgcctggttctctgaggaagagagcaacagtgggaagtcagtctttcctcaggagccttcttgttgtcttttctgcttgcgctcagaagcacagaggccctcacagcaggtgtccctggtcttctccaaagaagccactttcaagacctccccatgtgcacccagtgtcctcagactgcagctcactctggctgttccttcttccctttgctgcgagcctccctgcgtccagcggcagtgtccgggtggccagctccccgctgagcctccgattccagcgcagctggatgtcctggccagtgccacccacactggggaatggaggtctttggggctgcctggggaaggttgagagaggtggctccagaggtggagaccaggtggggctaagactgctgggcttctctgtcaagccagagaatgagctgctgctggaaaggagcgagtgtggcctcctgagcgaaagcactgggagccatgcattgcgaggtgaggagtggggcctggcatcgaggggagccccatgacctgggacaagaggagatgcccaagccaggagcaggcagctcagcctagtgcacctttgtggagccctgctaggcgccgggtccctggcgacgccaagggcctaccactgccctgctgtggcggctcttgggtagggaagggaccgattcctcgggggtgcagccgtgccatagaggtgggccagggagctgggagggcagagcagggcacctaagggggatgtctgaggccagggctcagttgtgggcactcagcccatttgcagcgctggggtcccttggttgttatgctggctggttgttgacagtgcctgcccagggcacagttggtgttgcttcctggccccaggtggacatgtccaagtttatttaaagctgcagccactggcacccagtcaggtggcgctgagctccctgcccaaaggaagggcttggcctcaggcccacagctgctcatgtgtgacgaggccactggcctttcccctcccttgccccatccttttctgctgtctctgctcccgaatcttccccagaggcctgggcagcagggtcagccagccaagaggggccgctttctggggccctgccctgcccagctctatagggagtgtgtgcccttccctgctcagcctggcagggctcacagacactagcctggtggcccatgtgggagcaggtacagagcaaggcaaggaagccctcagcccggcatggcccagccaacagtgcagtttttattttttttatattggataaactttaaaaatccagaaaaatcccagaaataataaaatgaacacagtatctcttctacacagaattgaaaatggttactcttttgtcattttggctttaagtccttttttaaaaaaattataagaagtattacaaagaaatattaagtaacccatttccttccaactactgcttttgtatttttcctcccaggctctttcgggtacatttacacatggatataagtatccataactaatatataggattgttttgtgtgggtgtttttcttaactttacataaaaaacctggaacttgtacttttcactcaacagtcttgttgacacctgtgctcgtcgatgtgtttgatcgcaggctgctgcgtggcgacctgtagtgtgaacactgtcctgcgtgcccccatcccaatggaaatctaggttgtctcctgtgttccattgtcactcagcacactgtggccagcaccgtcacggcccgggccctgaatgcgtctggggcgcaggtgtgagagtttctttagggtgtgtccctggcagtggggctgccgaggagggtcctcgagtcttctgtctttgcaggtgccgccactctccctgcagtgtccactcacacagcagcgttggggccgcccctttccctgggtgctgccattcctcaggttggcaggttgtcagtgttgatgggttgtcagtgtcgaccgtttgttgggtaggaagaggtctcacattttgtattcagcctcgtgaatcttccatttttggggagttgtctcttttcaaacatggagatctccctagaagaaagcatctcccacgaggttttggatttcatttcaggggttcatgggcccctccttttttggcggagatggcagctagggctgggccatgttgtaacaacacctaatgtgtacattactttaaatgtttggttttatttgattccaattgtccagaaaggcccttctccccagccccattttacagacaaagaaccgaagttcaggaaagattggcaacttgcccaagcccaggcagcaagaatggcccctgagctccagtctagggcatctcccacccctcccatctctcccactaaacctgagataggcccaaaactgaccttgatatgtccttgactccatccagtggtaccccagtcgccagcaagcgactatatcctggggtgtgtgtggcctgaccgctcgcgggggcatcactgtcagctggcggatgccttctgccgagaggcacactgtgaacaagcgaatggcctgttaggtagttaatagataaacttaggaaattcagagcgaatcaatttttgagtctccaagctctgagccggttgccagggaagagaggaatggaggaggagggatcatcgtatttgctttctctctccccagagcacaccaggcactccctgcctcgggggccttggccaagctgcctctcttcccctgacccctcacagctcactcccttgggctgctcagcaggctctcccagatgccccctgccctggctctccttttgcctccccactgctccctgcccctccccctagcttgtcttctccctggcactttgccccatctgatgtgctggacagcttacccacagagaggcggaggtccggctccctgccatggttgtgtccccagtgcctggcccgaggtggggaaggggtgagttgggtgggcctctgccttccggcctggctcccaggaggccagcaagagtcctcctggtcttgattccttaatgtagggtagtttaaaaagaagtcgcacatgctgagattgctggcaagatgtgcattaaggtgatgctagtttagttactatttaatggtatttttataccataacctactttgctgagagctaagaatatatctgcatgcttgctaccaggacttttcttttctggtaacagttgctagcgcttaaatggtgcttattatattaacgcgctagatctgtgaagtaggtactgtaatcatcccaagtttacaggagaggtagctgaggcacagagaagccccattccccaggaaaggtcacacagggtcaggatttgaatccacattctgctcctctcagaagctcattaccctactctattctgtgctttaaaaatgctgtgactccactggctgactcatggccagcttgtggtctactctgacctgaggcttttgggcacctgtccttggccggctgctcaccatgatgtatttgtgcttttccaaaccaagggccccctacctctaggttcccctttgtgaagatgttacttcgtttcgtcatcaaagacaaccaacactctgactccatatgacaccagcaagactagaaatttttattttattaattaaattaccagggcaatatgatcttgtaaaacacacacagacacatacacacacacaccaagtaatacagaagtacgtgccgtaaaatgtgactcctttacactcaagttccctcactctccagaggtacctggcctcttaattttaatgtcagtatgaggatatgtgtgtgtgtacatatatacacatctacatatatagcagatatagatgatttcaaaacacagatggaatcaccatatatgtgattctgcaatctgtttgcccaacactttcatgacgaccccccgtgtcagtaagtcttttcttcagctaagtgccttccaattcttagcagagaaatgtgtgcatacgcgttggccacattttttaaaccaaaaattgggacccatcctctagcaagtgtgatgggatatataataggatgctatatttgaaatcagggcctgaaaggtcattaggagggcccaactgttgtgaaggaaagctgtgttctcagcacgaccagctgcaggggctgggcctgtggaggtgggtgcaagtggactcctgccgcggtcaaaggccacaggactaaggatgtctcaggtctcacttgaaagaactgaaggacctattcccatctttccatcccccttttctaggaatcccgaagagcagaggggagagatatgcaatgtttaggttttgtatcttctacttaaaaattctaacagggatgtttccctcatttttgctccattggcctttaaagagtctatattgagccaccctagaatttaacagtaatttactagaagagaccaggtggagataagtgtgcaatgtctgtccctgggaagaccactcccatttccctgtgttccgtgatgccacctccctcatccaggcaagagatgtggcctttctggagattttaaatatattttcaaaaaatttaattctctctctcttcccccacaaaaattgaatctgatttgattatttttaaagcatcttttacagctgcaagtcactttgttagtgtagaaacataaaaatgcattatgtatcaacttggtttttaaaaaattatcatattggcatattacacagatatgtatattttattcatagaaaaacttgaatttatttaaaatgaaaacatccttttatgttagagaaaggtggtgttgctagctgccaaacttttgggtggcttttgtctcctgggttagagggtcacttgttgagggctcagttcctggtggacatagttctttttgtattgacataattatccaaaaataacttaagttatgattctttgttaagccagacagaagcttttgttgaattctagaacagattggcaacaaccaggcaaagatttaagaagattttatgggaggaagcataatggcacacttgtacagggtggaatttgggacccacagtccttgtttcctcactttgtgagcagcaagagaagcctggagggcaggagctgctgtcgcccttacaatgaagtactgcaggtgttatgccttttgctgtaatgccctctgggtgtcaagcacatcccagtgagtgccgtttccagcaaggagctgaggagccttgattctgtcacccaacacaccctgaattcaagtgctgagaacagtgcctggcacacagtaggtgctccacagtgactcagcaatggtctgggtcactcaggccttgcacctgggactgcttcccagagcagtggcacacccaccctgtaaaagatgagggccttataagaggtattgggtggctctgcaggtaggtcttgcgggtattctgatgtccagtctgggtagacagtcttgtcacccggtgaaatgcagtagcagggctgtcagcacttatatgtctgtcatggagcttgactccaagaggcttgcagctttcagctaatttcttaatgaggttgttcacatgacttcttgtttgttgaggtgctgcctgattctcagcgtctgtgagtttgatccaggccattagttaggggctttctgggcaaagggtaggagtctggttaggagcaggccctcccaaagaagatgaccatgtggtggttctcaaccccaaccacacatgggaagcccctgaggagtgttcaggccccatcgcatttagccagacactagggaaatggggtatcagcagtttttaaaagctcccaggtgattccaatgggcactgcatacctagactctgcagaggagtctgcacctgaggccagacactcgcctaagcccacactccttcatataacccttggttctttcagagcccacctaggcatgaatttgaagtttaccttcattttctctacattcacaatgacattactaccccaccgcccaccccatccaagttgtcgagagctgcattgtccagaagagataaaatgtgatacaaagttgagccatatgtgtgattaaaaattttctagtacgtaaagaaaaaaaagaaacaggtgaaaggaactttaaaaatatatttatttaactttatatccaaaatatcattcagaggcctggtgcggtggctcgtgcctgtaatcccagcactttgggaggccaaggtgggtggatcacttgagcccaggagttagagaccgtgggcaacatggcaaaaccccatctgtacaaaaattaaaaaatcatttcaacatgtaatcaaaacagaaattattaagctattttgcattcctttttgtactacgtcttgaaatctggtgtgtattttacccttacggcacatctcagtttggaccaggttcttatgactacatggtgacagtgaccacagtattggacaacacagggccagagcttcaaaatcaccatgcttttttttttttttttcatttttcctggtttcttttaaggataatagttacagtcatagctgtcttagtctgttccagatttcttttgctctcctgaagacttattcatttattcagcaagtctggttgcctgtacttaccatgtgccataggtgcttgggaaacagtagtgaacaaagcagtcaaggatgcctgcccttagggagcttatatactgctggatagaggcaggcaataaacataaatactaaaaaaattatatgatagggtagaaggtgattaatacctctgagaataattaagaagactcaggagtgctagttaggaggaaggttattattataaaaaggatggtaaagccaagaaaaaagaagactccaattgctaaaatcaggaatgacacaggggaccttactgccaaccttacagaaaaaaaattataaggaaataactatgaataattatgtgccctcaagttagataacctggatgaaatggacaaatacttagaaagacacaaactactgaatctggctcaagaagaaatagaaaatctgaatagacctataacaagtagagactgacttagtaatttaaaattttcccacaaaggaaagcttaggctcagataatttcactggtaaatcctaccaaacatttaaagaagaattaataccagtcttttacaagctcccccaaaaagtagaagaggaggaaattctttccaattcattctgtgaagccagcaataccctaataccaaaaccaaagatatcacaaaactacagactgttatcacttatgaatgcagatgaagcatcctcaacaaaacactagcaaaataaatctagcaacatataaaaaggattatttatacattatgaacaagtaggatgtatcccaagaatgaaaggttcattcagcatacaaaaatcaatctatataatacaccacgttgatagaacaaacattgaaactatatgaaccatttcaatagatgcagaaaaagcatttaaaaaaaaaccaataccatttcatgataaaaactcaacaaatgacaagtagaaaggaacttccttaacttgataaaatacatttgtgaaaaatctgcagctaacctcatatttaatggtggaaaactgaatgtatctgctctttccatttctaggcagcacggtataggagattctagccagggcaattaggcaagaaaaagagatagaaggctcccagattggaaataaatagttatagctacctctcttttcagattacatgctttcgtatatagaaaatcctaaggaatccatttaaaaaactattagaactaaaaaatgaatttagcaaagttgcaagatgtaagaccaatatacaaaaatccattgtatttcaatggactagaagttcaaaataacaaaattaggaaaaacaatttacaatagcatctaaaaaataaaacacttaatactaaatttaataaaagaagtacaagacttgtacattgaaaaccacaaaccactgttgagagaaattaaagaagacctaaattaatggaaagacatcccatgttcatggattggaatatttaatattgttaaatagtagtatactccaaattgacctacatttttgctatgaaaattccagctgcgttttttgcaaaaattgacaacctggccctaaaattcacataggaatgcaagagacccaaaatagctaaaacaatcttgaaaaaggagaacaaagtcagaggactcacgggttctgatttcaaaactaactacacagttacagcaatcaagacagtgtggtgttgacataaggataaatacatagatcagtgaaataggattgagagtgtagaataaatccatacatctatgttcagttgattttttacaagggtgccaagacaattccagtggagaagaataacggtccattcaacaaatggacaattgagtatccacatgcagaagaatgaagttggagctgtacttgacaccatatacaaaaattatttcaaaataaataatagatctaaatgtaggagctaaaatcacagaattcttagaagaaaacataagagtaaatctttgcaactttgtattaggcaatggttttttagatatgacaccacaagcataaacaacgaaagaaaaatagttttgctgttgggcttcattaacagtgaaaacttttgtattcaaaggacaccattgagaaagtggaatagaatagtccatagaatgggagaaaatatttgcaaaccatctgtctggtaaggaatttgtattcagaatactttaagaacttttactacctaacagtaagaagaaacaacctaattaaaaaatgggcaaaggacttagacatttctctaaaataggtaacaaatagcccacagcacatgaaaagattttggcatcattatggaaatgcaattcaaaaccatcatgcgatgccatttcactcttactaggatggctactgtcgaaaagacagataatagcaagtgttggtgagggtgtgaagttggaatgctcattcattgctggtgaggatgtaaaatggcacagctactatgaaaaatactttggtgggtcttcaaaatgttctattcttaggtatatgcccaagagctatgaaaacatatgtccacacaaaaactggttcatagcagcattatccataatagccaaaaagtagaaacagcccagatgtccaccagctgattgaatgcgtgagaaaaatgtgttatagtcatacagtggaatattattcaggcataaaaaggaatgaaatgctaataagcaccgacacatgctgaaatgtggacgaacgttcaaaacgtcatgctcagtgcaagaagccagtcgcaaaaggccatgtgttgtttaatcccctttttatgaaatgtccagaaaaggcaaacctgtaggacaaaaactggagcgagaatggatggaaagaggatgggcagtgactgctaatgcgtagaagtttggttctgaagtgatgaaaatgttataaacttagattgtggtaatggatatacaactctcaatatatttgttgagatatatttatctgaattatatactctaaatgggtgaattgtttggtatatgaattaaatctcaataaagatgtcaaagaaataaaacctactcagaaaataaaagctctcacatctggatctcgacgttcacattgctgagaagtgagcttagaaattaaagtgactgccaatgcctggctcagggtgggcggcctcccctaatcttcaggaccccagcagaaatgcggctttggccaggccaccttctttgaaccagcctctgctgcgaagtgtcttcgcaaacaaaaaactgtgagaagaagccttgtcactggagcatctgactggtgccggatgacagcatctctaaacttagccagccctctgggcctgtgcctgatgtgagctcaggccagaggcactggggagggccaggttcccactggcccaggaagatccaggaacctgtgagccctcacataagctgggcctggggcgggttctgacctggagttcagggacacatgacacattgggtgaccctttccagagaccagcacaggggaagatgccgtctgtaccaccttactttcagggctgtgtgactgagggttccgctgtgactaggaacccagtaggtgccctggcttccaaactttgcccccatagcctcaccccacgtctgggcctcacctcacgttctgggactctattttgcttgtttcctgagtggcccttgggactgtcacatcagaaactccaggccaggcctttgtagcaaggctggggctgtagcttcccattactgcagtgtgaggtgggcctcaggggtgccctccgcctgtgccctttttccttcctcagagaaagcctgggcccctaaagtccttgtcagggcctcatagcagcaggacgacttccattgcagtgtgggacttctgaggcacaatgtgtgtgccctgaaaggcagcccaaggatcaggggaatgggacggagcgagggagtgctggcctgtcactcaggaccccagctaggcagcgggaggtgggtggaggctgggctgggtgctgggatgccaggagcccatcaggggtgatgggcccagtggctagtgagaaagtggtggtcacaaggccgctgctgaggaagcgcaccagccccgagggtcctgctgtctccctggaaattaatgtggctgagcctgtactcctccttcgacagagctggggacccagctgtcctgggcccactgcctaccaccaccccatccccatcctttcatcataacagccccagggactgacggagaacacccctcccagtcaaaaaccctgagaaaagcagtgattttgatgcttttcacaactcctctgcatgcctgaggccaggttcattttattcttacatttttattctctgattgacattcacaaattcttatcttgaccaattgtccacatgacatccaacccaggacagcctgtcttgcgggaggtgttactctttctctgtctcctctgtctctctgtttctctccctctctttttctcacttcatgtttccacttttcctccctcttttgcttcctggtcttttctaggctcttcctggtgtggtgacgatggccactgggcacccccctcactttatggggcagcccctcccgggaaggacctggggctgtttctttctccagcctcatcatcctcccctccttccctccctcttcctccctctcctttctcctttcacttaaaggatcctgtcttttgggtggccctccttctcctgccctcccaggtactcggtggcttgtccctagctctgaaggccgttctggggctttgcagcccctgagagtgtcacaggcacttctgggtctctgccccaccctcccaccaccaccctctcgccactgacacctggctgaactatttcccccagtgtgggctgaggatgctggaatagagttgtcattttaaattccactcacctccactttctggcaccaaggatggaggctctggagtgtggatggaccagagcacagcctccctgtgactccagtgctgtttctgtggcctcactgccctggggtaaatgtggggctcttcccagccttggtcacccatgggggcatcaccagcaggaagcacacactggggctcagtttccccctctgggctgtggggacagagatgtggcgaggaaagtctccagcaggcgtgactccgtggtgaggatgggcctgtgcctcatttgggccccgttgtatgaccctgggcaggagaagggtcacctcttggagcgtcgtgagggtcagtccacggtgcagggagccagccacgcagtcacccttccctgcccagagtgggggtagggcagagtcagtcacacaccccttccccttgtcctgtctgcaggtgggagcagagacccaggcctgaaggcctctggtttcccactgttgtccctgaggcccagagctggggcggtgggggtcctgtgtgaaggatgacacagctcagaaccgcagagccaggctgtggtgctcgcaggggcaggacagcccctctgggtacccggggctggggctgggagagccctgagaggggttgcaagcacccggggccagcctcaggggcacatgctggggcacaacaatcttacctgccacccctcacagccacacattgcttttagtttatggtttactgtctggaatccttagggattcttttctctgagtttttcttgtttgttactagaggttaagaatttgatttgccacatggtgataaaggagttcttcttaaaaccagattttggctgagtgcggtggctcacgcctgtaatcccagcactttgggaggccgagatgggcggatcacttgaagtcaggagttcgagaccagcctggccaacatggtgaaaccccatgtctactaaaaatacaaaaatgtgccaggcgtggtggcatgtgcctgtaatcccagctactcaggaggttgaggcaggagaatcgcttgaaccagggggttgcagaggttgcagtgagccgagatcacgccattgcactccagcctgggcaatagaatgagactgtctcaaaaaagtaaaaaaataataaaaataaaaaccagattttaaagacagcattgcaagtaccagtttctgtcattatttcttaatgattcctcagagataacggctacataccataccaggtattttattaaggtaaaacatacataacagaaaaatttgctgtcttaaccgtttttaagtgtacagttcagtggcagtacgtgtatttacattgttgtgcaactgttaccatcatccatctccagaacgtttttgtcttccctaagtgaaactgtccccattaaataccgactccccattcccttccctcaccctggcacccaccattctgctgtctgcctctatgaatttgacaactttagggaccccatataagtggaatcagacagtgtttgtccttgtttcaatgagcataatgtcttcaagtttcacccatgttgtagcctgtgtcagcatttccttcctttttaaggctgaataatattccattgtgtgcattttgctcatctattgacagacgcaggttgctcctgcctcttggctgttgtgaataatgctgctatgaatgcgggtgtacaaaggacatttttaaaggacatgatacatggccccctcccaccgcgcatgacatagccactgggttgtgtggccttgggctgccacgtaactctctgggtttcagcctccccacttacgaaccaggagggttgggtcaaatgactctctccagtcccttccggccccaggaagtggttctgtggaagccccatttctttcttctgagacttgccccaaagctcatctctcccacatgcaggtgacccacagtctgattacgtggacatttctaagcttccaaaatccttttgcattccttgagaataaaactttcgaaggatgaaatctgattgatctgaaaccaaacaaaaacccgagtactttaattgatgcgcagcttgcaggaaaaaagcagcaagcgggcacaaagcgtatcctaactcccaaagcgcccccgcccccgcccggtctcggccaccgtgcggttccgcgcgtggcttggtgagcctggggtccctggcggtggcgcccacggctcagccggcggaaaggctcttcccgcgtgtccttcgcgagccgcgcggcctcggcctggttctggctgctcaggcgcggtgactacccgcgggccgccgctccaggaggggcgtgaccggctcttaagcgccgcctttgaaggtcgctgcaaggctgcgcggacggacgccgagtgcggcccctacggtgctggcgtcggaatctctctcgtccccagtttcttccgatgggctggtgtctctggcttttggatccactcaggtcccactgctagggtgagggactgactggtcccccgcgggcgctcctgcccgggcgaggaggctgtgtcctttccacagctgggacgccgcgggcgcagagtcccgaccccaccgcactccagcccacacccgcaccctggggtcagaggactcctcggatggggaccgcttctgcctgtccttcccgagggccctccccatgccctgtgcttaggggcgcgacggagctggggacctgatgtggtccagggcagcccctggacgtgcaggagggagatgggggcgcagcaagggtgggccccggggctggaggcgcagcccagccctcctgctcctgctggctcagagctcgggtactcgggccgtcctgagagctcagtggccttaaaccctccgtctgtgtcccttctcccgtcaggccaggagcgcagatggcctgggccccaggtgggtgggctgacccctgccccagagcccggcttcagctgggcagctgtgaactgccccttgtcccagccccctgcagggaggagcaccagcctggctgtggtgagaccactctctcctctctggggcctggcctggtgcccgcccactcctctgggacagtgcacagcacagtcgcagtggtttgtggaatccgcgttggtggtaggagcctactaggccaggcgggcagtgctgggcagggctctggggtccgtttcagcctagccagacctgaggacacaacccccctgacagggctaagccaagccaggctggtcaccgcagctcagttccctcagtgcctttgctggacccttctgggccttccggctggcaggcagtaaagggcaggctggccatggacagaggccccggggagggatggtctgctcagcccctggtctcttgtgaggagagacgaggggctcgcacaccgcctgatgtgcaaggcctgctgctgggcaaagtgccttctctgtgcctcatggccagtcttggggctagtggtctgcattccctgagtaggacggggccttgccctccggacaaggtgggatatggggggcccgcacctccctctctctgtaatgtcactcctgccttcatcttcccaaagtagacacgttggtggaaccttgtcctgccctccgggtgtccctgtggatccagctcagagagggcagcagtgtggttctgaaggggatgaccaaggaagtggggggatgcacaggaggagggccagcagctcccaatcagggaaggcaagctgtgaggagaggagggggacatgggatgcgagccgggggcagggggatggggacccaggagcaggacaccatgctgggcgccaccacacacaggcatggggcaggccctgtctctcttcccccagccacctgggccttcctatctggcatcctggctccacctaccatgggcacttctttcatcccacagctcagcttgtccctggaatttctcaggtgagagtcaggatggcagctccggcaattagccatctgcacatctggattttaggggcaaagaggagaagagacgtgccttgtgcttaaagtgttcacattcctgttagggaacagaacaagaacgtgcctgccccatgcctcctgggcacatcccgtgtgggtgaggccacagcaggccctcccagcatttgggctacatgaggtgaatgggtggtttccctcatatggaaagagctcctataggtcaaaaaggcctggaatcccagcgctttgggaggcccaggtgggaggatcacttaggctaggagatcaaggctgcagtgagctgcagtcacaccactgcactccagcctgggtgacagaatgaggccccccagttaaaaaaaaatggccaaaaccccagttgaagtacggatgacagcagcaacagctcacagaaaaataaatgaaagctttcagtgggtaaaaacaggaaaacaaattcaacaagggtcagctctcagcgttcccctcagagttcccacaggctccttccaggtggccctaggctaatgggccacctccaccagactctggctaagcgcatctcatgaggccaggaccaaggccctaggacacaggcaccgtagccttgtcccagggagtaggttggcccctgatgtgcgtgacagcctctccatgtgggcaggggaggaattccaaagatgcagtgagccctggcagaccattcccagtgccaggggccagatggcgccaatgacacaggaggccccaggctgagcctcctgaaaccctcctcttcacacaccctcccctgctcacaccctcctccccctgatcacaccctcctccttctgcttaccccctcttctccctgctcacaccctcctccccctgctgacaacttcctccccctgctgacaacttcctcccccttctcacaccctcctccgcctgctcacaccctcttccctctgctcacaccctcctccccttgctcacaccctcttccctctgctcacaccctcctccccttgctcataccctcctcctgttcacaccctcctctctctgctcacaccctcctccctctgctcacaccctcctccctctgctcacaccctcctccccctgctcacaccctcctcctgctcacaccctccatcccctgctcagaccctcctccccctgctcagaccctcctccccctgctcaccgcctcctctccctgctcacaccctcttcttcctgctcacaccctcctcctcctgctcacaccctcctcccctttctcacatcctcctccccctactcacccccttctcttcctgctcacaccctcttccccctgctcacaccgtcttcctgctcacaccctcctcctcctgctcacaccttccttcccctgctcacaccctcctcattctactcacactctcctacccctgcccttaccctcctcccctgcccacaccctcctcccctgctcgcatcctcctccccctgcccacaccctcctcctcctgcccacaccctcctcctgctcactggtttcagcatggccagattgagtgacagttctccagcaacccctgtgcattatctgcataatccaccacatgcttcaaggctgggtccagggctaagagacaggctggacctctccaccctagaggctaggcctgacctgcaggcctcccctagtctgttggaagagcatgggcacagtgggctacaggtgttcctgggtggtcctccctcctgtcttcatctctgtatttattttgctctttgcttaatgcagacctccccactggggtcatggccattgttctggggcacagctcctgtggggttgctaaaggaagacatttgttgctgaagatttctggaggatatggttcacctgagagaacggagaagtgaaagagaaagatggatgctgatacagaatgagcagaagtcccagaccctccctggaagggggaacttcccaccgaggctgcacaggacaggctggatttacggggatcccagcccagcccaccgtggctttcagaacccccagtcagactggctcccctgtgagccctctcctcaggaagagtgctcaccccctctcctctctcactcccatggggagcatgtaatttcagcccctaggtggtttctggcctgtcaggttctcctccctcctgaccctcaacccccctccctctgggtatttggggtatgtagagggaggccacatcatccccccttgcagtcccctctcaagtggtgcctggtcaatgtttaacagaggggtggggtccctggtgggtggtgtttgcccatttctgtggtatgaagatgcccaccgtggccaatgtcaagctaacaacatgacatcagctggctcgcaagaatccagaaaatgtgaaagtctgttctctagctggaagagctgtctctgacacccactgcctctgccttggcccagccagcgtgaccgagtgatggagtgagccaagacggcacccaaggcctctcgcccctgtcttggtcctgctgccaactcccggccctgcttcttcccactctcagggctctacttggctcaagtcctgtgattcattttcctcttgctcccacctcccccacctcacaggggtgccccgtccatctccccaggagactgtttttgagccagtgcagggcacctcaggggacctgtgcagggcggcaagaggttgattggggggcttggggattttttgtttcattttgttttgtttttgagactggggcttgctctgccacccagtctggggtgcagaggtgcatcataactcactgtaaccttgaactcctgggctcaagcaatcctcccaccttggcctcccaaagtgctgggattataggcatgagccactgtgcctggctaggggagaggggtctggtttgatcccacctccacatccatgctgccatggtctcagcagagcattcagtgcctgtcccttcctgtgacatggggagcatagccccatctttcactgtggcctgagagccctgaagggaacccttatacactgagagggccatgcgtaggtgggtattacagtcaggatgtctcccggggtgatgacagctccaggggaagactttagagtccctgaaacaccttttcctaatgttgttcagggcctcaggtcacagtgaagttttaaatttcactatatggcaaatatataggcattttccttgtgatacatgcttttctgcctatggttttaaaaagtccttctctatcctggtgttttaaagatacaatttttttctctttacaatgaaaaagaaattaatgggcttcatttttagagcagttttgtctgtatggaaaaattggattgaaagtataaagttcccatattccccttcaccattccccacccctgttgttaacatctggcattagtttggcatatttgttacaatgatggaccaatattaatatattattaactaaagcccatagcttacattagggtttgctcttgctgttgtagattatatgagcttggacaaatgtagaatgacatgtatctgtcattacagtgtcacacagagtagtttcacctgccccagaatttctctgtgctccacctatttgtctctccctccacccaacccctgccagtcactggtcttttgactctcttctgccttttccagcatgtcataccattggactcacacagtatgtggccttctcagactggcttcttttattcagcagtggccacttaagtttcctccttaagtgggaggaggaacctgtctttgtgtagcttgatagttcatttctttttagctgaataatattccattgtctggatgtaccacagtttgttcatttgcttgctgaaggacatcttggttccttccaagttttcacagtcatgaataaaggtgcaataaacatccgtttgcgggtattttgtggacataagttttcaatgtatttgggagataccaagaagtgtgattgctggagtgtaaggtaaagaatatttttagttttgcaagaaactaccatactctcttccaaagcaggtgtaccattttgcattcctaccaacaatgaatgagaattcctgttgctccacattcttaccatcatttggtggtgtcagaattctagattttggccattctaataggtgtatagtgatagctcttttttgtcttatttgcaattccctaatgacttacgatgtcgagcatattttcatatgcttattttccatccatatatcttcttcggtgaggtatctgttcagatcttttgcccatttttaaactggttgtttctatattgttgaattttaagggttcattgtatattttgaaaaccagtcttatcagataggtgttttgtagatattttctccaagtctgtggttgtttcccttttaattctcataagtgtcttccacagaacagaactttttacttttaattaagtccaattcatcaattttttctttcatgaattgtgcttttggcactgtatctaagaaatcatcaccaaacccaaagtcatccagattttctatgttattttttagaagttttaaagttttgcattttacatttaggtctatgacccattttaagttaatcattatgaaaggtgtaagatctgtgtctagattcatttttttcatctgaatatccagttgttctggcaccattgttgaaaaggctatcctttctctatctggtattcacaaacctcagactttgctcttctccttcaatattgtgttggttattgtattatgtatcttttgactctccatataaactttagaatcagtttgttgatatacacaaaataacttgccggtatttgattgtgagtgcattgaatgtgtaaattaatttgggaaaaactgacattggacaatattgcatcttcctattaatgaacatgggatgcctctgcatttatttagttcttctttgatattttttcatcagagttttgtaaatgtcctcatatagatcttgtacatattttgttagatttatacctaagtatttcactttgggggatgaaatgtaaatggtattgtgttttaaaattccaattccaatcattcattgctgatatgtaagaaaacaattgacttttatatattaacctggtatcctgcaaccttgctataatcatttattagttccaggaatttttttgttgattctttggggttttctatataggcatatcatttatgaacaaagacagttttatttcttcctttccaataagtgtatcttttatttccttttcttgccttattatgttagctaggacttccagtaagatgtcgaatagcagtggtgaaagggaacatacttgctttgttcctgatcttagtggaaagtatccagtttctcaccatgaagtatggtgtaaactgtaggtcttttctagattttttaaaaatcaaatttaggaagctccactgtattcatagtttgctgagagtttttaatcatgaaacagtgttggatttttgtcagattctttttttgcatgtattgatatagttgtgtgatttttcctctttaccttgttgacgcattggattataataattaatttttgaatattgaacaagacttgcatacctgggataaatcccgcatgatcatgatatataattctttttatacattgttggattcaatttggtaatattttgttgagaatttttgcatctgtgttcatgtgagattttggtctgtatatttcttttctttaaataatgtccttgtctggttttagtattagggtaatgctagcctcatagaatgagttaggaagtattcttgctgcttctattttctaaaagagattttagagaattgatatgatttcttctttacatgtttggtagaattcaccaatgaaccaatctgggcctggtgctttctgttttggaaaattattattcattcaatttcttttagagatacagtcctgtttatattacattatctatatttcattgtgtgagttttagaggattgtgtctttcaaggagttggttcatattatctaggctatcaaatttatggccatagagtttttcatagtatttctttattagtcttttaatatccgtgggatctgtattggtggccccacttttatttctggtattagtaatttgcctcttttctcttttttccttagttaacctgattagcagttttccaattttattgatcttctcaaagaactagctgttggctttgttgattttctgtatcagtttcttgtttgcacaattcattgatttacactctagtttttattctttttttctgcttactttggatttaatttgcttttctttttctagtttcttaaggtggaagcttaaattactgattttagatttctattttcttcttttcttttttttttctgagatggagtcttgctctgtcaccaggctggagtgcagtggcgcgatctcggcttactgcaacctccgacttcctggttcaagtgattctcctgcctcagtctcccaagtagctgagattacaggcatgcgccaccatgcccggctagattttgtatttttggtagagacagggtttcaccatgttggccaggctggtctcaaactcctgacctcaggtgatccgctcacctcggcctcccaaagtgctggtattacaggcgtgagccactgtgcccggcctcttcttttcaaaatgtaggcacttgatgctataaattttcctctaaagattacttttggccaggtgcaatggctgacacctgtaatcccagtgctttgggaggacagggtgggagaaccacttgaggacaggagttcaagactgacctgggaaacatagcaagatcctgtttctaaaaacaaacaaacaaacaaaaaacatcacagggcatggtggtgcatgcctgtagtcttttctactcaagaggctgaggcgggaggatcatttgagcctaggagttcaaggctgcggtgggctatgattgtgtcactgcactccagcctgcatgacagagtgagaccttgtccctaaaaaataaataaataataaagactgcctttgctgcattccataaattttgataagttgtattttcatttagttcaaaatattttaaaatttcccttgacattttttcttttgtctgtgtgtcatttagaagtgtggtgtttccatgtattttgggcttttccagctatctttctgttattgatttctaatttaattccattgcagtctgagagcgtactttatatgattactgtattttaaatgtatcagggtgtttttatggcccaaaatgtggtctgtcttggtgattgttccatgtgagcttgagaagaaaatgtattctgccgttgttggatgaagtagtctatagatgtctgttagagccagttgattgatgaagctgttgagttcaatcatgtccttactgattttctgcctgctgcatctgtccatttctggtagagttgtgttgaagtcaccaacaatgatagtggagtcatctttttatccttacagttccatcagtttttgcttcacatattttgatgctctgtgttaggtatgtacatgtttaggactgcatgtcatcttagaaaactgacccttttattattatgtaatgctcttctttattcctgataatttccctggttgtaaaatctgttttgtttttttttttctgatatcaatatagttactcctgggtgggtgcagtggctcccacatgtaatcacagcacttcaggaggcccaggtgggagaatcacttgagcctaggagttcaagaccagcttgggcaccatagcaacaccgtgtctctactatatatagctgggcatggtggcttacacctgtaattccagcaccttaggaggctgaagtgggaggaatgcttgaatctaggagtttgagaccagcctagggagcataccaagaccccatctctacaaaaaattaaaaaaattagccagccatggtggcacatgcctgtagtcccatctacttgggagactgagcctggaatgtagaggctgcagtgagccatgattgtgctactgcattccagcctgggtgacagagtgagtccctgtctgaacaactacatacacacacacacacacacacacacacacacacacacacagacacatacacatatacatacatatatacatatagttactccagctttattttaattattgttagcatggtacatctttctccatccatttacttttttaaattatggtaaaacaaaattatatgtaacatataatttgccattaaagaatccattctttatccatgaaagaaataatcatggctaacatttattgagcattttactatgcactagactatgcattgttttttgacttttccaaaagctctaagagatactattatcatctccatttacagatgaggagttttctcaggatcacacaattaataaatagtagagtccagaaatggacaaagaatggtcaattgcaaattattgatcctaaaatgattgttttctctaattaatgtagacagttcacttatatgtattttgatttggctaatcaaaattattctttttatttatttttaatttttaaattgtgtcatatatacataaaaattttactattttaaccatttctaaggatacaattcagtaacattatgtatattcacattgttgtgctaccatcaccaccatcattgtccgaaattttttcatcttccccaactgaaactctgtacccactaaaaactgacttccccttctctccttattccagcaacctctgttctactttctctctatgaatttgtctattctaggtatcccatataaggggaatcatgtggtatttgtgtcttttgtgactggcttatttcacttagcgtaatgtcctcaagatatgtctatgttgtagacatgatttccttccttttcaaggctgaataatattcattgtatatatagaccacactttatttatccattcttctgtcaatggccatttgagttgcttctacttttgactattgtgaataatgctgctatgaatattgtatacaagtatctgtttgagtccctgctttacattttttttggatccaccttggagtggaattgctggatcatatggtaattctatgtttaactttctgaggagctgccaaactgtttttcacagtggctgcaacattttacattcccaccagcaatgcacaagggttccaagtcctctacaccctcaccaacacttgttattttcaggcttttttcaattaaaaaaaatttataatagtcatcttaatggatgtgaagtggtatctcattatggttttgatttgatttctctcatggctagtgatgttgaacatattttcaacatctcttgttttccatttgcatatcttctttggagaaatgtctattcaagttctttgctcattttttgaattggcttgtttgtttctttgttattgacgtttagtagttctcctatatttatccgtcatcagataggtgaattgcaaatattttatccaattctgtgggttgtcttttcattctcttgatagtgtcctttgatgcacaaaaattttgtattttggtaagcccaattaattttttcttttgttgcctgcacttttggtgtcatatccaagaaatcattgccaaatccaatgttatgaagatttccacctatgttttcttctaagtgttttgtaattttagccttaaatttaggtctttgattcattttgagttattgtttgtatgttgtgtaagataaggatccaacttcattgttttgcatgtgggtatcccagtttccccagcaccacttgttgaaaagactgtcctttcttcattgaataacccttgacacgtttgttgaaaatcaatatatgggagaatttatttctgggcactctattttattccattagtctctgtgtctgtccttatgccggtgtcagaccattttgattattgttttgtattgggttttttgttttgttttgtttttgagatggagtctcactctgtcaccccggctggaatgcagtggcatgatctcagctcactgcaacctccaccttccgggttcaagtgattctcctgcctcagcctcctgagtagctgggattacaggtgtgcaccaccaagcctggctaatttttgtatttttaatagagacagggtttggccatgttggccaggctggtcttgaactcctgacctcaagtgacccaccctccatggcctcccaaagtgctgggattacagacgtgaggcactgcatccggccagttttatattaaattttgaaatcaggaaatgtgagtcccccaactttgtttttctttttcaagattattttgaccatttttttgtccctggagattccatatcaattttaagatggtttttttttccctgcaaaaaagccattggaattttgatagggatttcacttgaatctgtagataactttgagtagtatccatgcctttactcttcacttatttgtgtcttcatgtttaaataggtttcttgtagatgacatatagtttggtcttgttttttgatccaataagataatctctgtcttttaatttgtgtatatagagccattgacatttaaagtgattattgatatagttggattgatagctaccatatttgtttctgttttttatttttccctattttctttgtttctttttctgtcttccactctttttctgctttctgtggtttaattgagcattttatataattccattttctctcctttcttgcttctcttagcattcctcctcctcttccacttcttcttcttttccctctctttctctttctcttctgtggttgtcctagagtttgccatatacctatatacatttacaactaacccaagcccactctcaaataacactacaccatttcgcatgtagtgaagtaatgcaaataccttataggttatagcagagtatttctaattcctctctcctatccctgataatgttgctttctttcacttatccataagtgataattacccaaaacactgttagtatcattattttgaacaaattgttatctattagatcaatgaataattagaaaaaagatttcatattaccttcacttatttcttctctaagtctcttcctttctttatgtagatccaagtttctgaactatgtcattttccttctttctgaataatttcttttaacatttcttataaggcaggtatgctggtgaccaattgcctcaatttttgtttgagaacatctttgtttcttatttttgatggataatttctctggatacagaattctaggttggtggttcatttcttccaacactttagatattttactccactctcctcttgtgagcttgagaagtctgatgtaatgcttttttgccccttgacaggtgaagtgttttttgcttctgggttatttcaagattttctctttgattttctgcagtttgaatgtgatacgacccgatatacactttggggtatttcttctgcttggaattctctgagcatcctggatttgtggtttggtgcctggcttcaattttggaaagactcagtcaacattacttcaaatatttcttctgcttttcccctttcttctccttctgatatttccattacatgtgtttatatcttttgtaatttttctatagttcttggattattttgttttgtctttttcattcttttttgtctttgcattttagttttagaagttcctattgatatgttttcaaactcactggttggttttttagctgtgtctagtctgcatcaaagacattctttatttctgttacagcatttttgatttctagcattgtaacttccatctctttacttacatcacccgcctgttcttgtatgttgtccacttctcccattagagcctttagcatgggaattacagttgttttaaatttccagtttgatagttcccaaaagccatgccatatctgagtctggttctggtgcatgctctgtatcttcagactatttttttctgcctttttatatgccttgtagtttttttattgaaagctggacatgatgtaccgggtaaaagcgatgtggtgaactggccttcagtaatgtgacagcaggatgttgagggagaggaagcattctgtactcctataattaggcctcagtattttagcgagcctgtgcctgcccctgtgctgtgaccttcacaagtgcttctcagtctctctcttccatccgcttatgtactacatacaggatggctggagggggctggagttgggtattttccttccccaaggtaggtttggctctgataaagccccagcaggttgggctgtagtaagataatttctcctgagggcagggttttaagaagaacagaacgccgtggcatatttcaaaatgaatatttttctcctccccctgccagaagccctggggagttttcctccagtcttcgctgtgagaatctggtagggctcctggaggtagaacttacaaaagtgtgggtgcacgctgctaaggctaggcaccctggaattcttaattctcagacttgtccacactgagcatctggcaattcggcaattacagtttaggtttccctaccccagcactggttccatggaggtttctgctctggtaagttgtgattctgcacacttgattttaaccaaaggctgagaagtgatggcaagttgtaattctctctatctgccaattttggaggcagaagttttcctgcaacctcagttctctgatggatctaagaagagttgttgattttcagtttgtttagctttttgtctgtaaggacaggagtgatgacttccaagcttctcacatgctagaccaatgttttaagctttgctttttacattttgtaggtttttcttttcacattttaggtatttttaaaaaatctacccagaagttatttttcagtgtgatttgaggtaggcacctgttattctaacacatcaaccctgtgtaatatgtatcatcaaatccattttgcagaccagcgctaagttataagtccagaattcaccccaggtcttcctgattcaaacctcccatctttctaatctctacttggcttttctgagtccagaattgtgggccttgattgtcttcccttgactttccacatcccaggtgggacagaaagtgcagtgcctgctgggaaggatacaccatcagcatctgccaatccccatgtgtatctgactcagctgtttgctgggacccagctgaccttttgttgggaggggtgggtgcactgctttagtgtcctgggagggttctgtttgatcttagagaggccagcacccccatagaattgccatacaaacatacaccagcctatatatggccaagccatggccagggcaccaaagtggtgaagggtgctggcctgggtgcactttggggagatgaggagcagagggccaggagatgggacttgtacaaatcaggagggactgatccagggccaggaggtagcctgttgactcatagatctttctaaatcacaaatagagatctcataataagcatctgcagtctccttctggtgctcagtgcagacattgccaatcaatcacagggcacatgcagccaagccccagcactcccaccatccctgggcaagcactgcccagtgccttctgcatgcctgttctgggctggtcgctgggacagagagggagcaatcagtgcctggggaccaactgtctgttccgtagcccttttgctacctgtgtgtgccacctctgaggccacccatcagcagcatgcatcccaggatgcctgtgtccttgtcctgcctcctgttgcaccccttccgttggtcctgtgatacacagacaggggcatctgatgtggtcccttggggttggggactttggcgagggcagggaggacccaagaagagaggcagagactggggttttccttccttggaggggggtcagccaggtgtgtgggatgctgggcgggaagagggagaagtagctttcctggggatgtgtggtgccttgggagccagtcggaccccacccgacctcagattgctgcccactgccttgctgccgttggcattcttgccttgagctctccggcatgacccagagggtcccggctgtagcagttcctggcagtgggtctgggcagtgtgagatgtgaggtccctgaggctgaaattgaacacggtgtcacagaaacatgtcaaaaatcacactgttctcctatcctatacagctgggttcctcaaccctcaggccacggaccagtactattaggaactgggctacacagcaggagacgagccatgggcaagccagcattacagcctgagctccgcctcctgtcagatcagcggaggtgtcagattctcataggagcacgaaccctattgtgaactgtgcaagcgagggatctaggttgcgcgctccttaagataatctaactaatgcctgataatcttaggtgaaacagtttcattctgttcaaactattttcccctagcccttgccccagtctgtggaaaaattgccttccataaaaccagtccctggtgccaaaaaggctggggaccactgctatacaggattgtcaacatatgggaggaaaacctgtacaaactcgatctggctgtctagaagtgacgacgaccacgttaacccatgtgaaaatgtggaagcgctcccatgcatcaccattcacctgtgaacctcaccagggcatatgggggaatttgtcatgagcttatttggttaagaaatggcctgtgctctgctcatagcattgtcaaaaatgtgaagaaaatggtatctctgaatatactttcctggcttgaccagaggatgagccggcgctcagtatctgggaggaaatttagcagaacggtgactggggacctggcaggtttgagactttgatgcactgaagcgagtggcttcctgcacaggtgggtgggaagggcgctgcccctgggagaggggctctgatgggaggggcacgtggtccccaggagaccaaagggggcagccacaccactctgctgagaggggcagaaagcagagggtgctctgctgggttttctcgttctgagatgcacccacaaagaccccagggcagtggctgctgctgtgggctggagccgtcaagtttgggtgtatccttggatgagcttgtggacatcaggtggatggacaggagaggtttctgcctggctcttgccaagtgtttctttgttaatgtgttcatttcatcagaagcatctcttgtggcttcagtggatcacacagggtttcagaaaggggccagtgttgagtcctaagaatagaagtcccttctccttacactcctggccctccagagcctttttgaataaagatttctatggtcaaataggttaagaaaaggatgcacctcatactcccttcttggaggttcacagtacagatgatcccattcaaggccctgagaagtcctgcagttaaagaaaggaaggaaggaaacactgtctaacctactggttcccaaacttcttttctcacagaaccccttttgcacctatcatctgttaacgtcctatgaagcttatgtttgaggagtgtgatttgggaagtgtttgcctgctgcagctgcacacagtggcagattccaccaggcagacctggactcagcatacatcctgggctgaactgcatcccccagaattcatgtatgtggaagcccagtcctcaaaatgtgactgtatttggaaacaggatagtagcagatgtaattagtcaagttaggatgaggtcatattggagatatgactgtcgttcttgtaaaacgggtgttcttggacacagagacacaagcagagagaatgccatgtaactgtgaaggcagagattggggtgatgcatctagaagccaactagcaccaaggattgcaggcagcaccggaatccaggagagaggtatggaacagattctccctcccagccctaggaaggaaccagccctaatctctgccttctggccaccagaactgtaagaaaataaatatctgttgtttaaaccgcttggttggtggtactttgtttcagcagcccgagcaggctcataaagcatggataagttaagactttagctcttgttgggctccgaagctcaggttagggagcccttgggccaaagcaggaaagagctttgggaactctctctagggttgtatgagccacccagattccaagtttggaagaatggttttccattgctgctgacgtgaattgtgcttttggaagtgaacgcaatgaaatgactgaaacagtcatggcaggccattttcgagaagggaagttggagacctcctaaacgcttgctaatggaggaagcacccagctatcagtggtgcgtcaacttgagggaatgttctttcctataagtgagtatatgatctcagtcaaaatgtggggttcgtgtgtgaagtgatgttaaatacaaaagtcaaacacaaaacaggaactcccgtgctgataaggcacatgcttggatgccggcccaggctgtggccgagtttgggtgctcacgaggagaagtgagtgtgtccagctgcttgtctccagtagggtcacctcagacctagtttttagaacccaggatgcctgggccctgggcaggagtggacgacacagccctgggagctcggcttgcacctacctgggggacgtcttgccagtggggcggtaggatggccacccgcctccctgtgggatgttactctgggcctggggactccagctcctgcctggcggggcacctgcttgtccgaaactcctcaggagcccaaacactctccccccttggcggaaccccaacactctccccacttggcggaaccccagggccagagaggctggggaggagtaaataccaagcaggcatccacaggacagtatccatgagcaaagaagtatgcaactgtcagatcacactgttgaggcttcattaacagcgcgggggacatagtgagaggagaaagtggaaagtggcaacaagagccccctaattgtgtaagaagacacctcctcatggtgcagagctgcacacttgcacacatccaaacatcaatgggccctactgaccgtgttgtgggttatggaggcaacgtcaacgcattctgtagaccctcttgtttactccatagcaaacattgtaaacgtaacaataatacaaacatacattccatctactgtgaacgtgagttttgtttttgtattatcataagcagaaaaatacacaaaagaaaaaacccacaacaacctcagcactctgttcatataaaagttactgtttccaccaaattgcttaggtcaagattagaatataaaagacctccccctctggcactcccaagagctcattttaatcaaagttgggaactgtgtttttaagccaacacacaaataaataccaatttggtttagtttcacccacacaagaaaaacacaaaggtccgcatgaggtcagcggacttgtgcctgctggggtgtccccagcccctagcccaggcctcctcatggagcccacctggggccagccaggcaagaaaggacgtaggtggcctgaggctggtttcagaacaaccctttattaatttacagcaggaaataaagctgtcggcctgagagtgcttctgtggccggcccagactcttccagaaggacctgctctggaggacctgagcggggagggggctgtgcttgctactagggagacagcgcctggcccgcgtggggagcgtcagacgcaaaaactggatgggaaatttcgatttacaaaacaggtcagccaggcttggatcttttgcttttactcagggctcctcagcttctttctaaaattctaaaatttaagaacttcctggaattgcgtgtggccttgctgtggattgaaggggtcccatggcccttggctgtcactgttgttgggaatctgagggggcgtttccagcctattctgcaacatctgagtgaggagagtgcacatgtgtgtgtgcgcatgcctgtgaactgcaaccgaccggtgaggctcaggactgatgcaggcagccctggctggggtggcacaggccccagcacttggggaggaaactggatggtgtggacatgggctgcgggaggcagagagaggaacagggagagaagctgctgcctctgaaatttccactaagggaacggaatccaagcgttgagtgggccgactcagaggccgctttgatcctgcgtggcccagcgctgccctgcgggagctcagcagcctgtcatggggatcacatgcacgatcactccaggcgcctgggtccctgcctatgctgtcctgggagcagaatcacactgccggctctttctggatgccggatactgtgttgtggctggtacctgtgtcacctcattctgtgtagggggacaatcactgcccccttactgatggaagtcaccagcccttgtgaggtggctggggagggcacctgagcaaggtctgcgtgaccacacgggataggctgtggggacgcagggtccgaccttccctccctggtgtcgttaccaagtgtcttaactggcaccccaagagccggtaatcttggtaacccccagtcttcaccagtgaaggtgaggcatgagagggccctagaggggctgttgtgtggtcctgctgggggcaaggcgaaatttccttcctgctctctgggccctcccacaaactccagccatgctgctcagggacacacctcctcccagctctccggggagaggtgcgggcagctggcgagggccgcagtgcgaccagcatgacttagtggagagtggggcaggccacagagccacctgcggtggggagctccgtgggggttggtgggagccacggatagtcagcaactggtggccggttgcaagtggggactggagggaagaggcaggcacgagggttgggggggcagctcagagctgggaaagcctgggcctgcaccagcagtctgttgtggagccagaggagccatagactggatgcgaggaggagacagaggcggatggggcatcctgcagacaatgacgcttcctgctgcctctgcctgtgaagccccgagagcccacaggatgcctgtgaaacaccgactgccctgggtggctgcagtcaggggaggtacactcagcacctctcctcgcaggtggccttcaccccattatcgcgcgagaagcctgagcccccctgcaatgaaggaggtgcccgagcaggtgcagtcgtagaaacaggccatgtagttccgggcctccattcccacccagaactaattcttccccttctctctcaggacaggtttccctggtactgttgatcccactgtaaatgagacagggttcagagccttccacaaagcaaggactcaaagagtattttcttgttttaattagctttatttgattttaaaagccccataatatgcttggtgcccgggggcctcatgatctgaacaggttattcaaaatcgctttcagcctggctcagtagcattcgtcccatgcaggccatcatgcgggcaaccttgatgtctagatgcaattcgcagcccacaggaacagcgacctgggatcccgtaggagcacctcttccggctttttcctgcctttgccccaacccgctgtgcccttacagctgcctgggatggtccacaccctagaggcaggcgtgtgatcagcctatgcacctgcagtgtcatccaaggcattctttgctgagcccaaggaccatgctgccgcctgctaggcccgcccgtgcttccagataagaagaccgggcttcgagcctctgtgcgctggtggagaggcggggagcctaagccccaggccttatttacttggggtaccccctggctctgaccagggccttgtggcctcagtgtagcacagacccatctacccacaggccctggaagccttggtgggtctcccctcctgctgggacactctaggggccgctcttcctgtactgctgggctggacaagccctgaggcccagcaactccatgctccacagcccactgtgttgcttgtaggtcagttctggctcctatatcacagcccaggcactgtgcctgatacctaggtccagagtatagggcactctgcccatagagagccattggaagggggagtggcaaaagtgaacaggtagataattaagtaaactaacctaaggaacgtgggaggtgcaatatctaaagaccaagctgactttctgtgtgagctgggaaagcggggagctgtttgcattggatcttgaaggacgcataggagtttgcccttggcagcagggacaggcttatgatacagatccaggctctttgtcggtgttgtctctcaatgtttataaacactggcgggcaagcactgagtcgcaagggagtatggtgatggtgctggcttctttgctcttggagaagtcagagatgttgggcccccagccatggcctgcatggctcatgctaaacatgtttgtggccacttctcaagagggctgacacttccaagggggcttcccgtgacagattgccgtctggcaagtggcagaaccaccaggaaggggaggagacagaggtggatctgcagctgccagcccaagttccccggggagatggcaggatgggtgcgggtggacagccattatggggaggagcacctttcagggtgctctttaggggaagtggtgggtaaagcgggcaaataactggggtgggagacttaagcatacattccttaagtcccccagaggagagaggagagggagaaaattggggggcggcgatgacattgggactcagagaaggtttggggcttcagtgagggacagaaggcgtgggagaggcagagcccaggagcggggcgcagggagcagtggtgtccttgggagccagccctcctgcgccttcccccagctggccaccttctccctctgggggcatccaagtcgctgggaaaggggaccctgtcttctattcttgagggtgccctccaccctacctgcaggcctgtgtccaagagcagggccttcttcacccccgggccctgcacccctggtccctgcacccctggtcccttcctgctgagtgtctgctgggtgcctggcactgtgcctgccacatcctatgtcactacagctgtgcggcctggtgctcccactccacactcatcccgaggcccccagccatgccttcctccttcctcagcggcgctgcctggccttggccccctggctctggcagtcttacctgtgttccctgcccccgccttccccgattgctgactgctccgacctaggctgatggtgcaggggcggctctggagccttctgcagaggagaaaggggctgcctgacccagggaggggagagggatcaactggaggaagcccttgtcccacccacctgcggtcaggctcttggtgatatggtgcatggatgtcgtgtgctgaggaacagctgtggcttgccgccctctgctccggtacctgtctgagtctggccagcagctgggagcctgctgtgctggtgggaagctgcgcttgggtctcctccctgctccggggacgggctcgacacagcggtgccatacgggcatcatcagcttggcatagatgtgcagtctgttgaacttcctactgagggtcaaccctgcagtgtgtggttgcgttctggcgcacggaggcccagactccctgctcccttcagggcctggtccagaacactcagtggaggcctgccacgtcagccctgtggccgctgagccctctaggggtcagagcgtgacagatggtagctcaggactggtttcgggaagctcttacctctcctgagcaagaagtccggcaaacagccacacagtggccccggaaggctcttctgctcagtcatatggatggggaaactgaggctcagagagctgtgtcaccccgtctaaccaggattgaagccagaccaggcaaaaagcccatggtctttgccctcacctcagtctcccaagttaatgtcatatgttaaaaataataatcctttctttatatttttctttaaaaacattatgagaacgtaactgatgcacatggtgaaaaaatcaagcagagcaagagaatgcggagtgaacagtgaacacctcaccgtgcccccccgccgcgcccccccgccgcgccccccacgccgtgtcccccccacaccgcgccccctccgccgcgcctcccccccgccgcatctcccaccgctgggtctccccccacatctcctgaggcagcccctgtccctgttcactggttgactttaaaaagcgaagacgcagctcagtggccgcccaagcacagtgactgctcttgagacctgagtcgttaagaaaatgttcaattagatttagtgtaattatttatctttccaaggaattgaacagtactcttttacaaagatttatctccacaaaggactgtagataaaacggtgttcgtatgtaagacgctcctcttccaccacgcagagcccttggcctggactcccatgtgggtttctcaggctgtccaggccgaagaagctttctgggaggggaggctgttcctgtaggggggaggctgggcactttgcaggtgcaaacacaggagggccctgcgtgctcgggtttgcacgggtgggtgcccacctggtggtgggcttcctccaagcccccctttctcccagccccagcctgagagcatccgctggcccttttgtctggactcagacccttcatgtgacatttcttgaccaggccccttgcctcacgtgtgctgttcttagaaaatgatctgaaatcaaattaaatcaaccgtggtgactagtcagattctgcggggcctcctggtgggcaccggccccctcccctcctgcctcatagactctgtggctcccattgggtggcactgactccctcagggcgccctgaagccagggcaggagctcctctgcaggccaggctttgtggggtacgttcatggcctcttctcgatggcctcagcagccttaacccgattccttccttgtgtctcttgggctctggactgtggttgatgctggtcagctccctctgtcccccgtccctcctcccctctccctacccccaggctgtcagtttgtgaatgtcccttcgcccttactctgggcctccatggcctctgcgttgacacctggacagtggaggctctcaggaccctctcctccagcttttcagtttaaggatgtgatgtttctctctccctacaaaaccttccatgagtccccatgtctgactgcacaaatcccaatataactgccctctggagctgggccttccagacaaggccagctttatttgcctctggggaagactcagcagggcctcatggacgtggtacagagcccccgaggatgcctgctgagaggcctgtggacatggactcttggtccagccgacccacaaggatacaggcctgtaggtcacacaggagctgaacggggcccctccgccaccctcccgagggcctgactgatccttcttctctgcacagccccccagggcgtgccatctgccagggctctgccagccgtcgggaagccggcctctgttctgctggtgttgagtggggccagctgagagtggcttgtgaggggcacccacttcctcacagtttctgactcacagccatctgcccgaggccgggccggtggctgaatgcttaatggggagtgtttatggggagattaatcggctctctctctttctccttgtctgtctctgtctctgtctctcgctcccccattttcctccccaggggggctttctctgtggtccgacgctgtgtcaagctctgcaccggccatgagtatgcagccaagatcatcaacaccaagaagctgtcagccagaggtagggcatggggagtgtcctgcgcagctgctgtcaggctggggcaggggctttggaggccgtgccctgtggactgggcagcaggcccctcccagtcttggccagcacttggcccaccctgcctgtggctccatgcacagatgcagtggggttcctggagtggaggctgtggcagagggaggcacaggagtgttggggacttgagggcacctctggcctggtggggcccaggctggtgggggtgccaagggaccctcagacccttggatgcacctttgtgctctggttaggttgttctcagggcccactttcacctccccatcccgtgtatgggggtctctgcccccagagctggaggggaagaggttcaaggtggccaggccgccatggtggttgggtggtgtcatctgccctgagagccgtgggccagatgagagctcagtgacaaagtttcaggtgaccgggcagtgctgcggttggccatctgccttctgacagcagagtcctggcgtcatggcctactgggaggtgacctggcagtttcctaactaacagagcccaagtcttctacatagtggcagggcactccgcctgtcctgggagggcttctcagacgtgcagggtgtgtgcgaggaagggccttgagtggtgctggccccaagtggccctcagcatgtggatatgccccatcacgggcctccagagccctgctggcaatgatcagctctgggcactgcaggcagtgatggagcagacaggctcctgccctcacggggtctccctgccctcacggggtctccctgcccttgtggggtctccctgtccttgtgctgtccttgtcctgtggggcaggtcgaggacaaacaaaacccaaaatcagcacacagcaaatctgatgatgatgggcagaggcctcccggggcagctgctgtggttggagcacagatctgaggaggtggtggggagggactatggcaggggtcctgctggagccccaaggtggggtgtgccagagcgccaggtggggctgtggaggtgggtgcaggaagggtgggctgcctcactgaggtggcagccccatgtcactgccccgtatggtggggttccatggaggaggggctggccggatgatgccctggtagagggagccaagcgaagcccctgtctgcctctctgagcccctcccctcccagggcaccaccagcagccttgattagcatccaggcacaaatctgagctaattgggagctggagaggccctgacccatctggccaggctgccagatgctgagggcctaatgtgggcagagacgggcctcctctgggttggtgggagagctgcctactgtctgtggcctgcagtttacagtgatccagccacctgtgggggcgggcctgtgccatttgtggagcgatgtgtcggcgttgtttgagcgactgctgtgtattaggccatcagtgtttccccttcttgggagcattccctgacaccaggctgtggggaggtcctttaggctgcagtgggacctgctcctgtcccagcccttgtctgcctcctcgtcactgagccacgaaggggcttggcggtgcccagggctgggtcagtccccatgtgtgtgtcccagcccacgaggggccatgggagggtgacactgcagagggttcagcagggacactgaggagtgggctggggcagctccagaggcatgcgctcccaaccattctccacacattgcgggggcctgggtgtcccttctgccctgtgactgcacagctggaagtgggccgcctgctggtcagctcttttggccccctggggcccagcccgtggtggggtgggtgggccaggctgtgttccaggacctagggcagtcagcttgttttttcttgatcaagacagagaactggtcataagtgggcggtgctcagttgtgcctgtggccagttcctgtgggtctctgggtgacatccctgaggcctggacactccctgcctgtcacagggtgccatggagaggaggtctatgtgtgcgtgagcgtacctgtgcatgttcacacacgtgtctacgtgcacatgcatgtgtaggtgcatgtgtggagcatggtagagcctctggaatgggactgtctggccctccggcagttaggctgggaccagcccaggatgagctgggagaatgagaggtccttctggttcctgcttgggaagatgcttcaggttcccaaggggcctggagtgaggcaggtgggggtcctggaggtggcccctggccgggagagcagtgggcagagctgaaggccacttgctccaagggtcagcttcgatgagctctggggtgtttggacaagcaggtgggaggaggagggagtggcctctgtaaccaggatttcagtccagactcaggagggatgtccagtaaggctccagagactgagccgtgtggttgagagcctgagtgtgtcattatgggtgtgaccaagggtgattggggtgctggggggcagatgtcgccgggagcagagggcaggaagctgctgatgccgagaggcctggccagggtcctggggtgtctgctgagtgcacagaccctgagtgggctgccataccgggaccacaggatccgagctgcctctgctgtcctgcaaagctgtgccgctgggagtcgtgggtcagtgtggtcatctgcggtggccagattttctccgtgaccacccagggactgctgctggcttgagcccaggcacggggatgatcaagtgtgggccacagcctgctgtcctcctggccccagggagcagctcatatgtcccgtggctgccccatcatggatgaagacccacaagtgtctggtggccccgctggaccctgagtcctggcactgcccagtgcagcctttctctagcaggcttgaaactgagacctgaagagatgccaggcccagctcaggtcccacggccaccctgcgatgacagcagtcatgttaaagccagcgcctcccgcgtggttgctgtgtgcacggcttggtgagcccaggaggcttctgtgttccctgacgttctgtggctggcactggtggaggcactagagtgaaatgttctgggggtggggggagtatcacccagcacaaaggtggggtccctaagccaggaagagcaggaacctcaaacacttcatgttggagccttccaggcacccccttcccctcatccctctcctggttttatgctcatccctgcctcgtttctctgttgttttgccacatgggcgtttcacctgcttgtgtctgagcctgaaagtggagttgcgctgccgctgtgacctgtcttgtgctcgggtgatgttctggggtgtgtctgtgggatggatcccttcccactgctgtgtgatgttctgttgaacgaaggctgctacttttctggctgtagctaattcctgatgacgttggcagagccactgagaccccacactcaggagaagctccgtgacatgtgtcagtgaattgagtttggcaaaaatgttgcttgctggtcaacttggtgttttaaaagcctgtgcaaatttattagcttaggaaaccagaatccatagctggctgtctccctcctgcttttccatctgtccgtgaaggtcagcagccacccccacccacctcgggcccttccttatcaggggcctccaaagccttgtccacctagacccacagctctgacatgcacttcccagggccatacgtgtgaggtagcaccacctcgtgccctgtggcctggtgacatatgtgtgtagtgtggcccctctctccacagattgagacccgtggggccttccctccctcctggataccaggcccacacctgtgggcccatgcagggcagcacagtgctgccagcctctcctttgggatcactttgtctctgcctgcttctcctcggccagggaccatggggcatgtcagacccagggcttcctggcccctctgcacattctgtctcgttcctcaattgtgcgagacctcgggaggaggagagaggaacccctttagacacaccctagacatagactctcactcatgtaacaggtttacacggaggacacagagatgagcagatacaccctgaaaccagcagctacgacgctgtgtgctgggtggggcctgggagaggcagtcctgaggcagtcctaaaagtggagttgcgctgccactgacctgtcttgtgctcgttcactccaaaagttgtgttgcatgggcgttgagggatgagtaggagtttgttagggtcaagcagaaaactacccgagtatgtttttgtggaattacatagctcctctaaattaacctcacaacccctatttatattctcaaagtgctctatgagtcagaaggatttagggtagtgggaatctgagtgagaggatggctgcgccctggagaccctgctgaccacacaagctgcagagctgagctgctttgtgttgccctgtggctcatcacaggccttgctcccaggtgcttgtgcctctcaagctgtatgcctagcctgtttactcattcgatgcaagctgggtagggtggtgggaggaaggggtagccagccagggggctgcctggcattctcagcagccagctccctgctgtgaccttcccgcaggatgcctctctgggcaggggcagggatacccagccgtgtgtggctccagagggcaggccgacccctttctgctttgcctcgagttgtacacaggccctccgcccagggctgcacagcctcaccctgccattttcttgggcatttttttcctatttaactttttatggtggaaaatttcaaacactcccaaatacagagaaaatgatagaacgaacccagcttcaacagttatcaattcttagccagtcttgttccatctgggccccagaccctgggatgtttaccattcagtgcataaatatctcagcatgcatccctagcagaaaagggttccaaaaacagccacaggagctttatcattctgaaaaatggacagtaattccttgataccatctcatatgcagcctgtgtttgtgtttctaatgattcagaggtttcctcagaattgaacctttgggtcacacggccctgcacaattgggttgtctgcccttggtgcttgagtcctgctcctgggtagcatccctgaggtgtgcagttcacaccccgggggccccgctgtagccacacagcatagatcacagtggagcctcagaactcttgatgagggagctggccctaccaccccggctttgagggaacctcatccccttggagttgaaatctgggtctccagaaaatgacccagacagagctggccttgcccagatgctgtgggtgttgctttggtgtcccctctcctgcccccagcctgcctcttggggtgggcggtgacagcgctggacggtctgctgagaccgtagaggaaggatgcttggcacttcctcctggccctcttctgcaggcagaatcctgcactcaccacccatctcagtctgggtgctctgtcctgtggcctctgctgccctgggctgcctcccccatgcggggacctgaggttccccaaccctcccaggccctttgggctttcctagctgaggaggaatgggggaggtgagggatggggtcttggatggagccccagagcttcactgtgggacacgcacctccaggtgaatgtcctgcttcaaccctgactgcccagctgtctgaccgtggccaggttactcagtcatcctagacctcagtttccccagctgtaaagtatctacctcacagggatgttgcaaagctctgagaccatccctctccacatcgctgcctcccttcctggccagaccctctgcgtcctgctgcggaggacccctcgtgaatacccagtagctttctggtgtcgtctggcccacccaacctgcaggccccagggccccctcctccatgaagctgtcctggatcgtcccacgggcagcctgccaccctgcctggaactccccaggccccatggcaggcgcccctggctgtttctcaactgaccatgtgctccttgagggcagatgcagctggttcatctgatggcctcctggctcccagcccagagcctgtgaaaacgtgggagagcataacacccttcctaaccaggggctgggcccaggctctgcctgggtgtctggctctctccttcccatcgtggtggggcaggggcttccccaaaatggccttccccactgctattcagggaggtagaggatggagaggggacccagagagcaatggccttcccccctgctattcagggaggtgggggatggagaggggacccagagagcaatggccttcccccctgctattcagggaggtgggggatggggaggggacccagagagcaagggttggtgggggagaaggattctgggcccttgggccttgtgggggaggctccagcagcctccccggctgcatttcacccctgatttgggtctagcgccagtggaggggcctcgctcactccttgagagtcactaggagtgctgtgtccccacactcactcatgtccgggcccgagcagggcggccttggtccttcaaggctcctggtgatgagaagcggctggtagcatgcagctccaggaaggaggatgccactccagaaacactcaggcccccacttaccgaaatactcggccacgcggacactgcagaactgcaccagctggtgccaaagctgtaacagttcgattttttaatatttaatacttaattaaatggaggattgtgagacattcaaagttggtgaatgtactgaataatgagagattattaaactactgttaacaaaagcagttagaggaaattaattgacgggggtaaagagatcattaggcacacaagtcttaaaacatgtcttgttgttatctaccccctaccccaaccccccgcccgcttgcccagcccctgctgctcattgtccacaatgaacggctgttcttttggggacagttttgttgtgccttgttggacgccctgtgtagagggaagcgtgcgtaggaagcagtgcagcggggtgaccctggttagcggcccatgctgtggagagcctggtgcagggtccgtgccctggaatggcccttcagctcagggtggagctcctggcatcatcgacgctgtctcatgtcctcccaccctctgagctgagcgtgggctcccctttcacatggggggaaagctgagtcccgaagaagctgagaggtggacggggtcccctagctggtggttagcagagccgggatgtggaggactctagatttcacccagctgaggcaggccgagggttcggccagcgtggggctcccaggtggggctgacctcacaagtggggctcacctcccaggcccgaggctcaccccacagagagatcagtatcaccactgtcctcttcctgcctgcaggcccatgcgcagctcaccccagctccctttctggggcacctggtctccccagggacccttctgtcttggggggacactccctgcccaaaggcatgatggacagggaccatcttgaggtctctgatcattggggctggggctgagcccgcaccccagggaagcctgcacgccccccctttccccagccagaagcctgcctgcctgggacccctttgtgcagtgggtggcgggggggtgctgcctccggggctttcctactgcagccggtactgcagttttcttgtggctcccgcgcaatccacagccagaaaacgacccctgctcagggggataatgagtgcctggtcggcagaatccgcggaactgggttaatagaggacaaggcgccgcattgcagggacagctgagcatgcgcctgtggcagcagcacccctcccagcccagggaccctcccctcccagcctggagacccgcccctttccctcctccccggctcaggggccctgccctcctctcttctcccctccccctgcccctctttcccctctggcttctctccccacctcctccctgctgggagacctcctctgcttccctaccctaacctccctgggtggcttccagcctgagggaacagctttagagcttggacccccaccgaactcttggcccactctgcctttaagtttgctctctagggatttggagggtggccaggaattgggggaatccctgggaaacgccccctcccctgccccagggtcagccttcaacaggatggggatggtccctgaattgggattatggggaagggaccctgcatccaggtacagaaggagttaggggagctgggaggcaggccttctgggggctcagtgggggcaccgcatgcctgcccctcccagggggagggccacctaggagcaatgaaggaacgaggctaggctgctggatttagcagttaagtatgatttacaatcaaaagatgtaaaataagcactgtgtgtcccaaattgcgtgggacacacttacttaaactaaaaattatttgttgtgtatctgaaattgagacaaacttataccgaaaacaaattttgtcctttgtcatttaactgggcaccctgtgttttatctggcaatgctcagccagactgttaagagacaggactttgtcattactttggaaactgaattggtttaatcgaaggcttctagaaagcggccctgaagaggaccaggagaacagggagccgggctgcgcggagggtgctggcccttgctggccccatctgtcaggtggagaaagggtgggcagcatcatgacctcctgctctctggttctgggtgtggccctgtgtagacaccgagtcccaaaacctgccggtcagggtccaatgccaggttcctgagcctccatgacccctggggaagacaaatgcatcctgaactggatgcaggagcagggcccaccctgttggcatttggagggggtgagggaggaacccctgagccagggaagggagggaggggaggggaggagttgtcacggaggacccctttgcgtccttccgcatttccagccactcatcttgcagggtcaggggcttgtcagtggcagaaaaggctcccggcagaggggagacctgggagctgggttctggcccctaaagaccatcgcctccctgcctcactcctcttttctgtaaaatagatggagggttgccctccatgctgcctggcttttctagcactgacagttcccacatctggtgggatccttacttccaggctctgccggttccaggaggtgagtgaggattggggagatggctgaacccacagcctgtgggcccaaggtttgaagacctggttctgccagtgtgggcacagccccctcccctggtccttcctgctcaccgccccttgctccctccaggccacccgccagcagactgtaggcccagcaagggcaggcctcctgctttgcacatagtacctccttaataaacagagttgaacaggtgggaggagaagagtgttttgaagattccacttaaggactgagctggttggggagtggtagtgaccaccgatggaaggagaaggggattcggagtgcccaggtgcccgggacgacttgggcaggagcggggaagcccgaaaggtgcgggtttgaggcctgggtgggaaccgagcttgggaatggcagagctttggtctctgttgtgctggtctggctgctgatgggaaagtctggagagctggagatccagggcaaagctcgagggggaacagctgcagggagccctggaaggtcctgggggccctggttgtgtgtctcccctgtgggcagccacggtcctctgtccccagggccagaagctgcagtcctgtgacaggtctgcacagcggctctgaggtcacgatgtttccattgtctgcatgtcacctgggggagccccgactccagctcggtgtggagtgattagcctacagaaggtcatggagggtttattgaggttattgggggttagaagagccccgtgggtgaatgtgagggcctcagcctctcctgctggggagggcggatgtgtgcagatgctctcatccggaggtggtagggggcattctggaaagggcctgatagcagtgtgcgggactgctggccacttgcttctgttgcacagtcctctctgttctttctcctcaataccttaaaaaatgtggcagtgcttgccccggactgtgctccctggcctcgggctgtgctccctggccttgggcctcgggctgggttgggtccccaggcatctgctcagggatgagtgggaacctccgggcagctgtccactctctgaaaaggacaaaaaggacatggacagagttgggggcagaggatgaggctggacataaggccacagtggtcaagagtgcagccctggagtctgggccttatttttgagagtaggaccctgacagggtgggtcctgcacccccaggggctggcctgagccagtgtcccggctgtctccggaggaagccaagctggtgtctatggagagatgggctttggtgggacgtgtatgtgtcgggggtggggggaccccaggtggaggacccatcgcaccagggctgggagggatggcctagcaagcccctcctgtcactgtgcctgccctgtggggggccaccgttgttttcctagactggagagtctaggcaccttggtttaaatctcctcctactcacccgatttgtgagcacgggagtcctgtcctggggttacggggatgactgaacacaagacacccagcactggatggatgagtggatgacattttattgtcacatatactcagagcccagagaggaggatactgcactcaggacacagtgaacaggcaggggctggggaggcaggctttggagtaacaacgaggtgaggtggcccctggttcccaccagaggcagtttcggctggtttgaataattccatgggttggcagagagctgcatctcactactcaggcataagcaggagctgtgcccagtccttgtggggaggacgcttgcctgggtgggtacttagccacagcagcagagtccggtgggggacatgaagctaggctgttcagggccttcctggtttcactgggtgtcaaggtagcacgtaatgttgttggctttaactttaggccttaaaccatagccctgcacaaaatgccacagcatggcagtgacagggaaggaattccaagccacacctccgtttcaaagctgagctgcaccccgcaagctggaggatggttctgatcctgaaaagggcactgggaatggggccccagctgaaaggccaagtggaccccatggagggaagatgctgtggaccccccagtgtgtagcctggaagtggccctactgcagccactggcctggcctgggctcccagaatggctatgttcatccccatatggctggcaaatagtgacgaggccctcggctccagctccgtcatgcatgttcatgcagaggggcagggtgctgccgacatggttgccagggtccctgggagccctgaccttgaggcagcaggcagctgcaggatgtgtccacaggtgcttcttgcgggtggtggagctgctggcgggttaattgctggttgtcgtgttgccttttaaaaacaaaacatgcacagaaagccacagcaagagccgccctcttgcatcttcatcacagggctcagcctcccggggctgcccaggcctgactggatcacttgggaccccaagaggtgctgggtgcccaggaggagaggggtgtctgcctccaccgcctacccccttcgacaccacctcaccttttctggtagacttgtgctgccctcagaggatcctgacctggcccccagaccttgggccggggttattcctgcctcagacctaccactgggctccccaagtcctcgctgcccacccccccaattccccgccccagatctccagagggagagcaggcttgtccagcccactatggcagcatctgaagggctccgagaagtcccgccggaaagaaaatgaagagggggctgctcccgaggctccaagtggggcctcctgtgacggggtccagctccacttctacccagtctccttgctcccatgcccccatctgaaagctggggtgacgcagcaacagccctgtttcatgggtgccatgagcagctcacaggcctgcccagagccagtcctcagcacacagaagtcactaccctgaagggactcatagggtcattctcaaggagcagttttccttttaggaggaatggccgggacctgcccatggcctcctttcagcccctaaaccggcctgcaccctgagactggatgggcagtccctgccgcatggcccaagctgactttggggtcaggactggttctacttcacatttaccagccagggaggagagtcagaggagaggggctgctggaagccactccttcgtccccacccagctgcccaatctggtctcaaataaatccaaggtcagtgctaccaagggacttgctggcagcccaggttggcaagtgctggccccaagatgtgagctggcctctgcctgccccaccccacagccaatgcccacttttctgtcaccagagtctgtaggagccagccaggtcatggccaaacagaattaaagaccagaccccactggcctggtgtcaaggcccaggatgtcctatcaggttctggccgagctgctcagtgccacacagggctgcgcttggctcccaagtactctgtcactagtgtgcgagcgcagtcaagtttagccttgaagtgaattgggacgcttgagttaagtgtgttggtaccaggcagggtgcagagtgtgcctggctggtgtttgatgtggatgttggcgagctgtttaagagtctagagggccagatggtggctcatgcctgtaatcccagcactttgggaggctgaggtgggcggatcaactgaggtcaggagttcaagaccagcctggccgacatggtgaaaccctgtctctactaaaaatacaaaaattagccaggtgtgatggcgcatacctgtaatcccagctactggagaggctgacatgggagaatcacttgaacccgggaggtggagtttgcagtgaaccaagatcatgcccctgtactctagcctgggtgacagagagagactccatcaaaaaaaagaaaagaaaagaaaaagtctagaaagttctctcatgcctgtgatggtgcaggtcgctgagacaggtgtgcaggtcacctggggctgatgggtcttgccaatgtactgacagtgcagggaggggctgctgaccccaccaaggtccagagtattggacagatgtgtgcccagctctgtggggatggggggtggctttgggggcccctctgtgctgtggccctcaaagtgtcctctggacaggaacagcgctacttgacagggcatctcctgaatccatttcatgggaggaaactgaggcccccgagtgggatttggatgcagccagtttcctggcccaggccttggtggcgtgccacatcccatagcaggcccctgcgtagggcctgagttctggagcatggcgctgacatcacagcaccttcagccagacagcctcaggcttgggtcagagccctgagtctggtgtccttgccaccctagtccagcgcacaggtggaccacctgtcttgatgttggtctgtggattagcctggaggagcagagccccaggtagccccagccctgaggaaccagacgctggcacagtacacagcttctggcccatccctccccagccactgcttccaggccagggcagctggagcagagcccttctgccatgtgcaccatcccagtgccctccccagctgggctgtgtggtggacaagcagaagggattgtccttgaggatctcctcccaggcatgaggaaatgggtggagagcgctggtgctagtggggggcccccagtgatgggcccatggggggtctggcaacctccctcggggtgaggcagagctgcctggaatggggggggggtacgttcttgagcacccaccctgtgtcaggcccgtgtggatttccacacacgattccattttcagtccagcacagtcctggggccagataccattattacagccatcttccagatgaggcccagggaagtgccatcccttgtcccaggccacgtggtgggcaggactcatggcacctagggagccccacccctcagccctcagaccctggtggcagtggtcccaggtggccccagctgcatcccccagccagcacagagcttacccgttgggcctcctctcggtctctgggtctgacaactccagaggcccttgggcgagagggggaggcagcccctcctgacacaggtgggccttgtgcctccccctcctgcccctccgccgcccccgcccagtgccctgcagtgtcctcctggaggtgccagctctgctgtttctcctggtggctggcggggggcccggtgcccacccacgccctcctgttccccttatccctggttcctctcactcaccaccccccaccccctgctgtgagtcacccactgccagggaggaggaggggctgggagggtggaggatggcatagggggcctgggtgggcagagaagcctctgccagctccatcccggaccccttcttggctctggagaaagaaagaggaaattatgggagcgaacatcaacgatttaccaaaccatgtaaccttaacttgtcctgtaagaccctccttcccccgcggggggcactggtcgcaccatggcctctgggtgctgtccacttgggacacgaggggtccccggagccatgcacaagtgcgcctttgggatgttgaaggctaccctgcccccaccaggcccccagccttgccctttcagccctggcagctttgagctcctctctgtgcctcagtttcctcatctttgccctgtgcctcaccctgcagatgcagcagggttggtgtgaatgtccttcccgtcagctccatctcttccatcgccctcagctggcttctctttgttcttagctcaggggaccctacagctcccatgctgatgagggtggcgtggcaggaggggaggagctccctccacaccaggagaggtttgcagtctctcccccaccactcctggtctttccgggcatttttggaatgaaataggttaatgcctgtaatgtgcccagaacagacggtgcctggcatgtggcaggtgctccaggatgggtcacgtggctgtgcccatgtcccggtcctgtctcttcctgcacttggctgtgggcaccttgaggtggcccctgccctgtcaccttcatggtggtgggtgccagctgccaacccaccagcacagtaacagcttggaggagcccccactcccctaccccatccctcagagctccatgccaaggcttcgggggtcctgtggatctgggaatggctgctggtggaggacctgtggtccctgctcctgagaggctggacatctaggcaagcataacccgaccttgtctttccccatgagcatgagtggtttgctttgtttgggcctctgcaggcaggtaacccagaccagctgggctctcagtgttttggagaaggctgtggggtgagggaggaggggaaccttgtcacctgggcccttgagcccctcctggtactggcgtggcgttgtctccccttcctctgtgatgtcggccttgctgcccccacagccagcatctgcaggctgtaaatatcagattctgcattgagcagaggctgcagccaccaggcaggcaccacccaccagctcagagagcagcagggaaggcagaccaaatggcatatcacagagagcccctgcgcttcagcgagaggccttggctttgggtcccagcccagcagcctgccctgcgcagtccagggcgtcttcggcgtcctgggatgtgtgcgggagcgggtgagaagcctgctgtaagatgagctcagcgtggctgtgcagggctcggctgggggtgcttctcttccctgtctttcagtggcccccagcctgcctgtgcctcagcacttggccctacctgttgtgcggacctcgggggacacccaggtgcaggtttggcaggatgaatggccggcaggccagggctctgtgcagagattgtagccaaatcacctagaaaagctcccagggctcggcattccccgagggctggaatctgaggatgtcgcactatcattagaattaagcaggcaggcggataattgcaggctccggtttagcctgatctttttgagggcaattgtttatggggttttttgttgttgttgttttgggggttttttgataaatgcttttatgggggtataaatgaatgctgtatttgatctgtgggatgtttctctggtagaagaaataaatagcaatgcttttgccagcgtctctcttagccacccccttggggagcaggtgtgtaaatgtgtacacacgtgtgcgcatgtgtagaattgcatccacactgaatgggccagtcaccttctggcttaaatacaggcccacacacatacgcccttgcctccgtttagggtgcagatttgcaagatgcccaagcatttaggagctggttgaactcatgagttccctctccaagcttcacatcagagcgggtgtgagaaccaagtctttttccagcatgagtaggcaaactcctactcatcctctaaaaccccactgaagcatcacctcttgagtctccacaggcagaatcagggcctgagagcactctgctcatcactctgctgtaacaaggggcacaggcactgctgtcattggctttttgtgccccagggactgtctgccctggaaccccaagaccttggccaggggtcttggggtgggagaagaagagggagggcaagagggcagaggggtctcctcttgatggggtgaggtcccctggaggtcgggaggggctcagcctgcgtcctcactccccagctcctgccttctgtcccacggtctatttcagaggttgttcttagactcctttaggaaaactcagcatcacagggaactgcagttcccggagccagtgtgcacgtagaggtgccgtgagcctgagcctgagcctgacattggccgacggggagaggggattcagcaccttctgaggagttgaccaggcaccggctgttggatggggtgggttcttggggtttctttgtcattggattcacaacctgcagaggtgtggcacctcttctgtgacttctgtgacactgcctggccctgacaaggacatcaccgtagtgggcatagccagggctggccactcaggaggcctcttgggacctccttcaggaaggggtgccccgcgggggtcctgggggcattgatggggccctgggcaggtagggagccgctgttggcagacttccggctgtgttctcgccacaggcctgctggcctcgggacctgctcagtggccactgctctggtctcctgagttcagcaggttccctggggaccagaaccccccagaatgaggctggcagggagggatgagcaagatatggttgctccactgtctggggcagggaataagaccgagctggaggttcctccagattccgctgtactgtttagggccagggcacatttcttatgcactggattgggttcaatttaacttacttaaccttgtccatgacaaggggtttacggtgttaatgtggaagccaagaataatgtccctggttttgtggaaagaaaatcatagtatgtccacagagttaggaagctggattctggcctgccctgagatggggctgtctgagccaggtggagagagaacgcctcttccttgtgccccctccttcttgtggcttctcagtcctatccagagtcacattatatctgcttagatttattttttgcccgaatttttaaaatttaagagcaaatgctaccatagcagattttatgaaacatccttgtcatattgaatcagtagcttggtcactggagacaggatcaaaatcttttttaaaaacaatgctttgctaaattatggaagtaacgcatgatcactgtcaaaactgggggaggggaagttaacgaataaaacaacattagccataatcctgccaccgagagtgaagcactcgatacgacgtgtgtgtttgtgtgttaccagcttagatcttgtgtcatggtttatggtttccaagcggctctctgagctctaacttactgcagctgctgggaggaggtggtcgaggtgctgttgtgggtgttacagaaagaggaccagtcagcaacctgtatggccaccatgagtggacacctggtgccaggactggacagccaggtgccctttctttaccccacacaaataattatctccctaaacacatgctcaggaataggtatcatttttgggctggggctcagctcttggcgatgtttcagtaatgaaacacaggcatataaattatctgtgtcccaggagaatgcgttcataattgcatctttctcctgatttggatttatgattttattgatttaactctaatcaggcaatttttcaaaaggaaactacgtgccctggttccaccgcatctccctcctaggtcctcctttccctcagcctggctctggcccacacgtcccgtggcgatgtgtggtcctgggcttggatcctgtcctggggaaagattagccatcaactttattgggacaagttggaaaggtggaacgtggattgtagcttagagacatgagtgtcatatctgcattcgatttactgaatctgggacctgcactgagattatggaagggacaccctctccttatgagacgcacctgagtgctgcctggtgttacacacgcgtcagaagaagcgagtgtgttatatggaagcaggggcggggcagggagattgtacagaagtgctgtacacgattgctctgtactgttgttgcagtttttctctaagtctgaaaaatgttcacaatcagtttaagaaagatactaggaaagaaaacaataaccccgtgaactcaccgtcctgcaccctgagagcctccctcctcccaccccagagggatgggggtcaggggtgttgcaagagttggtgccctgctttccactggagccaggccttgtgcatggacccctcccctccccaggtatgtccagtgttgctgggttttgagctccatgcagatagggaaacggagcccacaccatgtgtattctattgtgactatgtttgatttttccattctgatgctgacagacacttgggctggttccagttccgccatcacaaatccctgaggctcctggcacctcagctcccacttcagtgggaggggagaggggagggagggggagcagggactggagtattctggaagaccgtgcagtgcttgctgagttgggtgtgcaggtgggagagggagcaggtatgccctgggcttccagcaaaacagcgggatggggtctgactccctccatgccacctggaggctctgccagatccctctgaatccctctcgtgggatgccaggcggctgggcttgaagcagatggcagccaggtggccagggcagggagacgaatgcctgtcctgggaggggggagccaggggatgccgctcccagagaccttcccatctgtaggcgtggctttctcactcaagacatatgcgtgtttgcaggcatatcctgtacccccaggctgccaccaccacacctgctccaggggaattaaccccagacatgactcagccagtcctcccttcctgcaggtggacaagtttctgccaagcacggggatcagaggttttaatgcttcccaaggatgattgtgaagttgcagcctcattctttccctgctcctgggtgctactgggcattcctggcgaaggaggcatccccgaggtcttgtcttgtgtattaattatgtgcccccaggccctgctcacctttcccatggtgggactcagcactgggcaggtagagggggctccagacactgatgccccctccccagtcacgtcctgaactctgaaatgcactggcctttcctcgcagctccccacatgcggctgtgcccaccgactgcctagtttcgacctttgtgtaaataagagcacactgtgggtcctcctttgctgctcgttccctccacactattcggatgtgggtgctacccgcacgtgggggttggcagagggctttgatgcattgcagtatgggaccctgtgtgactgcagcgcatggagtcctccctctgtcagtggaagtgtggggttttgggttttgctattacaatctccatcagtttttaaaagcctcctgcctctatttgaaatgtaaaatttctggcagataagttgctccatcctttgggggccagtggaggggccacccaaggggcaccagtcacctccacgcctccggtgtccggggatctgggccccgcaccttgtggggtgggaggagagcggccagggcaggaggggccacctcctgcttcaccaccagtttactcctatctcccaggcgaggcctctctgaggctttcccctcctcctcctgccagccgggctctggggcacaccctcaaccccctcccggccccattctgacagcccctcccctgcctcggaagaacaaatttggcttcagccaaaagctccaaagagtatggaattaggacaaataagtggaggactaaatcagtgcaccgctgacttagaatcatccagggaaacttttagccccgagttagcagcgctcactacccgaatgggcctctccacccatcccaaacacaagccggctggtccctgccccagccttgccaccagtggcccagggggtgccacgaagggtgttcccttggtgggggcacaaccactcctctcgtcagaggccctggcacacccttgtgggcctctcctgacatggacgatccctgggccaccagttgctggcgcaggaggtgacgccttgtttttcctgtcccccagatcaccagaagctggagagagaggctcggatctgccgccttctgaagcattccaacatcggtgagcagcctggggtagggagcggggatgggtccccaccttctcccggacagcagcccattccggtttctctatcagactttcaaagagatgcagaaagacttccttttcttctctgttgaaatatcccaccagaagcccctgaggacgccccctcttctcccctgaccttgaggactttgtcgtatgtgacatgattcccgggggtgctcagagccggggcagccccaaggtggggctctgggtgcccagctccacccgactggacaggtccctttcccatcccactctgtcctttgggtcttgtcggtggcattggtgcagaggaaggtaaaggacacattcctcacagagccctctgctgagccagtgcccagcatgtgacccccataactctgagccgccattctgctgagaacacacaggggccccaacattctgtggcctcaagaaaagccacaagatggcccaattacaaggaaaagaaagactgaccaaagaccccagcacatgctgttctcgggctgagagcccctgactgttttcttgcgctggcccagggcttctggaactacagtctggggtcaggtgaccctggcccagagtcagctgctccacaggggtatctggagcctggagcccaggccttgcctttgtcggggagcagccaggaaacgccctagggacggcagccgctcttggcctcggaggcacctggggagctgtcaggtggatttggggccctttcctccaaagctctgattcacttatgccaggaggagcccaggcatgcttgttccaaaggaacagctggggaccgggagcctgtttaggagcctggggcatccacacactcacctgggcctggctccgaaggtcgctgaaccctcatcacctggtttagggggctggaaccacctcgcctcatctgatgcttcaccaatgagctgggcagaggggcaggtgccccattggacccagcaggaccccagcatggaaagcggcagccccaactccagggcccggggccaggctgcagccccaggtgggctctcaggggcctgctactgcagcttagcccctgacgagatttgccgctgcccaccaacccactgcatccagactggactcttcaccctggttcctcttagtaacccaggactttatttgtttgccacctctgtatgctgcccacagtgttatttgcttactgtttttatttaaatagatttcctgacaattcacttttttacttagccctgtctgtgaatttgccgtctgatgtgccagttaggttttcttttaaaccattaaataagtatataactatttttaaaaagttaaaaatgtttttttttaaagtgtccacatgcatacggcccagactccccacacagacccccagtgctccatctggcctgagcaacctgcttcctgccgaggaggtgggatttcccccaccagctgccaccccggagcccatctgcctctgccccaccccaccaggcctgcatggggaggtgggtgcctgagggcaggggcagcccccaccatgagatcagccctgcagcgcccccagggagcagtgaggtaccttcatagatgacagggcctcccttggagctgcccatgggggttctgcggggggcatctcctccatggcccctgggaccacctctgctctgagtgtgtgattttcatgaagcatgtcccaggtggggcagctcagaggggccagcctgctgggcccccaactgggcttattgggcagcccccactggaaaggagtggggaggggtgagctttttaactccagagatttcacaggcaagtcctagaagcaggacgttggtgggcctcccatgtcttagggacgcagaggccagcctgggtagaatgggagcctaggagtgaagagagggtccaggggacctagtgagagggcatccttgctcttgggacagaagccagccagagaggggtgagagggaaaggggacattggtttcagatgagtgccttagctggtggagtccctgcttggcagaggccagcgtcggctcacagacagccccggtgggtaagagttgccctccgcccagggtgctgacccaggacatggtctggggaataccttgctctttgagaatggggcttggtgggggcagagaggagaaggctgggctgctgggcctgaggcagagaagtggagcaggtctttctgcactgggcttgaaaaaaccccaggactcttaagtgggccccagaccctggtgctgagtgttggtcacctgggattcttcacactcaggtgatgatggtgacagtgatggtcacagaactgtggtttacctagtgctcactgtctcagagcaccacaaaggttacataattgatcttcacggccaccctgtgaagaggtgctatttatcctatttcatagaggggcagattgaggcttagatgggctgagcaacctgccccaggtcacacagccagtgcaagtggcaggggctgggcttgccctatattttctgattctgtggaggcttctggggcctggcctgcccttggtggagggcattttgcctgaggtttaggagctaaggagggccattggtatggggctgctggagtccaggaatctgcaaggtgaggcctaggccccagaagccacatggagttcctggatgtaaggacgctatcaggctgggcccctgggagaaccagagccagaggagggagggcactggcagccagttagaaactgggacagcgccggagcatgcaaggaaggggggctgcttgtgcctgaggcccagggacctgcgaacctaggagaaggtggctacgtcttactgtcttacccattcagcgtctgtggcccagtctcaagtggtagaggagagccacacctcagaggttcatctctccaagacttgaggactggagggaataaggctggtgcagtgcaggccctcaagccagactgcccgctgagtccacagccctattctgccttttgtgagctgtgtgactatcagctgcttacctaacctccctgtgcttcagcttcctcatctgtaacttctcggggtggttgggaaggttaaatgaaataacacacacaaagtgcttagaacagccctagcgtgttggctgtcgtcgtcctcgttgttctagcaatcatcagaaccggcacgtgggagagtgtccaaaatgagtcattcctagaaaatatttgctgcttagtacagggcacatctccagctcaaggaaaagcaggccttgaggttgcttgctttgtgctgaaatcactcactgttccctcgcctcttcatccgcttgttcattcatcacatcctgaccagctcctgccctgcgccaggcagagttccagggccaggcacgcttcacatagattgtcatgggaagttgtgcaaggaggaaggagggaatgatggtggtccatcctgctgaccatgccagctctggaattggagctcagggcccaaaattttggatgatgttgcatcaggcagggaccctgccaccagcctgtgctggcaggacacagcggagacacagagcctgaaggcagaaggcagccctgggaagacccagggtgaataatgagtggtttttgtcccagcttctcctcatgtggagctgcacggcagctcctttctggggtttggaggtgtgagctcctcctgttgatctccgtggtgtttgggagcagctgaggcccaggctgggaccaaaaggacctggtctctctctggcagaaggagacaggtgaccagactggcagcggagggtgaggcactggcagctgagggcagtggcactgccctgaggccctgtgggtgctcgctgggtggccagctggcccgcagggcccaaagcactctgctcagccctgccctctggcctgcccacccgggccctacccagcccgatcctctgggcagccctagggcttacaccgctggtggtgtgcctggacaggtacggaggcaggcaggaggtgtgtcctgggctattgccagcccctcatggcttctctgtccccacagtgcgtctccacgacagcatctccgaggagggcttccactacctggtcttcgatctgtaagttccagagctggggactctcgctgcactcactcccagccttggctcagggtgggatctgcagcctccccagccccagggaatagtccctacccgtgggctggccactcccttgagtgtgcttctgctgctggtccccttgctccaagctgtgcccagcctagcttccctcgcctcccctcatttgctttgcactagggttactgaggcccacagaggcagggctgacatcctggactccccctctcctccacacagaacagggcacactggaggcagcgggtgggtggaccccagaggaatagtcagtcagcagctgcattcaccttcctttccttggtgccctcatcccagctggactggggcaccactggctggcgtgagtgcacatgtgtgtgtttatgagtgtggctgtgaaatgtgagcacgtgcacctgtatgtatgtgtgtgggtgtttgcacgtgggggcgcgtgagcacatgaaatcagggtccatatgggtggggatgtgcatacatgtgcatgtgtattgtgtgaatgtatgagtgagcgtgtggaggtgtgtgcatgtgggtacgctggcacaagtgtatgcatgcacgtttgcatgtgtgtgcatgcatgtgtatgtgtgtgtttgcatgaatgtgcatgtgtgagtgtttcatgagtgcgtgtgcagtagctcagtgagaaggtgtctggggccgctgccgcctctcacttcctgccggatttagaagcagtgatctcatctccctcacttttgacagttcctgctaagcagcgctatatttagctgtctgtgagtcagtgctgttccaggaccctgacctgggcaagggcccataggccttagcctgcccctgtggcctccaggcggccacacagccagagaagcccagccttggtgctattgccatggttaccccaggccctccccatggctgctgtgagcgtgcaggccgagcagagacaggacacgcctgcgtgggggctgccctctcagctcctccttcctcaagtgacagacgtcaggccatggcacatgtaggcctgaggaggcctctgtccatgtgaggttctctggcctagagaagctgagactgtccctgcaggggcttggccacctctcaggttcccctgcatgttccacaagacaccaactcaaatcaccagccaggtgactggggctgacccaggacacagttgccactgcctggctgaggctgtgtcctgaaacgtctgtcctgtggccctggggagctggcaggcttgctgccacacctgtgtgccccagcacacctccaccagcctcttttcccaggaaatggagactgtggggtggggggtggtccgatccagggcccttggtggccaacagatggctgcatgtgttacaggagccgaggaggagaaagggtggtgtgttcgtgcatgtgtgtgtgcccatttgagagactctcatgtctcccgccttgccaagcacatgccaggcaggtgtcattggaggccctgaggcaggctgggaagaggagattggctggcgagtcaggaaggaccctccatgtcttccccaccaacctccatggcccctgtgcctcagccagcctccaggccagcagagggccgggacagcagtttctggagttggctggcattgccctcaggaggccctgaggccccatagtagtttgggaactctgtggattctgggggattgacagatatccccactccccttgcttgggaatgtcacagggcttgagaaccaggcctgggagtagagggtctcacacacacctgcacgcccagaggacagaagctcccataggcgccatggctgaagccaagaatcagccatgtgtcccccacagcctaaggaaagggggccatggagtcatatgtgtgccttcccggactgtgtccctcctgggccagcactgagtttcccaaactccccacagcaaccaacgtgggtggaggagcaaactcccttccctgaaactgaaccactagatggccctggccagggagtcccaggtgcccaccagcccaaactacagcttcctgagcacacagagcacaccagagggcctgcatcagccctagtgaggcaccccttggagcgactctgggctgcagccctggctcaagaccgtaaggccttttagccactgttctgtgcctggactcggcgtctgcagagcctaatctgtgttcagtgtgtgccaagacctaaacagttatagcacaacactggggcatgccaggcccttgcctgggctagatgtgggttttgatcctcctgcccaatgcacatgtatacacaagcacacatatgtacaaacatgcacacatgtgtgcgcatgaacaaactgctctacaagtgcacaagggcacacacaggcacacagttgtacacacatgcacacaggcacacatgcaaaacaatatacatgaacatgagtgcacgcatgggcacacataggtacagacacacagacacacatgcacatgtgctcacatgcacaagccagtatacatgtacacaagggcacacacaggcatccacacatgtgaacacgtgcacacacacaccctcacacggacaggccaagctcaggagcccggccagatgaccctgggaagggccccgtcaacactgttttgtttccttgtggtcggtgtggtggttgattggctgtagaaatgtgctggcccatgaggagtgagaggagaggcaggcagaggagtgagcgagggtgagcagagctccaggtcacatgccaggtgctggtcggggacacagaacagcagaaccagtcaggcaacagaggcagagcccctgcccccagccccagcctggacagaaaaatggggaaaggaaagggaacacccagtcctttaatgccctgctaggtgccagggacttgggtgtcttcccagtgcatttcaccctcacattgctcgaaggattttgaggggattcaatgggatcatcagggcatgcgtttagctggagcaggggtgagccgacattcaacacatgctcacttttctttttctccagtgctgagagagcacccacatgtgccaaggtcacatgttcaacagatccactccctgggtcttccctgccatggaccagcccagccccaagtgctgggcccaaaaatgaggaagacctaagccctacattccagaaccaatggggaaaactgccaggcagatagagaagccacagcacctgggcagtgcagtggagcaggcggggggatggggaagagggtgcggaggcagaggaggggcttggaccccacaggcctgccccacacatagggtcacaggaagtggtgtgggagcagtgaccctaaccttctcaggggtgacagcttctaggggagtctaccagcagactcaagcaggctaagtgtgtgaggggcttgggcagacctgcagagggctccgtcctactcccctgccgtgcatccagcccctccacctttttgttccatgcccacattacccggctcccagaggcccttcagattgtggcttctgctcacagggtctatcctgaccatagggcccaatgactactcactgggtggagacacagggcaggagagtgggcagagacctcccttctgcctgtcatctctgttctcttcctagagatgggacctcgaacacctcaagaccctgcgccaccaaggagaccagatttaggcaccgtgtctttaggctctgatcctgtgcgagggccaccactctggccctaagtgggggtgggagagtattgaggaggggaaaccagatcttctcagacttggaatttgagtcacaaggcctgggtgtaacaatgcagaccctgagacaaagctcctgtgctgcccactctgggcaagtcaccaaatctttgaaatttgttttctcatccataaaaatggagtataatcgtggccaaagtcacagagtggttgtgaggactgaaatgttaaatgtcattatagataagtaagcactagtaagctgtcagtcccaagtgatggtaatacggtggaggtggtggtgctggtgatggtggtagttggtggtggtgatgattgtgatgatgctggtgatggatggtgacattagtgatgatgggagtgatggtgatgatagtggtgatggtggtggtggtagtaatggaggtgacagtgcagtgtgacaggggtctccagaatctgtgaccccttcatgcttctcccatagggtcactggtggggagctctttgaagacattgtggcgagagagtactacagcgaggctgatgccaggtgggtgcagagccctcacgctgtcctgtccctcttcctttataccctcaccatccctccttcacccactcctgctgctctttctaacccacgtctggtgctgagcatccctgctcacccacaccccagagcgatgggcatgaagccaaaggaaacttgtaacctcagcgcagagccaagaggccacctcccctccacgcccaaggccaggttcagagggcttggccctgggtctgtgggcctcccagtgtgaggatggaatggaggaacttgggctctatccaggtggggcttcccgtggaccctcaggcagcccttcccacaaggctgaccctccccggggggatgaagagggacagatggtctcagagatgactgtttgtggcccggctgctggagaccagattgagggatggcagatgtcagctggggaggtgacagggccctgtccctggaagcataggccactggtagcctgctgtggcccaggccagatgccaccctgacacctgacaaggatgtctctcgtaacagtacatctcacctcagggacagctgacagcattactccctgcccactgggctctgcccaccctgctctgccacagagatgtgtatttaaaaaaaaaaaaaaaaaaaactgaggccaggcatggtagctcacacctgtaatcctaacattttgggaggccaagacaggaggattgcttgaggctaggagtttgagactagcctgggcaatataatgagaccccctctctaccaaaaacttaaaaaaaagtagccaggcatggtggcacacatgcacatcagccacttgggaagctgagatgggaggatggtttgagcccaggagttcaaagttgcagtgagccgagattgtgccactgcactccagcctgggtgacagagcaagaccctgtctccaaaaaataaatacataaataaggctaacggaggacctcgctaggtggtgaaattgtggatgattttaaatttgtatctttgtctatttaaaaactctttttaggccgtgcgtggtggctcacacgtgtaattccaacactttgggaggccgaggtgggcggatcacctgaggtcgggagttccaggccaacctgaccaacatggagaaaccccgtctctactaaaaatacaaaattagccgggcgtggtggcgcatgcctgtaatcccagctactcgggaggctgaggcaggagaattgcttgaacccaggaggcggagtttgcagtgagctgagattgcgccattgcactccagcctgggtgggcaacaagagcaaaactctgtctcaaaaaaaaaaaccaaaaaaaaaaaactctttttaaaatgagtatgtattacttttctgatccagaaaaatgaatttttttttaagtagcagaagtagtttgatgtgacttgcctctgcaccagtaggaaactgcccatcgtgacatggcccgcatccctgatgggcagtgtgagcagctctggtgccactgggcctcccctagagctgggcagggagagggacaaagctggtgagtctcttggccccagacttctgtggggttcgggacactggcttcttttctaaggatccttgaggagggaatttgtagtttgcagaacagcctggagaggcctgtgcccttggagtggaggaagacgaggttttcctttatattctacttagaagacaagtagaaagtggaacggagccctgtccccctgctctgagcttctggggtgagatatgtcacagagcctgctgctgcctgcctgctggccaggtggactcgagggtccctggtggcccatccagacacctgctggggcaggtgggatcctgggatgggtggagtgccctgaggggtggacagatgctgggcaagggtgggggcatgtggcctcctagagcctcccatcagcagatcggatcccacagctagggttcaggagtgccttagaccacagccccaccctcccccacccccaccccctgcccgtgccccatcacaggcccctcactcccaccctcctgctcacctgctgcctccagccctctcccctgcccctctgtgctgcaccctctcctatgctccctctgcctccttattgatgtcctgcagccccccagagccccctctgctcctgtggatccctcttggccccctgtgtggtttaggagtctttgtgttcatcaggtttggggaaggagacacaacctgttatcccccactctgggggtcagcttgagagtcagcctgcccagaatgctgcacccctcaccgccccaggtggaggctggaatggggcaactccagccatgggggtgaagggtcacatgtggcttcctcatcacaccaggccagttccctccagagcgccaacccctccgcccaatccacaggcgcggccttgacttcttgctcagcatctccctcctcagtctgagtctcggatggacacacagcaccccacacacacccacagcccctccccgtggcgggccctggggtgcctggcctggcagcaggagtcccatctgcttgaaccccagattttctgctgtgggccgggggaccgcagagctggcctggcgaggtctggagcagcctcagggtaggctcgggaggggagaagtgagggatttctagggtcctcaggaaatgctcgggctgttcaggttccagaaacctttgccagagcaaactgtagtgttcccggctctgacccaggtctccccatctcctctcacaggactcccgatgcggagggcacccctggtgtatggggtccttggaaccagccagaagagatgttctcttagaaactccactgcctccattgagggtttggagctcaaatggagggcattccatagccagactgtggggagcgagggggcacacggcctgtgtgctgtagagggtgccaggatccgggcagtgattttggaggctgagtgggagaggggacatggagagggaaggagcctcctggagagcccctcctgggttggccctgctggtgcgacagcctcagcatggggcccctcctcgggcttcagcagccttgggctcctttctttctgggtgagcctcgtgccctgcctggggccacggtggctttgctctctgtgcgtgagcttcagccttcaagcagtggagctcggtggagagtctgacagaggcacccgtgggcccctacccaacaagcatagccacaaactcagggcaggactatagcaaaggagggagcttgacttacccccaggcagagccccatgtctgaacagtcagggttgtgctgagacagaggtaaaggacaggcgcgggacaggatgggccgaggcctcctggccagacccaggcagggaggtgctttccgaaccacacagacgcagccagggcaagtgtactaatgccctgcctggtacctgccaagggccaggagctgctgccgtggagcagctcacagatttctggatgagccccatctaaggaacaagaagaaacaggacagtcattgcttttctgaactcatttctaaccaacaaagctggaaattcctcttaggaggaagcagggtcttattttggagttgatggggaaactgaagggtgtccatgtcttcttcaaacagggaaagcaaagtacaaaacatttagaacccatttttaaaaaaaccttaaaaagcaatgtggtggccaggcacggtggctcacgcctgtaatcccagcactctgggaggccgaggcgggcggatcacaaggtcaggagatcgaaaacatcttggccaacatggtgaaaccccgtctctattaaaaatataaaaattagcctggtgtggtggcgcatgcctgtaatcccagctactctggaggttgaggcaggagaatcgcttgaacccgggaggcggaggttgcagtgagccgagttcgcgccactgcactccagcctgggtgacagagcgagactccatctcaaaaaaaaaaaaaaaaaaaagcaatgtcactactgaaagatggctgaagggacctggtgcaatgctgactgtctgcggagggggaggacatcagagcccaggctgagaataacgtcccaaatgctgcttgggaacaattctaatcacaaaagtgacatcttaaactgttcaaaacatgaaaaaacaaaaacaaacctagaggggatcggcccttcctagagaagacatcgatgttaacagaaagtgacggcagacaagatggtgtgactgtgagtctcacatcctccaaggccgtggtctcagattgcaccaggacaagggcaatatgaggacaggtccctaaagtgcaggggactgccctgaatgggctgtcccaggccaggtggttgtcccatcccacctaccctgctgggtgcagcctggcccagcgttgtcttggggacccctggcttgctcagccaactcaatcctgagcatgcgtttgcagggcctggaggctgcgtgacaatggatggggcggacttgatctcagcaacacgtgccaagtccccgtcatacccttaaggacaccatggagaggtgcagaaccaatgctgtccccatagtccccgtctctggcattggtttgggaggggaggggagcctcctcagcaggggaggctgaggaggactgggcgagccaactgtggagtcagggggtgatgacagctggggaggaaggaggatacagggcgtggccagagctgcggccaggactcagtaagtctgaggctgaaagaaggtcgatgaggaaggttcaactctcgccctcagcagtagtctgtgaggtgcatgcggtgcaggccgagtccctgttggtgtcccgggaggtggcacttcctggtgaccacaagctctgcacatatcactccacctggagagtgcccaagggcagaggaaagtccagccctcagggaggtgatggaccacagggatgggctgggggaaagtgcacacagttggacaggaggagcccaagatctatgcccttcccaggacaaaccagggccaagactgaccacaggatctggtcagcactgctaccgtccacaccacgcagcagtgcatgaaggagctggctggcccttgggagggcccctgggagggccacactgagctcactctgcatctggacccatctggatggctgtggatatctgaccccacagcctcacccccgacttcccaggcttcccgtcttgcagggaggctgagtctgcccaccagagggaagcccccaccccagccagccagccagccatgcttaggctcacaggccttggcaggacacagttggccattcaaaggaacagatgctgggccccttcaggaacaaggaggaggggctggtccaggcagatgagggcagcatgggaagtagatgctcctcatagtggcttgtcatgggctgacttcagggacacagccctctacaggagttgcaggagcagaagagaggccaggaagtctctagatgtaggccagggagaagggaggatgtttcaacaaatgggcaggacaccccagggcacatggggaggagggaaggcaggacaccccagggcatatggagcaaggagataggattgtggctcccactcttggtgacattgaagtgacaccaccaaggggctgtctcccatgagtttgggcctggcttcttctgaccccacacacctcaggagtccatcacccattaggactctgagggctggatttcttcaggaggaaactcagattcactttttaatgcaatggctgacgctgtacagatgggaccaagacgggtgggagctatttgaggaagaaggctgacctctcgtgtcttctctgaatttgctgttaggaaaacaaagcccactcatcttgctgaccctggtcaccctcctgtccccaaggatctggctgggatagaagggtcttgagggggtcttcctgtccctcccttgaccgtgcccagtggggcggtgactgagaccccaggcaggtgggcatcggcagcctgtggcaaatgcctccaggcccagcagggcagcctcggaggtggtggctgctatcaccctgcattgtggagctgtccctggggaagggcttgtgttgggctccaggggcacctgggcagaagcagattcaagccacgggctctcggtgtgtgcaggggctccgtggccctgggtctgatgtgctctaggacaggtgtcagggaggtggcctgagagcagcttggacctctcctcccagccagtcatggcctggaagggccctggacttctgccaacagccctccctgactatgagaggaagggttgaaggggaagctccgtgtgctcagtgctgtgcacacacagccccctgcccagcccctcagatccctgggagctgaactagatgcccctagtgctgctggaactgagccacccaacacggcagccaccagccaatgtggcagcttgggtttcactttttatttttttctttttgagatggactctccctctgtcacccaggctggagtgcagtggtgccatcttggctcactgcaacctccacctcctgggttcaagcaattctcccttccttagcctcctgagtagctgggattacagccgcccaccaccacacccagctaatttttgtatttttagtagagacggggtttcgccatgttggccaggctggtcttgaactcctgacctcaggtgatccgcccaccttggcctcccaaagtgctgggattacaggtatgaaccaccgcgcccaggcaggtttcactttttattaaaatgaaataacatgtgcccgagcacattatttctgctccagcacagagcagggtcctggtgcctggggctttctcacacaccagggcagccccctgcccccacccccagccgccttgacccttccctgccttggttttctagcccgctcgcccggcctgctcacctcagcctgccttacagggtacagactcagcctggcctccctcctgagggtgcccagcttagggtcaagcttggccaacaggagcctggggacaggggtgtttcctttgaaagtcacttctgtgtgcctagccatgccctctgaacagatatgggcccagaggggaaggcagggccagggccagagttgctggccttggaggtgaggaagaagccccagaggcccctcctggccagcatctcctctcaccttgacttgctttgtccccctggtccccccaggccacacagcaccattgcccctgcccccagtgcctcctcttgctgctccccagggccactcgcactaacccacctgctgtttgccacagtcactgtatccagcagatcctggaggccgttctccattgtcaccaaatgggggtcgtccacagagacctcaaggtgagtccccaccccactctgtgccaggtgtctgttgtctgtacctgcatgctgtgtacaaggaagtgtgaggggctggacagtgtgtggcactgtggagcttggaggggtgaggtgtatgtgtgtgtgtgtccttgtgtgcatgcatggaggagtgtgtgcatgcatgtgcatgtgtatgtgtgtgcatgtcctgtgtggatggtgtgcatatgtgcgtgcatgtgtggaggcatgtgtgcatgcttatgtgtgtgcacctgtatgtaaatgtgcatgtgtcatgtgcatagaagtatgtgtgtgcatgtgcatacgtgtgtacatggaggttcgtgtgtacatatgtgcatgcctgggtggaggcattgtgtgagtgtgtgtgcacatgtgtgtatacatgcttgtgtgtgcatcttgcacctgtgcagggatgtgcatgtatgtgcacacttagaggtgtgagtgcatatgtctgcatgagtggtggcgtgtctgtgtgcctgtgtgcatgtgtgtatacatatggcatgtgtgcatgcacgtgtgtggggactgtgcatgcatgagtatgcaagtgtgtacaagtgtgtacatgtgtgggcatgttcatgcgcatgcatatgtgaatgtgtacatgtgggtacatgtgtgcgtgtatgcatgtgtgtgtgtgtctgtgtgggcatgtgtgtacatgtgcatgtgtgtgcacttgtgtgttggaggggtgtctgcacatggccctccctacccctccggacctccagggctgggaggggttagtcttcagaaatcagcctattacaccgcactccagcctgggcaatagagaaatcagctagtaacaaatgtccactcagggtctaactgtgagcccccaccaagactccactgtggcagatgaggacacaggtgacagggctgacgccgctgggagcagagtggtgagagcaggactcgccagggtctgccaagtcctcccagccctttcctcaagtctctgctgcccccagctcaggtctgggcaaagcagttctaggctgtgttcggaagaaggttggtcaccccccagggcacagggtggcctctcagaagcttagctgtctctctgctccttcctctctcccttccttcctccctttccttccttccaatctcctttcctccttcttcaaccccaccttccccaaggcttggttcagcctgctgcttctctgtagacaggcaagcagtgcagaccctggggccatcaccctgatggcatttttaagaccaacctccccattggttttcatgctgaatgggggtcacacctttccttaggccatcgatgatctttgtgctgctctggggagagtgtcacaccaagagcagatccgggaccctctcctataccctttacacgccaccgtaccccctgttccctctcatctctgcatcccaagcatgtcctgctttgtctcacctgagtcagcctcactcaggcgcctctgggaggagggggcccccaggtgctcccctcggggccacgtgggttggtgctaggactcagtggctctcctgtgaggggccacagacattgtgttaccagaccccatgatttatctggttaactctggagccaaggcatagaagtagaggtcagtggtacctcctccccaatttgggggacaaacagaattcttgctgtctcaacctcctgttgagggggacaggatgtccttttctcctggacagaaatccaccatcttgatcgtgacagcccaggaagcagcagagtagtggggttgctctcaccccactggggagggtggtagagagcagagggcagttgatgtcatcccagggaactgcaaaagagccagggtgggggcatcactgggtggcctagcaggggtgggcacagcctgagagctaccctggagcctccaggccttcttgcccagtgcttcctacggtccatgttcacttaacgctccttctcttcggaagaactgctggtctgtttcctctggggaggggggacatgcagcaagtctgctctgggctgggtggagaaatgcagcccctgacccctcctctgtccaacttctccatgtagctgcacggggagcttggggcctccacccactcacgttggcaaaatcaccatgtccagtggcctgtggattggtgctcggtggacacggatgcgtgtgccccagcaggctgggacccccaaggtgacgaggaggtggaggtgggggacagaagcccccaatgctgccttgtcaagggggcacacggcctcatcccgcctgctcagtagggcgtggctggagctttcgaggaagctctgggtttctgctgaggggcgctcacagctcggggctgtggcagtctttccacatggggatagcatatgtcattcattctgggggtcactttttcacatttcaagatctctgaggtttacaaccagtgttaaaagtgggtggagtggtctgttttgtctctttgggcggctcatcaagcggcagtgtgatcccgagggtagtgcatcagatggaagcagtgccaggacagcggggtactcaccagggcaaaggggtggcctgggaggctggccaagggacccgagggccccagggagccccctgctggtcagggacaaggaaggcctgcagccaagagaccccaccgctgggagatggtgaggctgatgggtaggccagagcccgatggggtttgaaagctgggacaggaaggtcccatgggatgcagtggccctgggaccccctcaggccctcagtgccaagtgcccccaggcctccttggccgctgctgcaagatagggagcagatgtccttctggcttgagcaagggcactgctctctgtgtcagggcctgagtaaccccccaacctgtggatacccagcgggcagggggtcattgcaggggcctccttcctgccccatgtagtggggatgaccagagccagggggacttggtgggtggatgtcctgggctgcccctagtgctgagggccctgggcgtttctccttgccctttgggggtcaccatctcagcaggaaatacctgaacttcccctcaagcagcccccaacatcccaggtctctgaggagtgagaaacagggagggaagggagggccattgcagcctctcagccagtgggagtccgagggccatgggagcccccagccactgcacagtctgccccagggctgtggggaacatttagtttgcttgtaaggatgagcttgaggttttggtccaactagcccccaggtcgcccttccaggttatggggatccaagctcaggctgagagccaagtttcctctgaaaggccagagctgctgtgtctctgtccccaggggcagaggggctgtggggttgcaggctcagcgtctgggactctggggtgaaggctcagccatgccctgcagacaccatggggcagggctcagacctgtgcacctgtctcttgcaaaccactgttttctctgttttgtaaccccccacccaaccccacataacacctctgggtttaaacaacatgcacccttgtgccggtcacctccctgcagccggagaacctgcttctggccagcaagtgcaaaggggctgcagtgaagctggcagacttcggcctagctatcgaggtgcagggggaccagcaggcatggtttggtgagtgccaggggcagggtgtgttggctggcagttggcagggcaggaggtgatgctgacagccccttgtggcctcttcccctctctctaggtttcgctggcacaccaggctacctgtcccctgaggtccttcgcaaagaggcgtatggcaagcctgtggacatctgggcatgtggtgaggcctggcctgagttggtgcggggcagggcctcgggtgtttcaggacttcccacctacatcctggagtgtgcagtggccagcacgtcttgctctcatctgggtttatctgtgtcagacctgcccttgagctgccctggcaggggtctgcccacacagccaagagccccctttccacccagattagaattgctcacatgaacctggcgcaccccagtgctcgcctgcgctcagcagaggtctggtccagaagtgtggtgggtggatgggagtggagaagagaggtcaggggctgttgggccatgggcagggccacctccttgggtaggggtctcctcccacagaggtggggagcagcagaggggcttgacatcaccctcatccctgtgatagtgtgggtgtggggcagaggtcagggggccggctgtgcccttctaccccagtgtctgctgcacaggtgggggcaaaggaatgctgaggaccccaatgccctcccagggccacaggagctaggcagtgagggtgcagggcatgggcttcatggacggtggcaccctgcaagtggctgcggtgctcacaggccccatccgcaggggtgatcctgtacatcctgctcgtgggctacccacccttctgggacgaggaccagcacaagctgtaccagcagatcaaggctggtgcctatgacgtgagtgcaccagcccctctctgatgagctcccttcctccaggtgtggccgggtgagggcagcgtgggaagaggctaggagtggggtgaagccacctgtggccaggtcctgggtcctgctctcccagattcgtggctggagatgaagccccttggagaattcttgcccctgcctgagagggagcttcaggcccggccggggcgctgtttccttctgcagttcccgtcccctgagtgggacaccgtcactcctgaagccaaaaacctcatcaaccagatgctgaccatcaaccctgccaagcgcatcacagcccatgaggccctgaagcacccgtgggtctgcgtgagtcgcccttggtgcccatggtggggagggggctcctggtggagatggcctcagaccactcccctggcaaggaccccaagagggtcctgttcctgacatccaagagctcccttgggtcccctgggtgctccttgtggcctctggcttgggacataccagcacgtttgtgaggcctggggcttggaaggcattagagggtagaggtgatcccttcctcccaactgcagtcctgtctgtgaggggcagagtggacgaggcaagggagagacgagtcttgaagtcccaggcgggtggggacagacaacccttgccgcaatggtggccggtggctcttggcaagtggggaccccagggtgccacaagccttgccaccctggcctctcccctgtgcctcgggctcggctgccatatgaccacccatttccccacagcaacgctccacggtagcatccatgatgcacagacaggagactgtggagtgtctgaaaaagttcaatgccaggagaaagctcaaggtgaggccctggcccctagtcccaggcacggccatgcttctctgtgtccctctgggctggagcaggggggccttggggggtctgggcagacctaggggttactgctgcccccaagactgactgttagcaagtcccagactggatgcatcaggtgaactcaggccagcttgggaatgagtccagaggggccctgggccaggtgtggctcctcctagttgtctgtgccacctcctagcagcccttggaggagctgtcctgaagcgctcgctgtgggctcctcacccgggctctgcaggcagcactcaccctctggcagtcacactgtttagtacaagcaagtccgaagcttccggctcagacaggtttggtaaggagagcagagccacacacactggtcttgggtgggctgggggagttctgggagggaggtgggtcccagtagggtatccaacctgcctgctttggtcagggctggctccggtgaccgcacactggcagtccctctacttgtgggttccgggatggggacttgttgcctgactgccctctgctggtctctgagcagttctccccggaagccccaggactgttgccctgtctgagcctgtcaggaaaagaaggggctgtcagggagctggaccccagaggagctgccgtggtgaccagctgttctggtgacccctgaggcttgaggggtcttgaagcagctagaagctgtagttggtcaacaggtttaggcccagggtgtgtgtagttctggaaataggtgatctgtctcagtgcggctgctggcttcctggagctcttgcctctctggaaggctgaggtcatgtcagcctcatgacaatgaggctgagcatctgggcaggaggacaggggtcttatcctggccagaagccagcagggaacactgatgggatagccccggttttatctgtgtctctccccagggagccatcctcaccaccatgctggccacacggaatttctcaggtgagcctttcttctccagggagacaggcgctgccccctccctgctggcccacgcaggagagcgcctccttcctcaccagcctctccactcctcctctgcggcaggcctgccctcggcgtctgccctcagctctgagacccactgcccacctggccccgctgggctcccaccttgggtgataccacagggtccagccccccgaggccatcaccttcgtgctgggtctgtgtccctccaccccctgaacacgagcgtctgtgctgccccactggggctcacagcatcgtgtgtgtctgtccaggcgtttgtcgggcatctatgtggcctccttgtcattttgagtgctctgaacattgtgttttgtgcgggaggtgggcagaagggatgcggggtgatgcgggaggctcgggggcctccttccaagttctggatgagctgcagcctcctgtcccggctgctcagggtgggtggttgggaagcaagttctcttggcaggggggtggggtctgttatagacccctgaggcccagggcgctggcagacccatcgggcatgatgttagccccggagtggagccggcagcccaggtctggacaagctgtacctgtggcttctccgtcgtccgacactccgtgtgcgagcgtctgtgatccgtctctctcgttgtccgtttgcatctggtgccccccacccgccatcctgttacttttgctgtgatgctgtaatgccgggaacgcgtgcacacggtcacaccaacactaataggactgtcctgtctgctgtgtgctcaccacaccctttgggcatgagaagcccccactggggttttctaaggagaaaggaggcaaatgcttttccgtgtcaatcagtccaatcttgttttcactctcttgagcaaaggattctggaaccatctgtcacctaaactttaactctaatcttcttctgcttcctttgtctcttttcttcccttacctcgcccacccctcgtctgtgtccgcccacccctcccttcccctcgtctctaacccggtgctaacagtgggcagacagaccaccgctccggccacaatgtccaccgcggcctccggcaccaccatggggctggtggaacaaggtagatgtgtctcgaccagcgtcccgcccgctcccgcccgtccctcctgccagcatgcagccccctgctgcacgcagccgctggccgggctccagagccgccccagaggccgccaggcccccgggagcccctgctcccgtgtggtcacatcccagcagagcccaccacaagggcagggaggcagcccccaaggctcctcgcctgtaagaggaggggctgggctaggtggcccctgggctacaccaagcccttctggtcctggcccccgaggtctgggggtccggagacccccattaagaatggcctgggcccacagggagccactgggcctgctgctggggggtctgaatcctgaaaggagagccttgaggagcagagccagagaggcagaggcccttggggcagacacacaccctgcccctctggggccgcatggagacggtggtctgtgctgctgagtcctacacatgcatgtctgccctgagcatccccccaggacaagccgctctggagtgggtgagggttttatgcaccctgaggagactttcaaggcttcctcttgggttgtttctgcaaagtcctcctcccctggcctcaaaccctgtgagggaaaaggccggcactggccacctgctcctctgggctgtgcggggccagagccagaggcccaagttggcttctgcccacctgctggcttgtgaccatgggcagaccccatgagggctaggcgaccccaagacctccttgcagctccagcctgagctgaaggctggtgagagcttagggcaggccaagctgacaacgcctggccacagaacacagagggctacaggggtgaccccagatcctccctgggctgagctgctgagttccctgtcggtgcctccaacgtgggctggggacccggcagaggttccagggtgctggagactgccttccccaggcctcctcatgacccacagggtgagcagcctggccttcccagccagagaaccctccttctggggaggcccagggcgtcctcggggagggcagtctattctcctcccatgagcccagtggacgtgtctagcaggcagcaccccgggagagccctcccacgtcttctccatttgacaggcctttccagagcgcaggcgggagggggctgtgattagaaaagagtgaggctagtggcttctggggaggcactgctgcccaggggacagtgctgagagacagctgcctctacgctgccctgtgcccggggctcccgctgcaatgcccgcctgtctgcaagtgaacgtggggcgacggtgcatgaggccctgcatgtgtggctccaccctgggcgccgagagcagctctgtcctggagggtggtcagtgcatgtggacagagcccagcatggctgtcctgggtgaccagctaaggggacaaggcagaggcagggctgagaggaccacccatcctgctaggtcagcccagctcagccatatcacacggcagtgagcatggagctcagttctctgccaatggcagctgagtctagtaccatccagtcagagtctggtaccagcccatgtggcatagccccctcggcccgcagagagaccccgtctgtcgagtgtgcttcagtttggcctctgtggtctctcctgcattgatcaggtgtaagggcataggagacccagtgtccggccagctgcagggtggcagcagttgccccggcctggagacccgggaatgggcagtgccttcccaggatggagggcagagggtctctccttgtcccacagaggcctgcagaacccccaacccaggtgtctgagatgcctgtgactgctccgcctaccctgggctcctgcggcacctaacgcatgctttgaacttgagacacagaaaggaagttcccgtgcccttgaatgctagtgtagatgggcatcgacaggactctggccacggtgaatctggagttagtcccaggcagagatgtgaaatgagcagccccccaaaaaatggttggccgggagccatgcactcaggagggccgggcccatgcaccccacactgcgcccaaggcgtgcacaagcgattgttttaaaagcgggttcacaaggaaggatgtttgggaactgactgagacaacagggacgtctgctgcagggcttcccagagctctgatggcagcgtcggcctgagtccttcgaggagggctggtttgtacgtggcatttgctgcccactggactgtgaacttctgtctttttatttcccactgctgctgtggtacatctccagtagcatagtttggaaatgcaggttttgatagactcaaggatctaaatagaaccctcttagtaccaaggactgtccggggtctctgccagccccgccgatgggcctaactgtggtgcctcctttcctgtgagaatcttctgaggacatgcccggggaaagagctcagttctgctgctgcctagggtgccatgctggccccggttccaatgcagagcctggctggaagtaccgctgggttggcggaggctacgtgcctgactgtcccctcgggggtggggtggaactagccttctgaaaccgcctgcttcagttggccacagctttttgaaatgtgtgtttctggaagggactgggtcccttccttgcctgttcagctccccacgacaaatgtcctcaaggcgaggctggatgcttccttcctcaggctcctaggaggagcccgtcccccagctgtgtcgggcagctggtcaccagcaaggacaggatccctcagctgcagcctcaggctggctggcactgggcgggtgtttctgggatgagttgtgtgtactggagatgggaggggagctgagagggtgggatgcacagacaggagaggggactgtgggggtcctggaaccctgagttccaagtcttcaggactctccctccatagcaagttacagggaagcagatttgagccacagggaagcagatttgagctgcagcgagggggagggttttcagtctgtgctatagggaagtgggcagtcggcatttctggtcctgggaactcactgggcagggctgccttgggacatcagggaggtggcgctgtgctcagcttcaccaggaggggccttaggcctggggacggagagtgatgcctgaggcccctctacttctccatggatcctgggagggactcctgggctggatacaaaattgttgagagttaagagatctgtgaggaaggggaggctgggaatagaaagtgtgtgcccactgcacatggggtccgcagggccacgtgcagccactgcgcaggcacaaccccagtccccacagagcccaggaggggccagagccatggaggaggcagcactgggcatttggacagggagggggtggtcagcaggcagcaggcccaggcctgtctatgccctgcggggtgcagcctcctgatctccacggcaacctggagcacccagcgtcagaaccaccgggagggcttatggaacagatgtccagccctgcagaagttctggctcaggagggcggggtgggcctgggaatttgcatttctgactgtacagggcgattctgctgctgctgctgctgctggggttgggggaggatcccatttgagaagcgctgcagtcctaggttgaaacgtgcctgtctgtccccacccaggcctgcatgggcagcacgggatccccaggcaggaggacccaatttcatggcctggccagccagggtcctggagccaggcggtgggggagggatgggggattgctgtgccaccttccttcccggcttggcccgggggcaagcatcctcacacttcccatgtcgtcatccccttggctccagcctggctgcctctctaaccctgctgtaccggctggccgcatggccctggctctttttggtgagcgtggtccaggactggtgacctgtgagtcctgggcccgcagtcttgcgcccctgcccgaaccaacacaaatcttgttttctctctctctcttccttcctcactccctccccttctcacctttccttttctgtaaggtaagctgacttcctcttttggttttttatttatttttattttttagttctgtaattaaaatcctaacagccatggagggtgtgggcaccgggggctggggccaggcccctctgacctctgagggggaatgctgggtgaggcaggggccccgctgctgggaccaagtatcctcaggggcttgtgggcagaaaggcctgtgctggccccagtcagtgcacagaagcggccccaaggccagggctgctgggcagctcggaatgagggcgagcagggctgcccttggtgcctgagccaaggagccaatgggacagacctctgaggcctgggtgccaaggtatgaggtctgagagcagggtgagcgcctgggctgggacaaggccctctgagtgggcggccagctgcagcccacccacccctaccccaggaaggcagggcccgggagggcatgacctctggggtgctggctcagctgcccccaccccaacctgacacagctagtcctgagttcccatcagggaggaagcagcatcctgccttcctctaggaagagcttgcatgtggcccagaagccaagggggctccccagcacccacgggcatctctgggtctggtcagaggagaaatctggatgcttgcaggagccccagggtcatggaggaggctggagacagggctgtcctggggtgatgggatggcccccccacctgctcagagccagcctgggtgctggaaccacacttgcctcaggaccctgggcttgctcctggggaaagagtggggtcaggcaaaggggtggggttgcgctgcagcgagacccaggcccatcactcaccataccttcttcctccccatgcagcagccaagagtttactcaacaagaaagcagatggagtcaaggtgaggctccagccgggccctgtggtgccggggagcccagagcctgcagcttcacccccacgccctggggctcctgctctggagtccccctccccccatgccctgagagacacgggacagggaatggcgagtgaggggcttctcccacctaagagttcctcttccctctctccacagccccagacgaatagcaccaaaaacagtgcagccgccaccagccccaaagggacgcttcctcctgccgccctggtactgagctcctcaaattctgcctctcagcccctcctacgcccctggctgtgtgattgccgctggtcagagggggccgggtgaaggtggggtctggccccgcctggcctgtctgacagcactcgcatggcccccgcccctcatccctcaccggtggtgaagtggagagaagaggccactgttgtggggggctccaattcagacaggtttaggactgctctggggagcccctggctgagacccacagatgttggggtgcaggggagaggcccagcctcccacccatgttgacttgtggatgtctctccaggagtgttcaggaagtcagtgaggcagaagataccctctccccaccaggaccccaccctcagctcctccaccatcctcaacaggccgacccacagaccactccgaaggtctggcttggtggggctgggccaggatctgcagggggaacagcccatagtggcacattccacggcccatggggagacggggccacggtggtgcagtagagaggtgtctaagccagtggcagccaaggggagggcttgccgtcacctctgtgttccctcagtgctgctctgtggctgcctgagaggcagggcttaggggctccctgccggggaggggaggggtccccaccatgctccgctccaactgcgcccctcagtgccccttgccctgggggctcctacaggtgaaccctatagcagtactcccaaggatgtaaagttgtggctggtgggtgccggccttcctgctggggcgctgtgctgtgtcccctcagctgtcctaagagctttggggcttgctggcccgtaggtccccatatttgctggaagcaggcttggtgtcccctgagaaccccaggccaggcttcgggagccagccccagaccgcccacgggaatactgggtttgccaaatggccaccttgagacccaggagaggagagcggtcctgggaggggcgagctgctcagagcagccaggccgtggctggagggtggcctggtgcagcctacctagggccttccagtggccagggcagcccacgtgccagcctcacagccagccccatctcggaccctgtccatcccatgtgccaccgccacccccatgacatcttcaaacctgtgccccccaccacgctggggcacaggttcaggcagtaaagggtagggagaacccctcaagaccgagcctggcttctctggctcccacacacattgtgcagcttgtcggggccccacacggtccatctcccaccctggacagcagcacctccgccagcctggacagagctcctgtccattccatccctgccggctgacccaggctcctcccccagctgctccacgccgcctccatccctgtcccccactctgctctgcacttctttctcgcaggctctggccacccacacctcctctgtctccctgttcccctcctggtggtctccgcttcctcctcttctcactttccctctctttccttcctctgtgtcttccttcttctgtaggagcctcaaaccaccgtcatccataacccagtggacgggattaaggtactgccccactttcctcctcccgctttccccaggcaggaggctccaggccaggagagaggtctggggcagcatttgtgccagagtggagggcagatgtcccatgccctggccgcccctccccgcagtacggtagggccccagtccgtcttcgtgggcaacaacaggacagactggctcaggccccaggcgcgcccctggaggtgcttggcacagttgcgcccggtccccatgtggccgacactctcagaccagggctctgcgtgtcccacctacggcaggcagtagggcttcctgaggtctggagcagggcctgcatctcaggagctgcatccttggccctcctggctgtcctccaccccacctccctcacgtggcccccagtgcttcctgctgagcagaccctccctcctctgctcccctctctgctctggccatcagctcccatcacattggcatcatcactctggggccagggaaggggctggctctctggggtggtgggagggatggggccagcagccaagccatttccaggacttccaaaacagcgccactacacccaacacggccctccagcccagctcccacctaggcctgggctccttacagagccccagagtgcctctgtggggaccccccacttccttctggccagtgccaccacccagcccatcatcagaagacatctttctccatggcagggaccagggggtccaaggggcacccatggtgctaggcaccagggcctgggcattcttcccatctggcagctggggatgggtgcccctgggacccgtgtgtgtctggggtgggtcatgctctctgcaggactcctaaacaaccttctgggctgtggtgaactctgagcctgcacctaaagacctgtagttctggtctagggcctccaagcagtgtccaggcagtgtccagaccagggggcggtcccccagggaccttgtaagatgtttcctctgaggagcagagcaggcctcctggggacctgggggatggtcttttgaagggcagcagccctggagcagggtgggagagtctggggccacctctgccctctaaggccacctgagaggtgaggccggggcctgactggacgtccagtcccagaggggcaggtgccctgagggaatgtgggcgacaggaatgctctgcctggggccaggccaaggttcctggagccctgtgcggatctgcagagctcctgggaacgcctcaccctgtattttggatgacaccggctgctgcttcattggaaccagccagtcccattgtgttttacgtcttggaatttcaaaaagcccattttcctctcttgttaaagagtcagctgagcataccagtctctctgccaggctcatcttgctgggagaagtggagccctcatgtgttggggatgcagggtggccacagcactagggtggcagggccggcctcggactccgtgccagcctgtgctggctgccgtgagaatgcaccctggtgaggggcgccctcccagggaccagcacagaactgggtgtcttctccggtcactgccgcatgaggtccacagagctggggccctgcagccgccagagggcatgtcccctgagcccctggcctttaagccccgtggaagcagccgaggcagagatcagcttcagagcctgggctggtcctgacacaggcccagccctgtccacctgccctcagccacgtcccacctatccttggccgcatcctgacccgctgcctcccgtgtttcctcaggagtcttctgacagtgccaataccaccatagaggatgaagacgctaaaggtacctgcacttgagtccttgcccccccagcggccttggcattgctgggttgctctttgaggtgggtgggacttgggcagggtcaactctcctgcgacgcctagtttatgcatgtgttgaggggctcagggaccctgtagctgtaatcctgctccaagcctgggtgtcaggcctgcccagagcggagaagcatggcagagatgaccgacagctgggcagtctcggtcaccgcatccaagtgaggaagccacggctttgcatggaggcaggttctccacaccaggaccctcacggggaaacaggcccatgggtagaatttgttccaagatgctgtccttgtcttaaagctccttaagcttgcgtttctgtccagcatgcacttgccaagtggccgggcagctgggtgagtgtttccgtgtttgcctttgcttagccaggagtgtcctgctgcggtgggtttctgcaccacagattccagggccccctcccttgctcacccaggccaatgtcttgtgtgttccccaagaggcccccagggcaccaggcactggggcatgctccatggattctgccgcctccagaccacccacatggggcctcctgaccctcatcgctcacacggtcacctaataagccttatgctgttctcagggctaccctggtgcccaaaaagggtcagccactctgccagtttaggggagaaaacttctcacctgtccaaagcatagccttgctcctgcccggcctacccagctatgacactgtccctgagcagagatgagcacaggactttgggccctggatgccggagagtgggtgtttgtgtgattcccctgcagtctggaacaggccccaaaggcaacagcatgaaggctgtccagaggttctccatcaccctcagccgagtggggtgctgagcagtgagggaggggacctgggaggggggcccagcctggatcctgcaggggagaagagaagacagccagaagccagcagctgtggctcagatctgagcccgagcagcctctcgaggtggaggcagacaccccccaccccaccccgtgcagaaagaagccttgccagcctgccctgaggctggtacagagtccaggcaggctcagtggccatcatgcccctacgatgactgtcactccctctccgtgcgcctggcctctgctggctctggccaggggtggtcacagcactagggtggcagggtggcctctgactctgcgccagcctgcactggcctgtgctgccctggcctctgctggctctggctctggcaccggtcccgtgttggctccttcagccttcacatacctgctgcggccaccacaggcccaggacccccacaggtggccaccccacctccaccccaggagccccaggtatccagctgtcaccccctccctccctcctggcctccccctgtccttctccagttgccttcttttcctgcgggcgcaccacccacctgcctgcctcacctgttccgcctcagcccccagggtccccgacatcctgagctcagtgaggaggggctcgggagccccagaagccgaggggcccctgccctgcccatctccggctccctttagccccctgccagccccatgtaagtagcctgggtcctgctgctgtgggggtcatgttggagggctggcaaccccctagaggggccactccagagccgagggcaggctgagcgtggaccctggctccagcctcatcaccccacaatccctcactggggctttccagggtggccccagcccatcgagccccacctctttgtgaggagggccctggaccactttcctgctcaaggccactgggcaggatgggaggccctggaggctcgggcctcaattccagtcttcagggtcggtgcaggcctcactccacctcagcttgcgggcgggggggctccctgctattgaggcaggctctgattcagggcctgatcccagggcccaaggggtctagaacacgggacccctcccactggcctcctccgccttgccgccgcctcgtgtgtctgtctgcctcatgttcacgtctcatctgttccaccccagcccccaggatctctgacatcctgaactctgtgagaaggggttcaggaaccccagaagccgagggccccctctcagcggggcccccgccctgcctgtctccggctctcctaggccccctgtcctccccgtgtaagtagtggcccccaggcctgccgcctctgctgccggacagctccctgcgaatggccggcgctcagcagcttcccacctgcatgcacggcccagctaccctgccccggcgccgcagcctggagtcctgccctggcggggcttcctgtgggctcccatgctaaccagcagggcagctcctggcttctccctaaggggcccagacccctccacggctcctgctcccactgccactccccgctcgctgtccagccccaggcccctctccaaaatgtctgtcccagccctgggcagccctggcccctccgaggccccccatgcccctaggccctctctgctgatcactgtcccagccccacagacttcacacccacccaggggccctgcccatggtgcccaggagctgcactcagggccaccctggttcctgatgtggccccaacccctgagcaccctccctcagtctaggaggctgaggaaggtgccaaaactggaaccccgaccagggtctctggagctcaccaacaaggggatagtacggagaatcataagcctggcctctgctgacctgggctgtcctcatggggccaggccaggcctcctctgtaacgcccgtgactccctcctctccctgtaaccccgtccagcgttcctcaagggccacttacctgacagcttcttgctggccagcagcctctccctggagggtgccctctgcccccagcagcttcagcccacgccacccgacagccagagcatctgcccttcactcctgcagcctcctctccacgcaccacgctgtccgcagcagcaccctctgtccccctgtctccctccgtccccccatatccccctcggtcagcctacaacctctccacgtccccctaagtccacgctctatccctacatccccctctgtcccccaaattcccctctttccctcatttccattttcctccccaaactctgctctgcccctcacattctccctctgtcccccacaccctcctctgtcccccagactctccctctgtcccccacaccctcctctgtcccccatatacccctctgtcccccacacccaccttggtcccttcacgcccttttctgtcccccacaccccctctgttccctacactctccctctgtcctccagaccctcctctgtcccccacactccctctgtcccccacaccccctgtcccccacactctccctctgccccccagaccctcctctgtcccctacactccctctgtcccccatatccccctctgtcccccacaccctcctctgtcctccaccccctgccccccatacccccttctgtcccccacacttcctctgtcttccacaccccctcctgtcccccacaccccctctgtcccccagactctccctctgtcccccacactccgtctgtcccccacacctcctgtcttccacacccccttctgtcccccacaccccctctgtcccccatactctcctctgtcccccacctccccctctgttccccacaccgccttctgtcccccacaccccctctgtcttccacttcccctctgtcccccacatccccctctgtcccctgcaccctcctctgtcccctgcaccctcctctgtcccctgcacctctctctgtcccccacatccccctctgtcctccacactccctctgtcccccacatccaccttggtcccctcacgcacccccatcccccatgaccccttctgtcccccacaccccctctgtcttccacacccccctctgtcccccacacccaccttggtcccctcatgccccccatcccctacacccccactttgtccccccacatgcccctctgtcccccacgttcccttctgtctcccacgtctcctccatttcccgtttccctctctgtcccccaagctcccctccatcccccacatccccttctttcccctatatcccctctgtcggcccaggtccaccatcttccccccacacccccccattctcccttcctcccctctgtccccttgtgccccatcccccacatctgcctctgtgcccctcaatctctggcttggctgtctgcccatggtttctctcctgcgtgccccccgtgcctgccttgtgttcacgtctcgtctgttccgccccagcccccaggatctctgacatcctgaactctgtgaggaggggctcagggaccccagaagccgagggcccctcgccagtggggcccccgccctgcccatctccgactatccctggccccctgcccaccccatgtaagtagcaccttgagtggccgtggcagcggctgcccggaggggctcggggcgtgcgagcctggcagtggtgctctgggaagggccattcttgcggaggagggcggggcacaggatccctctgctgggtcccagggaattgctttgaagcacatgaaggtgccactgggtctcagaaaatggaggttatggttatgaagtgtgtatgacatatgtgtataggaagagcgtccgaaagagcaggtttgttgccgaccccagcattcgcaaccctgaggtccacagctttctcctgatgggaggggaatgggtggcaaagggtctgcgcgtgtggcaagggctagcacgccaggagctgctggcttgggtcaaggtggacctgctgggccgggacagaaaagtgtcagtcccggcctgagacgctctagcattagagctgtccaagtccagacagcagggagcaggtggggatcgggaggcgcggatctggggggcagctggggccaggctgaaacagagcgggcgggacaggaagcacaggctgggcagcctccccggccagggaggagccaggctgggccacctcccggtctgtctgccgactacccgcagtatcacttacagggatggatgacatcccagggctgctgccacccccacctgtggggagacaccagactgggggtggtgtggagatactcttagagaagaggctgctgggccacgggctcggcatggcagggcagtggctaggtaagtacttgagggacaggtggggtctgcttgccaccgtcccctctgcaggctgggcctgggggctgctgcaggcggccagggcagaagggtgtggggagagtgaacccacaggagcagcggctcgaggagggggatgcaggctgcaggctcaaaggggcactggatccaccctgggtgcccgagagagcagggggcagcccctggaggggtactcacccccagagcttctgtggtcggctgaggacccccagcaggggttgactgaggggatcagaggcaagcagctgaggggagaggccaggttcttgatgctgatagggtcggggtgcctgggcgaccagaactcaaggagggaggcatggggaggggccgccgtgcagctggggtgggtgcaccgcagagcctctgggagtggtcagaacccccgacacctgccacttctacagcagctcatctgattttaaggggcttgctgcccttgcagaagtggaggggtgtgcccaaaggagcctgcctggaaggtcaccccatcaggttggcatgaccccagcccaggactgcagcctgccctcaaggtctgtgcagtatctggggtgagtcctctgaggacagggcccagggtgggtgtggagtggccagctcggggctcggtgtccaggctcaccttcaggggccacagcacagacctgcccttccagagtcttccctgagcttggctggggaggagggggctgcaggaaggagctgtgagcagggcaggatggagattcgtgtggccctcctgggaggggctgggcagggctgggaaaggggtgggtgagatgttccggaactcagggaaaggaagagtctgggtactgccctgggggcacctgggcccaggtggcaggtggccagctttctgcctcctttccacctcctttctccagaaggcacccaccagctgtgtaaatagggcaggtgcccacggcccgcctcaggccccgtctcctccccacccacgctctctaatcgcggattatacacaatccagcctgatccctgggcagctgccctccctcccgcagccacctctggctctgagagatgggcttggggccagcctggggtcccaggagtccaggccaggatgagaacctgctctgaccccacctggacgcattaggcctgcctggacctgttgcctcaccccaagagagccacaggcaatgcaaaggctcctgttcatgtcagggcacctggaaggcctgacttgcagaggctcttggctcgtgcagacccctccaagcccaggccctgcccaccacctcccctttgtctctggaactgccaggacagcttgtcctcagccagcaggtttcccgacccgggcacctcttcatgttgggcccccctcctttccctccatcagggatcatgcccttcttcaggggcctggatatcaaggacacaaaagctcccatgtgctatgtggggaggcagagtgggggctgggttgagctggggtctgggcagcgccattccgcagggcaggggcagcctaggcttcccatctgtggaatgggtgggtgggtctcacaacggacctgcttcccgtacttcagcacggttaccactcttgattggaactctgaccatgcatctcctcttctgtttacttcacgctttctcttcccatcaactcccattttaattacaatttgtttaaaagcactgcatattacttcattaaacagaagattagtttcacttaccattagtgtaaggtgactatagaaccaaagcagactggaaaccaaatgacataatgtcattctcttctccattccagctgcctgctgctgtgcgcctgagaacccctgtggagtgggaggggcagctgtctctgtacattagaaagggaggttaactaagtgacaggaggtgtttgggacatgtggacaccagacttctctcttgatgcaaggagggcagagccaggcagcctagtgggggctggcttgggggctgctggaaggactggctacaggtggaagagaggtcagacctgaagcttggggccacctccaggaaaggacaggtgaaagtggaggcatgaggcaggggagaggcaggtgccaggcagagggtggagaggaggcaggaacatagcagctggggcgggggcgggcctcaagtgtcatatgctactttcctggggcccaggggcaaggacaggaacagccacagcatgtgttgggacagagccctgtgccttcctagagctgggcaggtggaatggggcaggaatgggactcgtggtggctgcagcaggaactggaggggaaggggcttctggatcctgcagcctaccttcctagaggccagctttccggggtccaccaggtgggtgggaactgggcttgtgtagcaagactgccctgaggaccatccatgacatggtctagatgaaagttaggaaagaaagggagacaagctggcagcagaagtacagctgggtcaggagcaagggcctttccagatagggacaacccaagagtgcacatgtgcccacgccacacaacacaggcacacacgacacgtgcacgctcataggcactgcacacacacatgcacaggtgctcatgcatatgtatgagcttcatctacacacattcacatgccgtcctgcttatgtgcatgtttccatacatgcacatgaatgcacaatcacgtgtacacacatgcatgtgatcacatacatgaacatgtgtgcaccccactcctcaggtgccatcgggctcctcctgctgtcactgtgcagcaggggacatgaggccccagagcagacaggtgcagcacaggcgttcccaggcagtgccccacacacatgcatgagcacacccgggcatgtggcgcctcctttgtggactcagtcacctgccaggtgggctccctggtggtgtgagctcccagaggtctggcgagagagataaaggcaaccccaccaccaggcgtgctgagaattccctcttctggctgggcacagtggctcatacctgtaatcccagcactttgggaggccgaggtgggcagatcacttgaggttaggagtttgagaccagcctggccaatatggtgaaacctcatctccactaaaaatatacacacacaaaaattagctgggtgtggtggtgtgcacctgtagttccagctactcgggaggctgaggcaggagaatcgcttgaacctgggagtcagagactgcagtgagccgagatcatgtcactgcactccagcccgggtgacagagtgagactccatctaaaaaaaaaaaagaattccctcctctgggaatttagaccacagacaggttgcatgtatgtggccgttggaggcagcactcacagcaaagagtggaaacgtcaccacagggcctgccttctggtgaaaatggtgtcctgcagggcgggcagctgtttgagggcaggtgtcccaggtgcggcctgcagcagcctgagggtcacagagcgcagtgctgggagtgcagagacttcccccacagggagagttcccaggaacctgcttccggtgcacttctgggggtttgagttttttccacggacgaattactttgagaaaccactgttactcgtgtgtataggtgagcgtgcgtgtgcatgtgtgttctgtgtgtgagtgtgcatgtatgtgcgtgcctgcgtatatatcctcgcagatacggctagggacctcactcaggacagtagttctgcctgaggagagtgaatgcggcaagattgaggagaacacaggcatcttcaaactacatgtgcggtgctttatttctttaaaaatgcgtctaaagcaaataggaaaatgttaagatttgaatccgtagagtgtgggttctattattctctccacatcttccatacgtttaaaatcttttgcaatgaaaataagctgtagttaaagcagcaatgcaggctgccagtgagcgccccggaggccagtgaggaccagcatggctgggtggcctgttggaatccaaggggggcgggcaggagctgcaggcaggcgcccgggagtagcccgggcatgggggtgcggggcaacagggatgtctgcaggggtagcatgtgggccccggactgcaagcaggtggagccagccggatgcggctcctatgagaaaagcggggaacaagagaccacgctcgttcttcctgctgcggggacagccctggtcatcgctccggggaaccctgcagcctgcgccgcacgtggccgccccctgctgcttcctcctccccggcctccgggtggccttgctgacggctccttctctgaggcaggtctctgccttctcgcctggtgcctgcactcagtagccccctcaccagagctgctgggtgaaggaagcactaagaacccaaggctcgggaggagagtggggccgggaagctgcagggaagcgcagggccaggcctggtgggcccaggggctggctcacgggagggcaggagggagactgtggcggacagcacgtggggccaggaggtgacctccaagtggattgtgggtgggttttttgtcctctttctgcattttccaggcattttgtaatgtggatagaatatttctgttcttcaaaaatactttagttaagaaaaataagatggaagctgttgcacttgaaaatgaggaagccactggtgatgcagggggggcggcggagaggacctcttctgcaaatagcggcaggaacacggcatggatgcagctcgcgctcccccaggccctcccctgggctgtgtggaggggtccggggggaatgggccagcgcccagtggtcacctggccatgtctccccacagcccggaagcaggagatcattaagaccacggagcagctcatcgaggccgtcaacaacggtgactttgaggcctacgcgtgagtccctggggctgggggggggctgtgcaggacaaggatgtgggacccttgggggggcctgctcagagtcaggggtccacggggcccctcctcacttggatttggcccccaggaaaatctgtgacccagggctgacctcgtttgagcctgaagcactgggcaacctggttgaagggatggacttccacagattctacttcgagaaccgtgagtgaggaagcccgggtgggcatgagggggcggtgcccccaggagagcctctcggcccctcccagggacagcatggtggctgcctatggaagccctgtcccctctgtgcccagggttggccagccacctctcccccgccagaggccatacccagcccccagaatcccactcttggaggggcccatgctgctcccaggagagccgagcctccccaataaggggagttgagagagggaaaggattaggctggtggggtggaagacgggcaccagggcagtcatggtaacccgagacccccgccccgcctgctgtccacagtgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaaggtgagtgttctgtgctaagtgacagctggggcagaggggtggcggtggtgtgagtggctgcagcctggggaggcgatggggagcggtggggcctgtgcagagccatgcctgggaagtccctgagctttcctggtgaggccacaggaatgatgtcaaattagggaccacggcaggctgggtgtggcaggcctccccagaggactggggagctggtgagggcctgagcagtccacactggccagagctgggtgggttgcaggtggatgggccccgggcagcacagtcctgggcaccatgccctgtttgtgaggactgttagagccccagatgggcgttccccaggtggtgggtgcagcgggcccagagcccagttttacagggatagtagtaattgggttgggcaccttgaacctctctcccgagtgggcccttttctggactttaaccctctctgcagtgccgcatggcagacagcagagcctgggggtggatgggagagggggctgctgaggagctgacccacccgccccatttcagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaactgc

SEQ ID NO: 375 - DNA, 90732 bp, Homo sapiens
cacactctttctccctccttctcctcgccccgccttccctccctcctcaatccctctagttccttccccgcctcgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtaacaccgtcctctaggctccacgcccgagcccgggggaggaggggagtgcccgtgtccgtgttggggtttgaggggtcgggagcggcgttggtggcgcgaggtgtgaggctgcccgccgacggaggggcggcgagaagcaaggagtgagaggggggagaggcgcagataggcccctctaggtattgactcggcccgggtggagcggaggtggtggttgtgaggagggggtgggtggtttagccccggcggcttggttggggggtgtttggcgtttggcggaggctgggagcgagtccgacgctctcagtgctcggccttccttcccccggcctcttgcacacgcccgcctggttttgcaccactacccttctcagggctgagggagtcgaggccgagttgtggccttcggcggtttcttcagcagcgcctcagctttccccgcctctcccaggtccgtggcacttgccgtggactggggcgaaggctactttgttcctttgagtcctgtggggtctgaggggacatgtgcatttttgagagagaaccattctttggtttacgaaaagggccctgtaccttccaccccctcagttttgggagaaacctgttttcttaattcgaggaagtggaaacctacaccttctagccctttgctccctcagaagtggggaagtctcctcgggagaatttaagaagcgggtttgccctacttctagttcacctttctggccttactgggtgggaatatgcctcctctagtagacgttctgatttggagggagcctctttctctttacacttatctctgagttacattcgctaatactccgtggcagcacacctgtcttcgctttccttggtccatcgaagagggttggagatcttttgtaagattatgtgtcaatttcatagttttaaaatttattcaagaagtataagaaggtttgcttatataattccccagtatgggatctgcaccccttcccaggtgaaatctgcccttgccctccataataccgtcacctaccgtttttccctccctctactccgatgtcttgttcattcagtagacttttatcgggtgcttgcttgggtaaagaagcccttttccaggctcctgtagggttatatagaagtgattttctctccagaggttgactttttaagttggggattgatttttttagctcaaaatcaaaactcagtatataattttttttataacttttacaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttgtaagtactattatggtgagcaaatcaaatgttcatttgtaaactgtaatcagagttgagtttatcctatgttattctcggaagcctttcagtttcttgcagtaacattgcttggtttcagtttccttgacagtctgaaaacaactattaaccattgtctgagtaaactgaaattcagaaaaaacgtttaaggcttaggaacttttcagattcaaacagtcctaagctacaagtttttgcgctttttaagtaaaaagctaaattcgtatggccggtatatattgccttaggctttgaagattcattcacagtggtagaaaggtaggaaaaaatgcaacaaataattcaccacgtgtcttcctagccagtttgtattctaaatgcgtgtgccttggtagccagttgactttgcaaatgtgagtttagactgcattccaaatgcagtttagtgttgcatttggagttacatagtttggttatattacaggtagtagttcttaatgtatttcatgaactagcttggtttaaggcatagttgttcctaacatattaatccgttatagaaattaagtttttgaaatagttttgttgaaatggttttgtatttcaaattatttctttactttcaaaaaaagagggtattaccaggaccagaagctcagaggaactgagcaagctgaattaagaacctttaaaataacttaagaaaatatgagtatacatttttttttccactcaagaggttatgctggcctaagtttgtaagcaaagcttttttttaaaaaaagttgtgaattaattgctataatagaaattgttttgacaggtgagagagttatcgtttaatgtttgtatttttcaggattaaacggtgtttttagttaccgttagttactacatttaatttttcggtgaatcataggcatttaatgttttttaaagagatacactaaaatttaatttttttttctctttgactaatgacaaaatttaatttttaggcagttaatattagtgaacacgagtataactaaaattagagggtatttcaattaattgtctttctgagacgaaagactaatttttatttgagaccgagtttcgctcttgttgcccaggatggagtacaatggcatgattttggctcactgcagcctccgcctcccgggttcaagcgattctcctgcttcagcctcccaagtagctgggattacaggtgcccgccaccacgctcggccaatttttgccttttttttttttttttttttttttttttttagtagagacctgggttttcaccttgttggtcaggctagcctcgaactcttgacctcaggtgatccttgcgccttggcttcccaaagtgctgggattataggcctgagcccacgcgcccggctgagattgcaatttttgaactctttaccaagatggcctaacatcataacttgtcagttgcttattttgaaccaattttttttttgcttaaactgttgaatcctgctagctcccatagagtgaaagtggtagtaaatgtaaaatagagttttttttctctgaaattgatattagagagttcagtgtttccctttgttataatagactaggttatatgtgttttctctgtcagacctgtgtgtagtaattctaattgagtgtctaccttgatttataaaatcggtgagaacattccacaccctttcacttgggagagcatgtattttgttcattcctcaattcaatgacttttcaagttgcttaacaatatgcatcttaaataagattaagttgaactggagtcaaacgatcattcttctagaaaactacataatatttattatttgtgattttttctttttttgagacggactcttgctctgtcgcgtgcccaggctagagtgcagtggcgcagtctcggctcactgcaacctccgcctcctgggttcaagcgattctgcctcagcctcgccagtagcttggattacaggtgcccgccaccacgcccagctaattttttgtatttttagtagggacagggttttaccgtgttggtcaggctggccttgaactcctgacctcagatgattcacctgcctccacttcccaaagtgctgggattacaggcctgagccactgcgtccagccttgttttcttctaaattgccattactgatattgttaatctaagcagtagtgttaggataaagattactccagagatcagagtttttagcaattaactttaatctgtgaatagtctataacatttgtcaactttgcgtacagcagttcttcaaggacagatttacttgaacgttttgacagatattttcagtattttatttttctggagattggaataaatagttgcatccgttggtaattggaactattgctggacgctgcttttccccagaagttaacaccacttttccttttatcttttctactctttatattttgcttttttgtccctttctaaactgtaggtctaaaaataataatcatagtggctaacatttatagatgatgatggtttttttgctgtgtaatttatgtggcatattttaattaattcttaatcccgtgaggaaagtactattatagtcactgtggtactgatgagaaaattaggatttaggggggctgagactgggagaaagttactttgttagaattgtaatcttgaccaaataaatgttcaagcagtctgactccagagcacatactcagcactatgccatacttacactgccttcttggggattttactttactaattcatttatttgaacattatctttgatatttttttcttttcatgtactgcttctctttggttgatgttgattacagactgctaatggagtttggaaataaactaagagatattactgttttgctatttgcagtaactatttgggtgatacctttggttagctaaaattgtgtgtgtgtgtgtgtttgagacagggtctcgctctctcacccagattggagtgtaatggcacgattgtagctcaggcaacctcgaactcctggggttaagggttcctcctgccttggcctctcaaagtgctgggattacaggcctaaaccacagtgcctggccttgtatttttctttcacccatagcctgtttccacaggcatggagctaaatgcatagctttgttttaccttgtcttttttttgttgtttttttgggtttttttgagacagagtttcgcagttgttgctgagggtggagtgcaatggcgtgatcttggctcactgcaacctctgcctccccggttcaagcgattctcctgccccttcagcctcttgagtagctgggattacccgcatgtgccaccaggcctggctaatattgtatttttagaagacgggatttcaccacgttggtcaggctgttctcaaactcctaacttcagatgtctgtccacctctgcctcccaatatgctgggattatgggtgagagccactgggcccggccccttgtctctgtttttgaattgaaatagttacatggatttttgtgcttgaagctgctgatatgttaaaattgaggaagggaggagtaatggggaaagaacaggaagagtgagcaggaaaaaaaaaactggggagagttacaagaaaggggtaattgaggaggacttctaatctgaaagtaaaataagcaagtgaggatagagtttaaaaccaggccagattatttaacttttttttctgagacggagttttgctgtcacccaggctggaaagcagtggcacaatctctgctcactgtgacatccgcatcccgggttcaagtgattcttatgcctcagcctcccaagtagctgaggttacaggtccccgctgccatgcccagctaattttttgtattttttgtagagatggggttttgtcatgttggccaggctggtctcgaactcctgacctcaggtcagatgatcacctgcctcagcctcccaaagtgctgggattataggcgtgagccactgcacctggtcagattatttaactttgtttaaccaaaccatcttttctgtttcttttttgataaaaatgtttatcaaatgtttaggtaacaacgtttagatctatcaatgtttaggtaacgtttagatccaggtaaggtactgatgtagaaaaagggtcatggctgagggtttggaagggaacttggtttaggatatggaatatctagaaaaatgcctgtgtgactgtatgttcacctaactttttttggccttagtttcttcattatactgatggaaatatatatggagggtttttgtaaattgtgaagtgtaatacagatgtaaagatttttttggggttttttgttttgagacagagtctcgctctgtcactcatgctggagtgcaatggcacaatctcagttcattgcaacctccgcctcccaggtccaagcgattttcctgcctcagcctctcaagtagctgggattacaggtgcccaccaccacgcccagctaatttttgaatttttagtagagatggggtttccccatgttggtcaggctggtctccaactcctgatctcaggtgatccacccacctcaacaaatttaaatatggctttaaaatatagtttgaaaactgaattaagaattaaagggggccaggtgcagtggctcatgcctgtaatcccaacagtttgggaggccaaggcaggaggaacacttgagattaggagttcgagactagcctgagaaacataacaagactgtctctctacaaaacataaaaaaaattagctgagcatggtgacatgcgcctgtagtcctagctacttggaaggctgaggcaggaggactgcttgagcctaggaagtcgagatggcagtgagcggtgattgcaccactgcactccagcctgggttgcagagtgacaccctgcctcaaaaatgaataagaattaaagagatgaggccggatgcctcggtatttttggcgctgcgatcgcgacactgcactccagcttggggtgacaagactgtgtcaaaaaaaaaaaaaagaacctctgacatacaaaatactatttaaaaaaggggtgagggggcagggcatggtggcttatgcctattatcctaatactttgggagcctgaggcacgaggctcactggagcccaggagtttgaaaccagcctagggaacatttaaaaaaaaggtgggggggcggtgcgggggcagggaatacatctcttttcaaactcctgacctcaggtgttctacccacctcggcctcccaaagtgctggaattacaggtgtgagccaccatgccaggccgagacagtggtttctgagaattctttgaaattgataattttgtgggcatttcagtgcatttttctggaaaggtccattaccttcaacagaaatgttgaaaaacaaaatgttagtggttactggtaaactgttttgtggttgtgactgtttttcagtttttacctgcttgcttttcccattttgtcagctgtcccacccatcacaatagttaacagatttgctgtataaccctgcagataattgctagtttctgcatctttttatatacaagatatgtcatttagtttcttggtctttagttattattttgttcacagcttggtgggtgcagtgcttttggtctttccattttcttccctttaattattttataaattttttgagacggagtctccctcttgcccaggctggagtgcagtggcatgatcttggctcactgcaacctccacctcccaggctcaagtgctgcttctgcctcagcctccctagtagctgagattacaggcacctgccatcaggcctggctaagttttgtatttttagtagagatggggtttcaccatgttgaccaggctggtcttgaactcctgacctgaagtgatctgcccacctcagcctcccaaagtgctgggattatagccatgagcttctgtgcctggcctttttttgagatggagtctcactctgtcgcccaggctggggtgcagtggtgcgatctcggttcactgcaacctccaactcccgggttcaagtgattctcctgcctcagcctcccgagtagctgggattataggcgcctggcaccatacttagctaatttttgtatttttagtagagatgaggtttcaccatgttggccaggctggtcttgaactcctgacctcgtgatccacctgcctcagcctcccaaagtgctgggattacaggcgtgagccaccgcactcggcttcttctctttaattcttatttatttatttttgagacaaagtgtcactctgccacccaggctggagtgcagtggtgcagtcacggctcactgccatctcgacctcctaggctcaagcagtcctcctgcctcagcctcccaagtagctgggactataggcgcatgtcaccatgctcggctaattttttttattttgtagagagagagtcttgttatgtttcccaggctagtctcgaactcctaatctcaagtgttcctcctgccttggcctcccaaactgttgggattacaggcatgagccactgcgtctggccccctttaattcttaattcagttttcaaattatattttaaagccatatttcaatttttttcctacacttttcatgcaagaataagtttttaaaactcttagttgccaggcatggtggctcatgcctgtaatcccagcactttgggaggctgaagcgggtggatcacctgaggtcaggagttcaagaccagcctgaccaacatggcgaaaccccgtctctaataaaaatacaaaaaattagctgggcgtggtggcacatgcctgtaatcccagctacttgagaggctgaggcaggagagtcgcttgaacccaggaggcagaggttgcagtgagccgagatcatgccattgcactccagcctgggtgacaagagtaaaaactctgtctctaaataaataaaaacatacatacatacaaacatatgtacaactcttaagttatcctttctccgaaactgagaatctgggcttggcttgtggctcacgcctgtaatccagcacaggaaatttagaaattagcccaggtcagtagtgcgccttgtagtcccagctacttgggaggctgaggtgggagggtcacttgagtcctggaatttaagatgtcagtgagctatgattgtatcactgcactgtagcctatgcaccaaacaagaaccgcccccccatctcaaaaaaagaattacgatgaaagtgtagtataagggaaatactagtctatgtttttgtattaaaattaacatttcaagagttgatagctaatattttttaatacgggggggatatgaattttttttttttttttttgttttggagacagggtctcactctatcacccaggctggagggcagtggtgccatcacagtttgctgcagcctcgacctcccagacacaggtgatcctttctttcacatcagccttctaagtagctgggaccacaggtgagtgctgccatgtccagcgaattttttattttttgtagagatgggcttctgccatgtctcagaattttggtaggctgaggctggtggatcgcttgaacccaggaatttgagaccagcctggccaacatggtgaaaccctgtctttactaaaaatacaaaaattagccgggcgtggtggtgcatacctgtaatcccagctacttgggaggctgaggcaggagaatcacttgaacctgggagatggaggttgcagtgagccgagatcgtgccactgcagtccaacctgggtgacagattgagacactgtctcaaagggaaaaaaaattaggtttattggggtgtaatgtacataactttgttagtctgtttttgtgttgctttgaagaaacacctgagactggataatttatagagaaaaatggttttattggctcttggttcagcaggctgtgtaggaatcttggtagtggcatctgcttggcttctggtgaggcctcagggagcttacaataatggcataactggagcaggcatgtcacatggcaagagggagcaagagtgaggtgaggggggaggtgccacacactctttaaacagctctctggtgaactatcagcaagaactcatcaccaaggggttggtgctaagcccttcaggagggatccgcttgcacagttcaacacctggcactaggtgccgccttcaacattggggatcacattggatatctcatgggacagacatccaaactgcatcaatgacaagaaaattctttaaagtgtatacagttgtgtaactgcagaatcagaatatagaatattttcatcaccccaaaaagttaccttgtgtcctcacccatcatcgtcagtccctgtaaagtcccagtctgtttagtatcgatgtcctttcctattgggtattttccggaatgtcaaaggaattatacagtggattagcctttcatgcatgttgtttcatgtattatagttgatgtttttatttcattttatttattaactccctgtggggacatcttagttgatttttattattgctaaatagtattctcttgtgtggttataccacaatttgtttatcagttctctcgttcagagacattttgtttgtttccagtttttgactgttgcaaataaagtgaataggaacacttgtgcataggacttggtgtggacttaagttttcatttctcatatgaaaatccctagcagaactgcccgggtcatgtgaattgtgtgccttcccaccagcaatgggtgttagttgttatcaccagccctctttaaaatttgtttttggcaaccatctttggttaggtctttttttttttttttttttaaagacagagttttgctgttgttgcccaggctggggtgcaatggggcaatctcggctcactgcaacctccgcctaccgggtttaagtgattctcctgtctcagcgtctgagtagctgggattacaggcacatgccacaatgcccggctaatttttgaatttttgtatttttagtagaaacggggtttcatcatattggtcaggttggtctggaactcctgacctcagatgatccacccccttcagcctcctgcagtgctgggattacaggcgtgagccactacgcctggctagttatgtcttttaaattttaacccttgtgtatagttggaattagcattatgtctttaatttgcatttccctaataatgatagcatctttccgtgtgttttggtgaagtgtctgttcaaatattttgcctgtttaaaaaaaaaactggggcctgagcacggtgcctcatgtctgtaatgccagcactttgggaggccgaggtgggcagatcgcttgagcccaggagttcgagaccagcctgggcaacatgatgaaaacctgtctttacaaaaagtataaaagtaagcctggcacagtggcgtgccccctgcagtcccacctactgcagaggcttgagcccaggaggtagaggttgcagcctggacgatgagagtgaaccttgtcttaaaaaaaaaaaggcaaaaaaattgggttgtcttaacgaattgtgagaattcttcatgtattttggatacatgttttgcaaataatttctctcagactgtggtttgttttcattttcttgatacagtgtcttttgaagagcaaaaattttaagtactgaaataaaatgcctggtggctcatgcctttaatctcagtactttaggaggctgaggctggagaatccttttacgctggaagttcaagaccagcctgggcaacatactaagacgcctattctccaaaaaatttaaattaagtgggcatggtggcatacctcagctacttgagagaccaaggtggcaggtttgcttgaacccaggagttcaaggctgtagtgagctatgattgtggcactgcactctggtctgggtgacagagcgggaccttgcctctttaaaaaaaaaaaaaaatttttttttctttcatggtttgtgcttttgtgtcctaagaaatcattgcctaacccaaggtcatagagttttctcctgtcttgtagaagttgtgtaatttcgttcttatcttttaggtctttgattcattttgaattttttgcatgtggtgcgataaaaagatgttcactttttggggggtggggtacacagggtctcactctgtcacccaggctggagtgcagtggcgtaattaacaggtctctgcagctttgacttcttgggctggaatgatcctcctaatccttttgagtagttgagactacaggtatgtgccaccacacctggctgatttttaaatttttttgtgtggaaacagagtctcactgtgttgcccagagtggtctcaaattactggactcatgggatcctcctgcgttggcctcccaaagtattgggattacaggcgagagccgctgtgaccacccctatttttttttttccatgtaaatgtccagttgtgcaagtttcatttgttgaaaagattgtttcccattgaatcaccttgaaatttctgtgatgaaaatcaaattatgtgtgtctatttctggactcagagaagtgtgtgtgtgtgtgtgtgtgtgtgtgtgtgtgtgtatgtatgtttgtatgtattatgctaattctatggaatgctagtccataaataaaatagtatttgatttttttttctgctttaacattggatgtcttacattttctaaaatattttataggaaatttggagcaacagggaaattgtttttgtgggtgtgtgaagtaagacctgttgcaaaataacgtcatcttgaattcgtatgtcaatcttcttttaagtggcttgaaatgttagatatctaattcatacttgagcatacttagaaaatgacaacatttctatactggaaatgagaaagtaggatgtaaaagtatcaacttatttactatgatatattatctcaacagtggatttgggactcttctctcttgagtgctaattatgtgctagagatttcctttgcctcaggaaatgtttgagtgcctatggtatcgttggtgctggggattttctagtgaacaaggcaaaaatgtaagattcctctgtccgtgaagtttgctgtgaagttctatgaatacagaataaaaagagtccttgaatttgaattatggtttcatgccatctgttacattatataatagctatgtgatattggccaacatagtctttatgacttaattcttgctctataaaatagtgcctcacagagttgttgttattaaagtcaagtgaaataatgaatgctaaatgctttgaaattgtaaaataatacagacagtggtgttgtggctggtcacaggtgatagtggttgaagaccatatcatatgatcaaccaggagggagagattatgaattggaggacataggtaagtataaattgaagggacagaagaagcagaaaccagatatatatatatatatgtataatgtatttgtgtatatataatatatatgtatatatgacatttaaaattatcgaggctgggcttggtggctcatgcctgtaatctcagcactttgggaggctgaggtgggtggatcacttgaggtcaggagtttgagaccagcctggtcaacatagtgaaaccccatctctaccaaaaaatacaaaaattaactgggcatgattgtgcacgcctgtagtcccagctacacaggaggctaaggcaagagaatcgcttgatctcaggaagtggaagttgcagtgagctgagatcgcaccactgcactctaggctgggcgacagaatgagagactgtctcaaaaaaaaaaaaatggttgaagcacatgcattccactcttgggataatacttgtgtaatttgtggtatgataccatagctttaaaaggtatatttatgcaaatgatctcaagtttaaatttccagttcagatcttctctccatattccaggcttatagcttaactgccgtcttgacttctctacctgtaaaatttaacgttcagtgctacactcaggctggacatggaggctcacgcctgtaatcccagcattttggaaagctgaggcaggtggattgctcgggagtttgcgaccagcctgggcagcatggtgaaatcctgtctctacttaaaaaaaaaaaatgcagaaattagctgggcatggtattgggtgcctgtaatcccagctactcgggaggctgaggcatgagaattgcttaaacacgtcaggcagaggttgtagtgagccgagatcgtggcactgcactccagcctgggcgacagagcgagacattgtctcaaaaaaaataaaaggcaagctacagtcttacttcctagccccatactctctctattctttctcatctcagtatggctccaccagctacctatttattcaggctaaaacacgtgggaatcatctttggctttcttctttccccccatctaatccattagcaaattatgtgttctaccttcaaaatctcctaaatgtattcattaatatcccactgctactagacttgtacaagcctctttctgtctgtctgtctgtctgtctttctttgcgacgaagtttcactcttgttgcctaggctggagtatagtggtgtgatcttggctcactgcaacctctgcctcccaagtagctgggattacaggcatgcaccaccatacccggctaattttttttttggaagacagtctcgctctgtcccccaggctggaatgtattgccactatctcagttcactgcaacttccactttccagttcaggtcattctcatgcctcagtctactgagtagctgggattacaggtgcctgccaccgtgcccagctaatttttgtatttttagtagagacggggctttgtcatgttggccaggctggtcttgacctcctgacttcaggtgatctgcccacctaggcctcccaaagtgttgggattataggcgtgagccaccatgcccagcccagctaattttgtatttttagtagagacagggttttactatgttggacaggcaggtctcgaactcctggcctgtggtgatccacccaccttggcctcccaaagtgctgggattacaggcctgagccactgcgctcagcccactttttttcacttgaactactgtggtagccttttaactttattcctgtaccattgtgtactctatttcattattcacagagcagtgatcctttaaaaatgatattcgattgtgtcattattgtgcttaaaaccctttaatgtctttccattggatctaaaaatagcatgcatactctatagcctgcaaggatctgcattgtttatttgttccctctccttgtctggaaccttgcttactgtcttactggcccattggccttctttctcttacctgaacacgagacatttttctttatatttgttccctcttctctgttcttcccttgtcagctcaattttagctcaaacctaactttctctgagattctctaaccattttgtgtaaagtgggccactctattcaatactttgatttctcttattattctatattatttcacttaaagcacagcttataattatcttgtttaccctgtgcccgtctttatcacataagctctttgagagcagggaccttgtctcatttgtttactgttgtagtctcagtgcacttatttgcacagtaaaagaactattaacatctataaataatttagccttacttttttttaggggggggattgggtgtatatggttgtttttattatagagctatttttaactgcttggggactaggtggaatttgttattggattataggagggttgatttgttgtcatgtcatttagaagctgttttatcagctgggcgtggtggctcatacctgtaatcccagcactttgggaggccgaggcaggtggatcacctgaggtcaggagttcaagaccagcctggccaacacggtgaaaccccatctctactaaaagtataaaaattagccgagcgtgttggcacgcacctgtaatctcaattactgggaggctgaggcgggagaaccacttgaacccaggaggtggaggttgcagtgagctgagatcacgccactgcactccagcctgggtgacagagcaagactccatctcagttaaaaaaaaaaaaagaaaaaagctattttatgtgtctagaattaaataaattgttatatgagctttttgtctgctagattcaagactggctttggatttgctgttagcttttttttttttttttttttttttttttcctgagacaaggtcttgctctgtcacccaggctagagtgtgctccattatcacagctcactgcagccttgacctcctgggctcaagcaatcttccggcctcagccttctgagtagctgggactacaggtacataccaccatgtctggctaatttttgtattttttggtagagacggggttttgccatgttgcctagaactctaggcaaaacatgttgccttgaactctaggtaaaacatgttgtcttgaactctaggcaaaacatattgtcttgaactctggggttcaagtgatctgcccgccttggcctccccaagtgctggggttacaggtgtgagccattgtgcctggctcctcttagctgtttttttcttttcttttttttttaaggcattctccgtcacccaggctggagtgcagtggcacaaccttggcttactgcaacctctgcctccttggttcaagtgattcttgtgcctcagctcccaagtagctggaattaacaggcgcttgccatcatgaccagctaattcagctaatttttgtatttttagtagaggcaggtttcgccatgttggccaggctggtcttgaactccggaccttaagtgatccatctgcttctgctgtccaaagtgcttgaattacaggtgtgagccgccgtgcctggccttgctcttagctttttgaagggactgcctcatctcataaagatttgtttactgtgacccttgcctttaaaaatttccccaattttgaactgttgagtcagaagccttgaaacctaggtaatttttgctctcaggttcaaagaaacaaaatacatttatctttaggttttttttttttttgtttgtttgagaccgagtgtcactctatcaccaggctggagtgcagtggtgcgatctcagctcactgcaacctccgcctcctgggttcaagtgattctcctgcctcagcctcccgagtagctgggactacagatgcgcatcaccacacccagctaatttttgtatttttagtagagacgaggtttcactgtgttggccaggatggtctcaatctcttgacctcatgatccgcccacctctgcctcccaaagtgctgggattacaggcgtgagccaccacgccggcctgtctaggttttaaggagtggctttgaaatatatgagcagaatttaagacttatcatttttcagagatgagaccatgatagttcatttgtagtgtgtctttgaggaggatactaatgcagataaatatccacagagctttaattatttttggtgttacaaagtttatctgtgtgatcttgttttccttctatgtaagaaaaacatgttatatagatcccttgcaaggacgttatttactgaagctcttagaaggatgctaaacttgaggctgtttcaggtgagtatcctcaggagagtgttgaaattgtttctggaacactggctaggttgaaaactacttgaaaaatgcacttacctgagctgggtgccttaatttttttcttttaacttgactggtagtttcacatttctattaagtacttcctgttaagtacttctgagtacttaatttgctgagaggacagtagtctgtttggggatagcgctagattgcagtggtagctcaaattgctcatcttttacctgtctaggtgattgagacctgtattttgtactttttgacacagcagtagtgtaagacagtgcctgagtaaaacttaaaatttaggagttggctgggcacggtggctcacgcctgtaatcccagcactttgggaggctgaggtaggtggatcacctgaggtcaggagttcgagaccagcctgaccaacatggagaaactccgtctctactaaaaatacaaaattagcctggcgtgatggtgaatggctgtaatcccagctactcaggaggctgaggcaggagaatcgcttgaacctgggaggcggaggttgcggtgagctgcgatcacgccattgcactccggtctgggcaacgagagcggaactccgtctcaaaaaaaaaaaaaaaaaaaaattaggagttacttacatgtctattacgaaggctaatgttttgtgttagataagatctctgtctgatgtatcctatgttacttacagtatgtatatgtatccagagcagttaagagtttcagctactatttgaccttgggaactttaaaatggacttcacgtttatataaacacttatttttcttgttttgaaaagaaggtaacatcaacctcctggagatgggatgaggactaaatgagatgaatgttaaagaaactgttggccgggcacggtgactcatgtctgtaatcccagcactttgggacgccaaggcgagtggatcacctaaggtcaggagttgaagaccagcctggccaacatggtgaaaccctgtctcgactaaaaatacaaaaattagctgggcatggtggtgggtgcctgtaatcccagatactcaggaggctgaggcaggagaattgcttgaactgggaggccgaggttgcagtgagccgagatcgagcccttgtgctctcgcctgggtgacaagagtgaaactccatctcaaaaagaaactgcctaggccgagtgccgtggcttactcctgtaatccagcactttgggaagtcgaggtaggagatcacttgagttcaggaatttgagaccagcttgggcaacatgatgaaaccccatctccacaaaaaaatacaaaaacgacctgggcatggtgacttgcgcctgtagtcccacctgcttgcggggctgaggtgggaagatcgcttgagcccaggaggtggaggttgcagtgagccaagatcatgccactgcactcaagcttgggcaatagaatgagaccctgtctcaaaaaaaaaaaaaaaaaaaaaaactatgaaaagtattctgtctttgttagtgctatctggttcgtaggattaggcgtgtttaaaaaattaaattgttggaacttgtttcctgtgcttgggatgattggtctttagcctaactcagtttcagaaaaaaaatggattaagagtttaaggatttgaaaaaaacaaaacagtttattcaggaaacagtaaaattgagtcagactaaaaaagatttaaaattgttttgaatttatgcacacaaattacaaaaggtgtaccacaagaggtttagaggaaagtcacccctttaatcctgtttcttagcagttcccctctgcggaaaccactgttagtttcttatgtattttagagatgtatataaaaccacattcttttgctttctaatacaagtagtagcatcatgtctaccctgctctacagtctttttttacttaatgaacttagaacattattccatattagtatgtgtaaagttacctcattctttttattggctgcatgctagtataactagacctctattgatgtatattagcctgtttcttgtttttgtttcttttttgctattatgagtagcgctagtgaatagttctcgtaaatataaggcaaattcctgtaagtgaatttctgagtgtaatttgagataatgcccagttgttctccatagaggtgtaccaatgtatatttctagtgctaatgaggtgtatcagacctttttgtttggcatttttgccttgtgtaaaaaatatatatatatttctacttatggatgaataatagttacacatatttaaggagcacatattttgataaaagcatacagtgtgtaatgatcaaatcagggtagtgggaatatcacttcaagcattcataattttctatattaggaacattccaactccattttagttatcttgaaatatataattattgttaactgtagttgccctgttgtgctaccaaatactagatcttattccttctatttttgtaccaactaacctcccgctctttatctccccaaccttcccactccccagcctctagtaaccattattctcctctacctgtgagttgattttgacctcccacataagagaatgtggcagtatttgtttttctgtgcctgggttatttcatttaacatactgtcctctggttccatccttgttgttgcaaacgacaggattttgttcttttttatgactgaataatattccatagccatatacataccatgttttctgtatccattcattcgttgattggcagtaaggttgattccatatcttggctgttgtgaatattactgcagtaaacataggaatacagatatcttttccatatactgatttcctttgttttggatatatacccagcagtgggcttgctggatcatatggcagctctgattttaggtttttaaggatgggttttttttttgcaatgagaataaaaattttccatgtataagatcagtgtctttgaactttgtttatatcctttgcccatttttctattgagttcttttttctttttgagacagggtttattgcccaggctagagtgcagtggcatgatcacagctcactgcagctttgatctcccgggctcaagtggtcctcccatgtcagcctcttcagtagctgggactagaggcacatgacatcatgcctggctaatttcttgtatattttgtggagatggagtcttcctattttgcccaggctggtctccaggtcctgggcataaatggtctttctgccttgacttcccaaagtgtaccacgtctggcctagaaattttattcttaacattttgtttaattaattactttctaattctaggaagttgattagcctgggacatgcaaattataaagcctattttgttgtagttagcgaagttgtagttttaaaactgaattctgtaccataatgtagatgaaaaaagactggagtaagatgtatttgcttgtatttgaagccattaggagctagctgtgatgacttaggcacaacctctttaagcccgaaggttttttatttgcgaaatgaatattaaaatacgtttttcggctgggcgcagtggctcgtgagcgcctgtaatcccaacactttgggaggctgaggcaggcggatcacctgaggtcaggagttcatgaccctcctggccaatgtgatgaaaccccgtctctactaaaaatacaaaaattacctgggcgtggtggcatgcgcctgtagtcccagctactctggaggctgaggcagaagaatcacctgaactagagaggcggagattgtagtgagctgagatcgtgacagagtgaaactccatctcaaaaaaaaaaaaaaaaaaaaaaaaaattttttttttttgtttgcaagggttgagatatgtaaaagtcaatatgatatctgcacataggctctcagtatttccttttccatatgatggttacttcttgtcagtgttttctatctctgcctacctactttcagtttttaaagtcgagatttattgttttattttcttaatattttgtagagccaaggactctctttttggccaggctggtctcgaagtcctggcctcaagtgatcctcctgtcttaacttccccagaagtgctgagattacaggtataagccaccatgcctggcctcagagtcaagacttctttcgactgttctttactgatgtggagtttcaacaccaagtaaccagttatggaattaatttgttatcaaattgatagtagagaaatttaatctggtggatttcacatttggtaatttcaggataagcattaccttagtgcacctttgttttccacctgttttgtgttgtgtagcatcagatgctataaatggcaaataaccactgaacaaatttgctttcatggtgctaaaaggaccaggatttaaataaaattgtcatcatctatttatttatttatttatttttggagacaaggtctcgctctgtcttccaggctggagtgataaagtggaacaatcagggctcactgcaacctcgacttgctgggctcaagccattgtcctgcctcagccccccaagtagctgggaccacaggtgtgtgccaccatgcctggctaattgttttgaattttattttattatcattattattatttttgagatggagtcttgctgtgttgcccaggctggagttcagtggcacgatcttggctcactgtaacctctgcctcctgggttcatgcgattctcccgcctcagctttccaagtagccgggattacaggagtacaccaccatacctggctaatttttttatttttagtagagatgggatttcaccatgttggccaggctggtcttgaactcctggcctcaagtgattcgcctgcctcagcctcccacagtgctgggatataggcgtgagccaccacgcccgacctgttttgaattttagtagagacagcgtttcactatgttgcccaggctgatcttaaattcctgacctcaagtgatcctcctgcctggccatcacatctagcccatttttttttaaaaaagtaatttatatagtagtttacagttacaaggctttcctacacattgtcctcctccatttgaggagaagaatcattatagaatctttatttccatgctcagagcaggaactctcctcaagcagtccctaggcttcccaaaattgtaaaagaatatcattttgctttttttttttttttttggacagtctcgctccgtcgctcatgctggagtgtgcattggtgcgatcttagctcactgcaacctccgcctcctggttcaagcagttctcctgcctcagcctcccaagtagctgggattacaggtgcctgccaccatgcccagctaagtttttgtatttttagtagagatggggttttgccatgttggccaggctggtctagaactcctgacctcaggtgatccacccacgtcagcctctcaaagtgctgggattacaggcgggagccattgcgcctggcctgcttcaattttttttgcttgatgtcatgtttttcttcatttgccaggcaggtgttgttttctttctagaagttgttctttgtccttggttctgaaaaattcatttatcttgctagttatttcttaaattctttgtttcctttttattcatagtttttttttaatgatctctttcatttgctactttgcttaaaatgtttgatgattattagttcatatttaagaatgaggcaataaaaagttgtttgagagttaggtgtatgtgagcagtgcttattgaacggctgtcaatgttctaggaccctgaaaagccaaatatcttttggtgccagaacccatattagctccttatttgtgtttgagagaatctacctttcctttttgtttcggtgtcgttgttatgtttatgtgtttgcttatattcatgtagacaactgtgcattcaaatttttcagttacttcttttcaatctcatttcccactctgccctcctttgtatctgcagttttgcagtcctaaatcatttcagcattctagggagcagatcagcttcccactgtattctaccttccacatgtattctaggccttggctttcgttgtctagtttcatcagttattatgctttcatttatgtcattccaaaaatttcatgaagtggctcatggccttttcattatcacagttttattcctttattattctttaactcctttgttttgcttttttaataggatctttgaagtcaggatgccatcatgaacttgaaatcctgttgtatttgtaatgggtactaatgaaccgaataaacaagttcagtatcttgtgtaaatcgagtatttttatatttctattatggtagtggttatcatagttttcttagttttctatagttctttataaatatttattaggccgggcgcagtcacacctgtaatctcagcattttgggaggctgagactggcggattgcttgaggtcaagagttcgagacgagcctggccaacatggtacaaccttgtctctattaaaaatacaaacattagccgagcatggtggcgcgtgcctgtaatccagctactcgggaggctgaggtgggagaattgcttgaacctcggtggcagaggttgtagcctgggtgacagtgagactgtctcaaatatttattagtaattatttaactctttttggtacttcagtgtcatttgcttcacattttgtttttttccagttatgaatatattgtttgcctttgcagttgcaataattttatgcttaaaagtattttgtttctttaggtaataggcatctgttaaacaggaaaaatcttactatatctcatgatgataaagtaggatttaatatgaattaatcatgatttggactccaataaatatttctcaaacaaaatcgaagtacatttacaatggcggggtacacttagtacagttcttttctgtgttctttcagaatactactatatcaattccacaatatttatgttcttttaacatacaaaatagttgtacgtaatcatactcctgtgaagtaaaactagcgatattcttgttttgtagatataacaaaagttagctgtgtcatagtggttatttagtttctgactattttttatagtttttgactcacagttttatattattagtgttagaactgggactagacattgggatatatgaacattagggatgggcggaacctgatgagactgaggaggagcagccatagggatacaggggaaaccagtaatgtggtgtattgggttagccctggaaaggaaattggatgaaggagataagaattgaaaggtgacacttctccttcctttaacacattgctaccagatttcttttcttttctttttatatatatatatatctttattatactttaagttctagggtacatgtgcacaacgtgcaggtttgttacatatgtatacatgtgccacgttggtgtgctgcacccattaactcgtcatttacattaggtatatctcctaatgctgtccctccccctgagatttattttctgaaagcatacttccagatatgtaatcgtcactttaaaacttctaaatacttcccttgcctgctggattaacttctgatttctcatactgctgtgtgctgttcaagaacccctactgtccccatactactagaatttaggtatacctggaatatattaagtggtgtttggttgactagacctagtggtttcagatgtatttttaacagtggtttttttttttcttttggaactcttgacttcaagtgatctacctgccgcaaagtgctgggattacaggcgtgagccactgcgcctggcccttacttgaaaatcttttttttttttttttttttttttttttctgaaacaagtcttgctctgtctgtggcccattcttaaagtgactttgttgcctcacctcaccttgcctcacccgtccccgccccgcccctcccctcccctgcttccttccctttccttcctctctttccttttctttctttcgttttagaattatgctgctggccaaggcatggatgcaggcagggagaaacggtgataaattccatgttctttctatgttagtgcttgagaaggtaatttcattttctgtttaattaaaacaaaacataaagcattgtagtttttgtgtcttgagtaaataagtttgaatttttttttttttttttttttttttgagatggagtatcatactgtctcccagcctggagtgcagtagcacgatctcggctcactgccacctctgcctcctgggttcaagtgattcttctgcctcagcctccctagtagctgggattacaggcatgcgccaccatggctggctaattttttgtatctttagtagagtcagggtttcaccaagttggccaggctggcctcgacctcctgaccttgtgattctcccgcctcggcctcccaaaatgctgagattacaggtgtcagccactgcgcctggcctgaaaattttaaataacaaaacttacttttgtatcttaagggatacactccgttgcccaggctggagtgcagtggcatgatctccgctcactgcaagcttcgcctcccgggttcacgccattctcctgcctcaggctaacaagtagctgggactacaggcgctagccaccacgcgcggctagtttatatttttagtagagatggggtatcaccgtgttagccaggatggtcttgatttgctgacctcgtgattcgcccacctcggcctcccagagtgctgggattacaggtgcaagccaccatgcctggcccatgcctggctaatttttgtatttttagtagagagagggtttcaccatcttggccaggctggtcttgaactcctgatctcgggtaatctgccctcctcggcctcccagaatgctgggattacaggcatgagccactgcgctcggccatgagccttgttttttaaaaagttaaattctgtatcgtatgaggtaattgttaggtatttctctctttttttgagtcagggccttgctctgttgcccaggctcgtgatccttctgcctcagcctcttgagaaactgggacttacaagtgtgtgctaccatgtgcagctaatttttttttcccagtacagaaagactttaattgatgcattgctgcccatgccacacaggagatggagttattactcaaattggtctcctaatttttaaaaatttttagtagggatgatgtttcactgtgtcacccaggctggtctcgaactcctaagtgctggaattataggcgtgagccactgcatctggccagatagttctttttgataatataatagtcatgtagccttatttttgtccatgttgaactaagccatctctaggattttacatagttcagcagtgtttttttatacaaattgcttaagaaacacctagggtagccgacacctaaggtggcctcttgctgtaaggttattttacttgatagtaagtaaacattcttttttatattaaaacacatggatattgtagtgcaatgcagaaatttcattaacttgttaaacaggtcttgaagacgggttatttggttactttctgaaaaatgtctttggaggggtcaggagaatgggtttgttaacattcagtaattgctgtgggaaagtttgagagagatactgtagtgaaaaagtgggcttttgaggtgggggtacctgggttcacattacctagtttctgtcatttattggctcttgtagcttaggggcaaattactttaatctttcataattctgcgttttttaaatttaagtcagtctggctttgttttttaatttgagatggggtctcacttggttgcctaggctggagtgtaatggagcgatcattgctcactgtagccttgacttcccaggttcaggtgatcctcccacctcagccttcctagtagctgggactacgggtgcatgccactacgctcggctagtttttgtagaggcgaggtttcaccatgttgaccaggctggtctcaaactcctgggcccaagcagtcgggctgccttggcctcccaaagtgctaggattgtaggcatgaaccagtgggcctggctccagcattgtttttgttttttgagatggagtttcactcttgtcaccaggctggagtgcaaatggcctgatcttggctcgctgcaagcttcacctcccaggttgaagtgattcacctgcctcagcgtcctgagtagctggaattataggcgcatgccaccacgcttggctaatttttgtatttttagtagactcagggtttcaccatgttggccaggctggtctcgaactcctgacctgcagtgatcagcctgtttcagcctccaaaagtgctaggattgcaggcatgagccaccgtgcccagcagcattttttttttaaaaagcttatctatcatttgaaccctcgaagtgatgacattttttggtaagtatttcagagaaaaaattgcttgtctacacttctaagaggatttgaggcagcaacattgcattacagttatttgttaatgctattagattgtaagctgttagaggcaggaatgccctctcttatgccttgtatcttccgttgcttaggccatattgctcatattattaatagctgttcaataaatgagttgatttaaattaaattttatcccaatgagttcatactgtttgcaatatatttctaaattaaaacttgccaatctttaaaacaaaaaaggattccataggctgttagaataaatttcagggatgactcagtcagattcagtttgtgaggaaagagaagctcaataagtagaaatttgtttaccttatggagagtaaagcttattttcttgtagtgaagtttatatgaaagttaagtaagttcgttgtaagttttgaagttcaattatattttgtgtgttgtatctttaatatgtctcaaaaattgagaattaaaaacatttgttttcagaatataatgcttttttaaccttatttttcttaggaggctgaatgtaccatatttatgtatatgtatgtatgtacttacatacatttatagcagttttcatatggaataatttaacaaatagagtaatttttgtaacttcctgttttgatttttatgataaaaatgtaagtaaagcatagaaagggtatggcgctgtggctcacacctatactcctcatactttgggaggccgaggcgggcagatcacttgagggcaggagtttgagaccagcctgggcaacatggcaaaaccctgtctctactaaaaatacaaaaaaatttagccaggcccatgtggtgctacacacctgtgtaatcccagctacttgggaggctgagacaggagaactgcttgaacccaggagtgggatgttccagtgacccaagattgtaccactgtacttccagcctggtgacagagcaagattctgtctcaaagaaaaaagaaaaagagcatagaaaggtgctgacagcttaagaggtaaactgaagaggatggagtctaacaaatttcagataagaggaacattaaaatggaagttttcaaatgttgggactttctaataacctagatttcttaaaaatttatgaatgcagtttcatgtttcagatcatgtgatctgtaaacagatagcttggtaactaacagataagacattggatacttctttctggaccaaacatctaaaaaatagggaagcaatagaatttttgctacctttagaggccatgttccttagacaggtgttttcttctttgaataatagggcatttaccatccttatctgatgacccgtaactcttagtatttatttaaaaacagatttctatgcaatgcttaagtaccattgaatcagaatcaacaagggaagtctgtagatcacttagcatgcagtagatgtctactaaatattaataaagtttcgttaattatgttaaaactgaagcaaacaattcagtggaataaaaatgtcatagtttttaaaagttaaacacgtaactcaaaaatagaataaacatgttttacagcttgttttttttgttttgtcttgtttttttttggtcagtctggctctgtcgcccaggctggagtacagtggctcaatcttggcttactacaacctccacctcccaggcccaaaccatcctcttgccccagcctcctgagtagctgggacaacaggcctgcaccaccacacctggctaatatttgtatttttttgatagagatcggattttgccacgttgaccaggctggtctcaaactcctggattcgggcgataccccgacctgggcctcccaaagtgctgggattataggcatgagccactttgcctggcttgattgatttttaaaaattactttccttgaatttaaacctgacacttctgaaaattttgggtcagttatgttagtgtctctcaggtttggcttttctcttgtttagattcaggttatttacctttggtctagaatattacagaagtggtgcttgttttgttcaggcacacaatatcagtttgacctgttactgatgttgttcactttaatttgttgattaagggtgcatttgccaggctatttcactgcaaagctgcaattaattttttgggggaatgaggtacttagaaattatagaataacctgtttcctaaatttacatacatttatttatatttatctggatttatgttttttaatttattcaagagattataatatagtactctacttacttttattaaagtaaaaataacatcacataaagttaatcacttaaagcatacaattcattggcatttagtacattcatagtgttttcaagcctccacctctatcaagttccagaatgttttcatcaccccaaaagaaaactgtctctaagcagtcacccgcattccaccctcccaacagtctctagtaacaccagtttgctttttttctctatgaatttacctcttatgaatacctcttataacttgaggcatacaacgtgatcttttgtgtctggcttctctttgtttttgacgtttatactcagcatgtgttagtaattcattcctttttatcgttacgatttcattgtgtatgccacattttcttttgtctattgatggacatttggggtgtttctaccttttggctactgtgaatagtgctgttttgaacactggtgtacaacaatttgagcatcctttctcaattcttctgtgtatatacctagcaatggtatttctgagtcatgtggtaattgcgtgtttgactttttaaggaattgccaaacttctacagttgttgaacccttttaccttcacaccagcaatatataagggttctggtttttccacatctttgctaacatttatttcctcttttttttttttttcatattttgattatagccattctagtgggagcgaagtagtatttcattgtggttttgatttgcatttccctaatgatactgagtatattttatgtggttattggccagttgtttatcttcttgggaaaatattcaagtgctttgcccatttttattttattatttattttatttatatattttttgagacaggatcttgttctgctactcaggctatagtgcactggcactatcaaggctcactgcagtacccacctcctggtcacaggcgatcctcccacctcagcctcctgagtggctgggaatacaggtgtgcctcaccacacctggctaagttttaaacatttttttgtagagatagggactcactgtgttgcccaggttagtctcaaactcctgggtcaagtgatcctcctgccttggcctcctagagtgctgggattacaggcacaagccattgcatttggccctttgtacattttaaaattgagttgtctgtttgttgttgagttgtaagagttctttatatattctggatactagaccttattagatatgaggtgcatatattttcttctgtcagttgtctttttactttatagataatattttttgcacatgttttaaattttcatgaagttcagtttttgttttctttttttaattgttactcttggttttggtgtcatatttaagaattcattgccaaatccaaggtcaggaagctttatctccctgttttcttctaagagttttatagtttttgcttttatatttaggtctgtgatttattttgagtttattttatttatttatttttgagacagaatcttgctctgttgcccaggctggagtgtagtagcgcgatcccggctcactgccacctctgcctcctgggttcaagctattgtcctgcctcagcctcccaagtaactgggattacaggcacctacaacgatgccatgttgggttttgccatgttggccaggctggtctcggactcctgacctcaagcgatccacctgccttggcctcccaaagtgctggaattacaggcgtgagctactgcacccagctgagtttatttttgtatatggtttgggtaggggggtccaatggctatttagttgtccagtctgtttttttgaaaagacaattccgtattgaatcatcttagcactcttgttgaaaataacttggatataaatgtgtgggcttatttctggtttatatgtctgttcttaggccatactacagttttgatcactatggccaaggtgcgaggattgcttgattccaggagtttgagaccaacctgggcaacgtagaccccatctctacgaaaaatatttttaaaattagcttggtgtggtggggcatgcctatattcccagccacttgggaggatgaggtggtagggtcgtttgcacccaggtggtggaggctgcattgagtcatggtagtgccactgtactccagcctgggtgatagagtgagactttgtctcgaaaaataatcaaaatgggcaaaggacttgaatatttttcctaagaagatctacaaatggccagctcactgttactttacagtaagttttgaaatagggaagtgtgagttctgtaactttattctttttctgaattgtttttggatgtttagggcccctcgcacttccaaaggaaattgagaatagccttttttatttctgtacaaaagagagtgttggattttttttcttttttgaaatagtgaaacttagtgaaaggttctcttatcccctttgcagggcatgtgatgggggtgtgccttgcttctttggcaccccactgctcaaatctctagggagagcatgcagacagggcaggctgtgggactccgaccccacggcagcacctaggggtgaatgtttacagctcctgaagccccagtgggcatgtgttacagggtgcccttttagtctagccatccataggcggcttgtgttagctcagttagatgccctgccttatcgcaaggacagagggcttttttgccttggtgtatgggaagaatcagatcacacgtgggcttggagaacgagtgcaaggttttattgagtggaagtttccagcagatggatgggaagccaggagggagatggagtgggagggtgttttcccctggagtcctgcagctcagtgacctgggctctcctctgaccgcaccagccaaacccagccaaacttcatgcccttctttggtcgatggcctgccagcctgctttctgtcagtgtggtattccactggcatgcttccctggacatccagctatttgtgtgttcttccgccgatatgtccctctcgatgacgtccagccacttgtgtctctgcctactagagtctctgagggttttataggcacacgatgggggtgtgactggcagagtggtcttgggaaatgcatcatttggtcaggaaaacagaaatgcctgtcctcacctagatccgtgggcacagaaccggggatggagccctcgcgagggaccatgcccttcccttcccagcgcttgcctgcacacttctgtatcagtagggtcttactctttctcaggggattggagccctagccagggaccatgcccttttcttcccagcacttccttgcctccctccatatcaatagagtctcattttgttgctcaggctggagtgcagtggtgtgatcttggctcactgcaacctccacttcccgggctcaagcaatccttccgcctcagtgtcccaagtagctgggaccacaggtacgagccaccatgcctggctgatttttttatttttagtagggacggggttcaccatgttgcccaggctggtcctgagccactgagctcaagtgatctgctcaccttgtcctcccacagtgctgggattataggcgtgaaccactgtagcctggccgggtgttggaattttaatagagattacgttgaatctgtagatcatgtttgggtagtgttgttgtcttaacagtgttgagtttcccagtcctcaaacacagggatatctgtcttttgtttttctttttttttttttttttttgagacagagtctcaccccgtcgtccaggctggagtgcaatggcgtgatctcggctcactgcaacctctgcctcctgggttcaagcgattctcctacctcagccttccaagtagctgggattacaggtgcctgcctccatgcccagctaatactttattttagcagagatggggtttcaccatgttggccagcctggtctcaaactcttgacctcatgtgatccacctgcctgggcctcccaaagtgctgggattacaggcttgagccactgtgctgggccagggatgtctttctgtttaggtcttttaacatttctttcagcactgtcttaatagtttttggtgtgcaagtcttaacattttcttggttatatttatttattataggtattttatgcttttggattttactgcgaattgagttgttttcctaatttcttttttggattgttaatagtgtatacacaaacagctgtttttgtgtgttgatcttctatcttggcagcgttcctgaatttaattagctctaatacatattttttctggactctttagaatttatgtaagatcatgtaatctgtgaataggaataattttactttttccttcccaatttggatgccatttaaaaaaatacgacactgtctcactatgttccccaggctggagtgtagtgcttttcacaggtgccattatagcactctacagcctcaaactgtggggctctagcacttctcccttcccaggctcccaagtatctgggactacaggtgctttgcactgtggtggctcaggatgcctttcatttcttttcttgcctagttgctatggttagaacgtctactacagtgttgaatagagcttgtgaaagcagggcattcttgtcttgttcctgatcttaaggggaaagctttcagtctttcaccattgaggatgatgtgctgtggttttttttaatagatgctgtttatcaggttgagcaagtttccttcttgtttctagtttgttgagtatttttataattaaagggtgctagattttgtcaaatgctttttctgcatcaattaagatgatcgtttggtatttttctttcatgttattaatgtggtgtattattgattgatttttgtatgttgagtcactcttgcattcctgggaaaatactactttgtatggtgtttaatccttttaatatgctgctagatttggtttactggtatttcattgaggatttttactcagtactttggttgtagttagaattccttagctattggttgattttgggtgtttttgatggtctttgtgattttaaagcttattttaaagttttctgaaatcattataaagacagtaagtttgttattctgatgaaatcaatttgagtaagtttttctttgaaaacgtggcacaaatttggtagggtcagaaataaaacataacaagaaagagaaaaaagtctcatctatttgtattttttgccaaagtgtattctttttcagtctgaagaataatctttttttaaaaattaaaagtcaggcatgtgcacttaaagatgtacacttaggttttatttttttcagaaccagctttctcccggggaaatttttattcttcatggatgtcgtgaataaattgtaaattgggtgacagagaaaaaaattagggttttcatactagcagtatttgtgtatcttaaactctttatgtccacatgggaccttcagatatgacagaatccagtagatttcttaaaaaaaatttttttaagccagtcaaatttagtattggggggccagtagaagatttctaataagctgtggaatcctgactcctgagttgttagtaggactgttgatttgccttttttgagggggagggtagttgtctcctgtatgtacctggttgttgtgtatgtgtaaaggaaatatttaatacataaacattttagttggtctatttctaaagttgtttgtagtttactagggctgccataaccaaataccacagactgggtggcttaaacaacagacatttattttctcagttttggaggttctaagttcagggtagaggcatcagcagagggttggttgcctctgagacctctctctttggcttgtaaatgactgcctgcttgctgcctcttcacatggtccttttatctgtgcatgtgtccaaatttcttataagggcacagtctgatgggaatagaacccactctaattgcctcatttgcagttaatcacttctttaaagaccttatcttcaaatattgctacatttgaggtattgggggctatgacttcaacatacaaatcttgttggttggggggacacagttcaacccataacatacacagggaaaggaagaagagacaaaatcagatggcacaatgcagttaagatgagtggtgtggaacttgtgaaactttaattagcctttatatacttgtgtaactgccatagccataacaatactgcctttttttttttttaaatcttttttcagaacatgagttaacttctttttttgagataggatcttctctgtcacctgggctggagtacagtggcgtcatagctcactgcagcctcaaacttctggtctcaagcagtcttcttccctcagtctccgtagtagctgggactacaggcatggaccaccacactcagccggtttttaaaattttttgtagagacgggagtcttaccatgttgccaaggccggcctcaatctcctgggctcaagggagcctcccacttcacttcccagagtgctgggattacaggtgtgagcctccacaccaggcccatactttaagaactagatttaaattaaagttaatataaagacattgcagaaatgaataggtgattttagtggtttgcctccggggattttgttgttgttgttgttgttgttgttggagatggagtttcctccttgcccaggctggagtgcaatggcgcgatctctgctcactgcaacctccgcctcccgggttcaagcaattctcctgcctcagcctcctgagtagctgggattacaggcatgcaccaccacgcccggctaattttgtatttttagtagagacgaggtttctccttgttggtcaaactcccaacctcaggtgatctgcccacctcggcctcccaaagtgctgggattacaggcgtgagccgtcgtgctcggccattacgtaactttttaccattttgtatgatatgcctttttgaaaatttgttaccaattttaattaaaaaaaaattttttttttgagacagagtcttcctctgtcatccaggctagagggcagtggcgcgatctcggctcactgcaacctccacttcccaggttcaagcgattttcctgcgtcagccccctgagaagctgggattacaggtgcccaccaccgtgccctgctaatttttgtatttttatggggtttcaccattttggccaggccgatctcgaactcctgaccttgtgatccacccaccccagcctcccaaagtgttgggattatacatgattccagcccatttttggttaagttctctgaagtttctggccaggaagttgttggaaaagtgtgtaaatactaaatactaaatactaaaatactaaagcaccgtttagtatttaacttcatgttaaaagatgaaaatcttttataaattttcagacaccttagttttcattgttactccacaagactttgacatttaatgccaatagaaataaataggactctgaatacctgaatttttgtgatgtgcagtatattttggttagacatagtcttaaaacctgtattttgtttcatgagtgttttattggaattcctcttaaggttttcaagttgtatcagagtttttctccctaagcccatattgagcatttaaacattttcacttacattgccagttttaactagttgtatttgttttttatatctggttactcttaacctttcttttctttttctttttttcttttttttttttttgagacggagttttgctcttgttgcacaggctggagtgcagtggctctatttcggctcactgcaatctccatctcctgggttcaagcaattctcttgcctcagcctcctgagtagctgggattacaggcgcacaccaccacacctagctaattttttttgtatttttggtagagacagggtttcactatgctggccaggctggtcttaaactcctgacctcaagtgatccacctgtctgcctcagccccctccctcaaagtgatgggattatacgcgtgagccacaatgccgggaccattccctggtttattttagaacagtccagatgtatcatcaatttagttgtaaagatttgagtatatgtctttttttttattatttttttcagagggagccttgctcttttgcccaggctggagtgcagtggcgtgatcttggcttactgcaacctctgtctcccaggttcaagtgattttcccgcctcagcctctcaagtagctgggatttaggcacccaccaccatgcccagctaattttttattttagtagagatggggtttcaccatgttggctaggctggtctcgaactcctgacttcaggtgatctgccctcctcggcctcccaaagtgctgggatgacaggcatgagccactgcacttggccggtgtcttccttctaaaacatcataaccaccacaccattatcacatctaaagtgattattccttagtgccatttaataatatccagcttatgttcaaagttctgattgtttcataattttctttttttttttttaagattgatttgttcacataaaggattcttagttcatctgcccattaaaagccactatttgtcgtagaaaccagttcatttaacctttagattatcacttcccccagatgtcctttaacttgttctccatcttgaatgtactgctaattggtagttaaatcagatttcaaattttattttaggtgggcacaagactacatcatagatggtactctgtatttcattttgggttatatcaggaaacatttgatgtctagttgtctatttgactttttaataaaagctatactgaggtatactttatgaaaaaaccagttttaagtttataatttgaggtttgacaaatgtgtacagttgtaataaccaccgcaatcaagataatactcagttacccagaaaattccctcttctttcttgcagtcatcccccttccaagttgatctattttctatctctatagttttgtcttttctagattttcattataaatagaatcctatagtagtaagtagtaagatcattgtaatataaaggcgctaatttttggccaggagctgcaggtctaattccttccatttttatgtgacagggacttgccatgaggtgttgaagccttgtttcactgagttggagagactggacctaaatggcgcagcatgactttgctccagcctggcttaatttccctactccaccatcatcaacaaaggtactctttctgcatctttctttctgtctgcttctcttgcattcattttttacacaaatgtaattaagtcatggaggagtaataatatctttgcagagaagtacatttgtggctgggcgcggtggctcacccctgtaatctcagcactttgggaggctgaggtgggtggatcacctgaggtcaggagttgaagaccagcctgaccaacatggagaaaccctgtctctactacagatacaaaattagccaggcgtggtggtgcatgcctgtattcccagctattcaagaggctgaggtgggagaatcacttgaatctgggaggcagaggttgtggtgagctgaggtcgcgccattgcactccagcctgggcaacaagagcgaaactgtctcaaaacaaaacaaaacaaaaacaaaaacccaaaacatttatattaacatctaagttatttaatttgttggctctattaaaattttttttttgagacagagctttgctctgtcgcctaggctggattgcagtggcatgatcttggcttattgtagcctacacctcctgggttcaagcgattcttctgcctcattctcctgagtatttgggattacaggtgtgggtcaccatgcctgactaatttttgtatttttattaatagtagaggtgaggttttgccatgttggctaggctggtctctaacgcctgacgttaagtgatctgcccgcctcagtctcccaaagtgctgggattacaggcatgcgccaccgtgcccagcctgttctattagttaacaagtcagtttttattacaccatcagcgtacactaagccatttatttcaaagttgtcttttgtagtaatcagagtttcacaaattttaattcttaccagtcatatactttgaacagagcatcttacctttttctatactgttttttactcttacatggattgacttgttaatgatatccaccatacatgatgtacttcagtttgcagagtgctttgctgaacattatctaatttgttcataattccatgaatgtggtgatttagaattattcttagtccctgctgtactcattttaaatattgatctcctttatgagggaaagtaaaatgattgaggtgcagagtaaagggtttgtgcacagtcactttgggatgagggtgatttatctgagttttctgtgtctttccccatctttctgtaaagctgtttgcctcatttgatatcaaacccatccgttaggctccattaattcccagctgattgctctattgttttcattaatgcctgaagggcctaaatttgatccatgctctgatccaatttagttatggcaggtgtagttttgaggcccagtctcctgaggttggttctgaccctagtagggctctccttacgtatctctttctcaggttcattcagaactagctggcctgtgattcagcttattgctcttcatgcagaggagctacttattttcttactaccagtatctccattgtttctgagagggctgttagtgtttgaataaagttagttcctttgagagactgcttcttacccttggcaaaatctttgagtcattactccacgtgctaggtggagcaatagcctgaatcttctaagtttttccagtgtgaaactacttattgcttattcagcttattgctcttcatggagaggagcctcttattttctcactaccagtatctccattgtttctgagagggctgttagtgtttgaataaagttatttcctttgagagactgcttcttacccttggcaaaatctttgagtcattactccacgcgctaggtggagcaatagcctgaatctgagtttttccagtgtgaaactactgccctattagatagctggagcaagagcaattagggcctcagtgttcttgggctgatgaacctggggtagagccttcattctgtgagtgggggttgggtggaataaaggagctccagagttctcgactgtagttaccagaaatttaacttcttcagttggaattggagagggtgagaaatgttggcagtctgcctctcccagtaaggtgtaccccccttgtttagaagatgagagaggggaagaaacctgtcttcttgattacagctgcccagattggatgtggggagggtagctggttgtagctcaagtgctgcagactcttgcaattgagttttagtctgaacaagtataactggggaaaacgattaaaaaacaaaacaccgtggtcgggcgtggtggctcacacctgtaatcccagcactttgggaggcacaggtgggcagatcacttgaggtcaagaattcgagaccagcctagctaacatggcccaaaccccgtctctactaaaaatacaaaaattagctaggtgcggtggcatgagaatcacttgaacccgggaggtagaggttgcagggagccgagatcgtgccactgcagtccagcctgggtgaaggagtgagactctgtctcaaaaacaaaacaaaacaaaaaacactaaaagtctgaaaattattctaagggcacatagcaaatgaagaaacatttatttaagaaaatctgaaaacttcgtgtttctgtactattcttctgataacctgctttactttctccttatgaacattttttcaaagccttttcatatatctggaacgctttttttttttcatataaataagactcgaatggctcatgactacaatttcaggaatgtgaattttgcaatatcgttatatattaggactcactaaggaatgttgatttaacttatataaataaaaatagaatagttttttacaggtacatttacagacattcaaggagagtgcaaattattaaaattgtctatttttaagatgtgctaagaataaatttttgaagcagatgctagaaatggacttttttgatagattatatgccactagtgatttctttaatagtctgcaaagtggaaaatagcggcgtattctgataaaaagttgtaatacaatttttttggtcaagttattttgttaggggagctttttgatgggccttccctccagcatgatctagtgtgtaaacataaaacaactactgcctgggtgcggtggctcacgcctataatcccagcactttgggaggccgaggcgggcggatcacctgaggtcaggagtttgagaccagcctgaccaacatggagaaaccccgtctctactaaaaatacaaaattatcccggtgtggtggtgcataccttaatcccagctacttgggaggctgaggctggagaatcgctttaaccgggagggtggaggttgtggtgagccgagattgtgccattgcactccagcctgggcaagaagagtgaaatactgtctcaaaacaaacaaacaaaaaacacaaaaaaacacaactacaagtggtcaaagatctacctgtaactgtctagatatttgcctctaaataatgagacaatgcgaatgcaaagagccagtatgattaagaatatgaccattttcagaaaaagcatattgactctcttgggtcagatatggtggctcacacctataatcccagtactatgggaggctgaggctggagaatctcttgaggccaggagtttgagaacagcctgggcaacatggtgaaaccctgcctctctacaaaagtaaattaaataaatgaaaattttcacacagattaagagtttatttaaaaatatctttctcataaatactagttaatttcttttcacttatgaaattttttatagtaatttatacttttggttcaggcaagctgtgttcattttgatttaaagtaattcctataggtgttttgacttttctagactataagacctgtgtaaaagaaaaaaaaacaaaaaaaccccactttttttcctctctactctcaacacagaacacttctataaccacataatttggattctccccctcaaagcagttctccagcagacactacctgggtatcctataattcatttcagttctgacactgtctgcttgggatagggtcagatcccacaggttaaatgttcagtcccacaagactgctttcacttcagatgccaatagccagtcccagtcaccagtactcctcactggttacaaaccaggatttctgcaaccacccccattgggtctgaacaatttgttgggatggctcaaagaattcagggaaacacatttgctgattttattataaaggatacaggtgaatagattgataatggtgaggtattaggtgaggggaggtggtgtggtgtgtggagcttccatgccctgtctgggtgtactaccctcccagcactttcatgtgttcagcaattggtctatgggtggtggggctgaaagttcataccctctaatcacttgatttttcctgttactggccctgtgctgagactgttgggggccccagtctaagtgactattaacataaacttgagttatcacagggacttgataacttgatttcacctcaagtgatccgcctgcctctacctcccagtgtgctgggataacaggcgtgagccaccacgctcgagccagaatcaattttataatttggcattttgttctcccataaggacttaccaggtcctaataaattttggccatatgtgttgaaaaagatacacttaagttataaaattctcctatagaatataattttagggtttgaagatggatcttagtgatcatctaaaccttatacagattttggaaggttaactgaattgttttcacatagctgattagtgtgagcctagattagaatccaggatgtatctcctattctgtgatctttccataggactcattttggaattctgtaaaatgagtaaaaattcatagactgtaaaaaagggatttgaggccgggcgtggtgactcacgtctgtaatcccagcactttaggaggccaaggctggtggatcacctgaggtcaggagttcaagaccagcctggccaacatggtgaaaccccgtttctactaaaaatacaaaaattagccgggtatggtggcacatgcctgtggtcccagctactcgggaggctgaggcaggagaattgcttgaacccgggaggcagaggttgcagtgagcccagatcccgccactgaactccagcctgggtgacagagcgagactctgtctcaaaaaaaaaaaaaaaaaaaaaaaaaaaaccaaaaacaaacaaacaaaaaaaaaaacaacaaaaccacacacacaaaaaacaaataattaaaatttaaaaaaaaaggtacttgaaattgttggggaatggagacctctgttgattaagccactgaaatcaattcttgttattgacttttgccaccttctcattcgtgtgtgggtccctggaattcccctgtaccgagctgctcttgtttgtcttttaagtcagcattttccccagtcctgcctggatgcatatgggtttcctgctttcctcttttgtcattttctctgaaataaatgtaagacttcttgtaatttttaagtgatttcatagctaacataaagcacagtaataaaaattagcatctgggccgggtgcggtggctcatgcctgtaatcccagcactttgggaggccgaagcagggggatcacctgaggttgggagttcgagaccagctggaccaacgtggaaaaaccctgtctctactaaaagtacaaaactagctgggcttggtggcgcgtgcctgtaatcctagctactcgggaggctgagcaggagaatcgcttgaacctgggaggcagaggttgtagtgagctgagatcgtgtcattgcacttcagcctgggcaacaagagtgagaccctgtctcaaaaaaaaaaaaaaaatctggaaagatacacaaaacattaaaaaaagcttgtaaatacttgtcttcatttaaatgttaacttgaagttaagattggtaatttaaaaaattaaaaaaaaaatagagacagggtctcactatcttgcccaggctggtcttgaactactgagctcaggagatgcttctgccttggcctcccaaagtgtgattacagatgtgagccattgagcctggctgataattgttaacgtgcgttgaaattctcaatgctttttggacctgactcttgattaatttatataggccctcataatgatgatgattttactcttagaatttggaacaccagttctaaattctgaattcttctaattaaaaattagctttagaaaatagttgacaatttaaactttttttttttttttttgagatggagtctcgctctgtcgcccaagctggaatgcagtggtgtgatctctgctcactgtaacctctgccccccaggttcaaacgattctcctgcctcagcctcctgagtagttgggattacaggttcctgctatcacacccagctgatttttgtatttttagtagagatggggtttcatcatattgtccaggctggtcttgaactcctgacctcaggtgatcaacctgactcggcctctcatagtgctaggattacaggcacgagccactgcaccccgcccaatttgaactcttaactagcagtatttgagatttgtttctttgcccaaagtggttttgacaaacacaatactttctagtgatacttttattgtaccttttctgtcttattctttctcagaatcatcatttatgaattctatttgtaattaacctcttgttttctgccatagacttttgtttacccacatcgtttctctttttaatattgttctgagtaattggaacagacattaattagtattgcattctctacttaaacggcagtatttattttttgtttgaaaagatgacatgaagatttgaattaagggtaaaaatgttttcagaactgtatggcagtagttttgagatgtgtagaactttagccccatcatgtggtaaaaatttaaactgcatgtggctgagtataaatctcttatttagggcagtgacttttaaactgttgattgtgacctgtagtgagaaggatattttacacagtcttttcattttcatgtatatgtaacaaattttatatacctgtggcgcactagttttttcttttgtgattttctagtttttttaaattccattaaataatgccaattgtgactgatcttatcatttgttaataggtcctgaccagcagtttgaaagtaagtattactgaaagaatattgaacagatattgaaaaatttagataactagcaaattccatttgttatgctaggaaggatgacaaaataatccctgtaaacaggatgctgtatcttcataattgtttgatgaaagatttcggggttgtggtattaaaagggtagatgaatggtataaaatagaaagttggagattttttttctttttaaacaaaaaatgtggtggaactttactatgatgaatacattttcatgtttgtattcaataatctgtagttttctctgtagtgtataatagtagcattttttgattcttttatggcagtgttaaaaagattagtattactgtaccaaaactttcctttgacaatgtaagcagtgtcagcttgcgatgaaaatgtaggctatttatacttttaggctaaaaggatcagaaaattcagccagactgctagtcgagttcattgaaacttttaatttgatttttgctgttctgaaggtacatagccagatttcattgaaacttctgtggagaaggtttactgtgtagattttttggtttattgtttatttaggtattctgggctttagagaaaattttaaatgaaactttttttttcaactttagttttgtttttttgttttgttttttttgtttgtttgtagagacagggtctcactatgttgcccaggctggtcttgaaatcagtgctgggattataggcttgagacactgtacctggccttaaaactatttttaaaaacagtccagaaagaaaggcagtgtaagagggaatggatggagatggtctctgccttacttgttgtaataaaacacttatattaaggtaacaaaaatcttaagatggtagacactcttatctccccctgccccaccatttacagatgagggaactcagcttgagagattaatttgctgagacatactagagctggaataggaagccatatgtatcagactttaaaattcatcagtttaataagttttttttcttgattattaggatagtagactaggtttcagaagtgaaatgctaagttacttttatgcatacaccagaatatatttttattgcagtttggagaaacatgaaataactgttttttccctttttttcaaggataccatctctagtatctttctatagtcagtcataggaaattcatctctttttagtggctgtgtaaacttttgttgagtggatctatgtggattatgtaattaattacctattaatggactaaactgtagaaatacctgggcatttctttgataatggtaaggtaaatttctagcagtagaattgctgaatcagaaggtttgtacattttggtagataatgcctaactgctctccaaaatgttcgtatctacttataatcccattacagttttatggggaggggggcaggttttcagtcttggcgacactggatgttttcatttttacgtttttgtgaaattagatgaaaagatggtatttcgttttgatttgcatcacttaatgacgatggagcatatttttgtgttagaaattttatctcagaattgcttatgtagtgtatttcttagtgatttatagctcctttcatattgggttatgtttgactatattttttattaaaattttttttttcatatggcgccccagaactgagcagatgccatttatattgcaaatgtttttctacagcttgtttgatattttaaaaaatgtccttaattttttttccctcttagagacagggtctcactgtgttacccaggctggtcttgaactcctggcctcggcttcctgagtagccgggactacacgcgtgtgccaccacgcccagctaatttttgtatttttagtagagacaggtttcactgtgttagccaggatggtcttgatctcctgaccccttggtcctcctacctcagcctcccaaagtgctgggattacaagtatgagccaccgtgcccggcctctataactgttttctttatactctttccagaagtttgtcagattagctccaattcttggtgctatcagtggtaccttatcatggttgaaactttttcaagaataccttgcaggatcaatattcaatataatcaatggacattccatgctctctaccatccacagacatctggtattgtgaagtagtactagaagagccgcctcaaaattcagctcaaaacaagttaaaactccaccttccttacctcctcacacctccgtaaggctgtttggtcaatgaatgcagcataactaaagaaatgtcttcatagtcgcttctgggtataattggtataaaagaaatgagaaattgtgagaatgtagacattttagttatatatatattttaaaattatatatataattttaaaatttataattttaaaaaatatatatatttgtttattttattttattttatttttgagatggagtctcgctctttcccccaggccggagtgcagcgatgctatctcggctcactgcaagctctgcctcctgggttcatgccattctcctgcctcagcctcccgagtagctgggactataggcgcccgccaccacacctggctaatattttgtatttttagtagagacggggtttcaccatgttagccaggatggtctcgatctcctgacctcatgatccgcccgcctcggcctaccaaagtgctgggattacaggcatgagccaccgcgcccggccttaaattatatttttaattaaaattttttctagagacagggtctcagactatggcccaggctggagtacagtggcgtgatcatagcttggtgcaacctggaactcctgatcctctttttttttttttttgagacaaagtttctcttgttgcccaggctggagtgcagtggcacaatctcagctcactgcagcctttgcctcccaggttcaagcatttctccttttccatccttccgagtagctgggactacaggcagatgccaccatgcccggctaatttttgtatttttagtagagacggggtttcaccatattgttcaggctagtctcgaactcctgacctcaggcagtccacctgcctcagcctcccaaagtgctgggattacagatgtgagccactgtgcctgtcctcaaatgatcctctctagtcagcctttcaagtagctgggactacaggtgcgcaccaccatgcccagctaatttttttgtagagatggggtcttgctatgttgccaaggctggtcttgaactcctggcctcccaaagcactgggattataggcgtgagccactgtacccagtttatagttttaaaattcgggattatgacctgaccatccctggacatgatgttgctttcccctaagagtaattaaagtccaggccataccacagggtgatagcttggccaaaatggaatctaaataattctaacttattagattctcttgggttgacatcctagatcatgaagacaatgaccatttgcttgagtgaactgctcacctactctccccctacagtatccattgagaacgaaggtaggggacacagtggatcactgcaaattacataaaaatgcccccatctcattcacatcttacctccccagatgaaaagtctaggttcaagtaggagattttctttttttcttaagtgaagtcacagctcttgtactttaaagactgacatatagccagcacagtaaaatatgagtaagaaatacaataggactaaaaaggaagatagaaaactggtattatttcgccgggcacggtagctcatgcctgtaatcccagcactttgggaggccaaggcgggcggatcatgaggtcaggagatcttgaccatcctggctaacatggtgaaaccccgtctctactaaaacctggctaacatggtgaaaccccgtctctactaaaaatacaaaatattagccaggcgtggtggcgggcgcctgtagtcccagctactcgggaggctgaggcaggagaatggcatgaacccgggaggcggagcttgcagtgagccaagatcgtgccactgcactgcaccctgggagtcagcaagattccttctcaaaaaaaaaaaaaaaaaaaacaaactggtattatttgtgaacaattaactgtccatattaaaaaaaactccgacagattctacaaagtaagaattaagattgctagacacaagactaaccaatttcatggctgtggagggagagcagacaactccaacacttgagaaacacattaccccaggaggtgcagaaaggtgaacaattaatgccctctctgtaccgttgaaccagcatcactgcctgagtcaaacagcagctggaggagatgacactgacacactgctagatttgtcacctctgtccacatgctttgaacttggaaaaattgatgtggacatgggcagtcagctatcctgctactcctgatgccatcaatgcagctcctaaatctgcatttgaacactcagatccatacaaccttgtttcgttatgattaataacaattcatatgcttatccagatacctgaaagttaacgacatgtgtagcaactgaggctccagttactttgagacagtgttcatgtttctgaactaagctattaacagtaatccaaatcaagtttaacaacagatcttggagtgacctgtgtcccttggggtggttggtttttatgtgagagaatgagatacaggacatctctctattgacaatgaggggtaacttttggcccatttgttgcccttgtaattgttaatgaaagacaccaacagtcaggtcggtttaaattcctgttaatgaactgtaatggataatcatggccttagaccatatcctggcaaaattacttattggtggttcccaacctccaccagcgttcctccttccagggtttattcagttggctgggtcctgacctcacttgagatgttgataatagacttaattaaatgctgtataagaccagttaaatgaattttgttctagtctctgtcaggaagattaatatgagttactaacagtggaataataatgggaaaattcaaattcagccaagaatgtatagggctgatgggtagatcattgagagaggcaattcatcctgggctctgagcatttttgcttttttttttttttttttttttttgagattgagtcttgctctgtcactcaggctggagtgcagtggcgcgatctcagctcactgcagcctccgcctgctgggttcaggcagttctcatacttcaagtcactgggattacaggtgtgcgccaccaagcctggctaatttttgtattcttttttttttttttttttttttttttttgagacagaatttcgctctattgcccaggctagagtgcagtggtgcgatctctgctcactgcaagctccgcctcctgagttcatgccattctcctgcctcagtctcccaagtagctgggactgcaggtgcccgccaccgcgcctgactaattttttgtatttttagtagagacggggtttcaccatgttagccaggatgatctcgatctcctgacctcgtgatcctcctgccttggcctcccaaagtgctaggattacaggcgtgagccaccgtgcccggcctgtattcttttgaaattattttttaacttttggaggtggagtctcgctctgttgctcaggctggagtgcagtggtgcaatcttggctgaccgcaacctccacctcccaggttcaagcagttctcctacctcagcctcctgaatagctgggattacaggcacccaccaccatacccagctaatttttgtacttttagtgaatttagtgtatttagtgagccgtttcaccattttggccaggctcgtctcaaactcctgacctcaggtgatctgcccacctcaccctcccagagtactgggattacaggcatgagccaccacacctggcctaatttttgtagagatggagtttcactgtattgaccaggctagtctcaagctcctgacctcaagtgatccacctgcctcagcctcccaaattgccgggattatggccatgagacactgcacccagtcccctacacgttcttgcttgtatgccaagaatgcaaaatcttgactacactttgcatgggccgtttcttggttgtttgcagtaagcaacattgagggacaaagaccaagctctttatatatgtggttgatttgccaaactcagtgcaagggcagcatccacctgggcccctccctgtcaatccccaaaggtcttagggggctgtacagaaccagtgccaacatcacgcttatgctgcttgctgtaccatgagtaataaagtctttgtctcatgtcttttgccagcatccatgaaacagtatccaggctagcttgttagcttgcacagatggtaacatcccagactcttgaaagactctgacatatagccagcatagtaaaatatgagtaagaaataacaggtaacaggactaaagggcaagatagaaaactggtattatttatgaacagtaactgtccgtataaaaaaatcccaacagacatgctacaaagtatgaattaaggttactagaaataaagttgctagataaaagactaatacaagatagaattgtaagtgcaacaaagacttaaggctttaaaaaatatttaaaatagtaacaagtaccctgtttaattacttctttatatgtttaaatacttcattaaaaccacctatatagtctttttagaatatcaaagctagctgggcgtggtggcttacacgtgtaatctcagcactttgagagcccaaggcgggcagatcacaaggtcaggagttcgagaccagcctggccaatatggtgaaaccccatctctactgaaagtacaaaaattagccaggtgtggtggtggccacctgtagtcccagctacttgggaggctgaggcaggagaatcatttgaacctgggagacggaggttgcagtgagctgagattgcaccattgcactccagcctgggtgacagagcgagactctgtctcaaaaaaaaaaaaagtctgcatctatatctgtatctcaaagctgggtgcagtggtgcatgcctgtagtcccggctgctcaggaggctgaggcaggagcatcacttgaggccaggagttcaagtctggcttgggcatatagatctgtctctaagggggaaaaagatcccctccattctttattttactcagatttcagcgggggaaatttttttaaggaaattaaaaaaaataagctgtagaaaaatatttgcagtataaatggcatctgctcagttctggggcataatacaaaaaaatttttaaaatgctataaggtgctaggataaatctattgaaatacatgcaagactgaaaaaaaaaaactaaccataaagacttaaaagatgacaaatataagtatagatatacatgtgcatttccctccctactgagagaagtaagcaagcatatatgtatgtgtatgttttctaacccagtaatgaataattgtctgggctgagtgcagtggctcactcctataatcccagcactttgggaggccaaggcaggtggatcacttgaagtcaggagttgaagaccagcctggccaataatgatcaaaccccgtttctactaaaaatataaaaattaaccggttgtggtggtgggtgcctgtaatcccagctgctcacgaggctgaggcaggagaatcgctggaacccaggaggtgaaggttgcagtgagccaagatcgtgccactgcaccccagcctgggcgacagaacaagactccatctcaaaaaaaaaaaaaaaaaaaaaaaaaaaaaaaaaaaaaggagttgtctgtcttctcaacccttactgtcattatatattggccaatgggcaagaggtgccagctttgttctaatcttgcattttgattacaagagaacctggctatgttttcatgtgatttgtggctctttaatttttgagaactggctttttgctcatgttttccccattaggttgtccttatttgtattgatttatagagctctattttcctttcctttccttttcctttttcctttttctttctctttccctttccctttccttttctttttttgatggagtcttactctgtctcgtccaggctctggagtacagttgtgtcatctcggctcactgcaactgcaacctgcctcccaggttcaggcaattctcctgtctcagcctcccgagtagctggaactacaggcgtgtgccaccacacatggctaattttgtattttttgtagagatggggtttcactgtgttggccggactggtctggtctcgaactcctgacctcaggtgatctgcccacctcagtaccccaaagtgctgggattacaggcgtgagccaccatgcctggcctttttcaaacatttattgatcattttcatgcattttctttttagattactgagacgacttgttaaaattttcccttcccttcccatcccgttgcatcgcatcgcgtcccgtcccgtcccgtcccgtcccgtcccttctcacatgcaatggcgtgatctcggttcactgcaacctccccgcctcccaggttcaagcgattctcttgcctcagcctcccgagtagctgggattacaggcatgtgccaccacacctggctcatttttttgtgtttttagtagagacggggtttctccatgttggtcagctggtctcgaactcccaatctcaggtgatccgcttgcctcggcctccgaaagtgctgggattacaggtgtaagccaccgcgcccggcctaaaattaaattctttaaaaaaactgttggaagttttgattgtggttttatcagattagtagattaatatttggggctagtgacttttatacattgttagaacttttctgtatttctaattttttggaatacttattgtacattcttttattttgatacctttttaaaaacacttggtttggggaagaggaatatggaaataaatttaagggacttagaactgaagattcatttgacaatttttctctgatgtagaaggaaactgagctgtagtgaaaatttatatcaagtagtgtatgataaagacttaacattttgttgagaaacatcgtattttaacttgttttccatacagtggcattttacctttatattttttggaaaaaaagatgtcgaactctaagcacatgtgcttgtttccattagatagaagaaaatggaccatcggtgaatccattatacagttacccagttatcaaataccttgaaaataactgcaatatgttgttcttaatcatttaaaatttttggaaataagtgaagttggagtattactagtttttaaagttatatttaggtttcataaatacctgtatttttataatttgtttcagtcgtcattgaattttgagaagcattctgaaaactttgcatggacagagaatcgttatgatgtgaaccgtcgacgacacaactcttcagatggctttgattctgctattgggcgtcctaatggaggtaaaatttgctaaggaatgatgtttatggctaattttctttatgatttttaaagaatgttttgatgtgattcaatctttaagcttctcttctttgaatttatattactttgctattatcaaataaaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttgtaagttttttatgacttttatacaaatgaagtttctgtaagtgctattttaagtgattctcctgcctcagcctctccagtatctgggattacaggcatccaccaccaggcccgcctaatttttatatttttgtagagacagggtttcaccaggttggccaggctggtcttgaactcttgacctcaggtgatccacctacctcagcctcccaaagtgctgggattacagccactgtgccactgcgcactgagccactgtacactgagctactgcacccggccaaaatactgtatttcttaaattacagaaaaattgacccagtgtacagtcatatttatctagttcttgcgattcattcttgataatttaaaagctagatagaatttgcactctttttatatattcattgtcaattcttattcagtatatatgagtgactctgagtcagctggtgttcttggcacacgcaatacatactggattgagataggcaaagcccttactcttaccaagtttctgttctctaagcaagtaatattttgtagtgaatttagacaggaagtgacatttaatttggaacatacttgataagcagcgagcttttgttaagactgaaaggaagagagagagagctcatgccaagatgcgatcatccttggtttatcttatttttttcatgtttgtgtgtgtgtatcagggtggggggtggtggtggaattgagacagggtctcactcttttgcctaggctggagttcatagctcactgcatcttcaaacttctgggctcaggcagtcctctcttgtctcagcctcttgagtagctcctctaggactacagatgcacaccactacacctagctcactatgttggcctagttggtcttgaacttctggcctcaagcaatcctccgacctcggcctcccaaagggctgggattataggtgtaaaaagtaaagtagaggttcttcaaagagactttcttcctagtctaattaagaataattagtaactcttcttagaagcagtatttattcaaacacttatgctaacattcttaattatctgctagctgtaataaagaaatcaacgtactttatgttcttagctcctacaattaagcctaaatatttgccttggcatgcttataccaatccaagcaggcattaagtcatagactgttcttccttatttggaggtgtttttacctttatcagcattccacaagttacttcctccttcctttgttctctgcctttgcctcttttaaaaagtttaaaaactttttgaaaagttctaaggtgctagccaatcaggacaaatacagaatgtgaagtcctgttccagccaatagaaactggacacagcagtaaagtagatgcgtcaagttataaatgaccctgtctcctttgttcggtgtactctcatggcaaaactggtggcgagtgtgtcctttctgcagaaagtaaaaatggccttgccgaggaagttaaatttatgttcaagtgctatttatttacggcaccaaagaacaagcatttctaacataggcatgagtcatcatacccagccaaccttgttatgtttaagggataaaaggctagtatgagtaaagagtagtttagtattagacaaggttagagagagaggaaaggatttaaattgaatggaatttttgcaggtcatcaaagtacagaattttggtttaattacaaggtgaatgagaagctggtttagagaggagtcacgtgatgcattgttagtttttacagttcttaggtcttgaacggattatagcaaaagagaatacttcaggagaaaatgatggcttgaactgggtagttgagataaatgaaaataaatagtttttggatatgatttggaagtattttggatggaaggtttcagtaagaggaaaaatttgatagattgggtttagggcgaggagtggtgagggaaatagaaaaataaaagattactcttaggtcctgttatcaagtaactttgtaattactctgtattctcatgttagtgatctgttttttccacttaataatcataacattaaaattttacagtatagttgacccttgaataacacagaggttagtggtactgatccccccttgaagtccaatttgcttataacttttggctcccccaaaaacttaactactagtagcctactgctgaccaaactcttgattataatataaacagttaacacatattttgtatgtgtattgtatactgtattcttacaggtaagctagagaaaaactgttactaaagtcttaagaggaaatatatttactattgattaagtggaagtgggtcatcataaaggtctttgattcttgtcttgatgttgagttgactgaagaggaagagaaggggttggtcttgctgtctcaggtggcacagatggaagaaaatctagatgtaagtggatttgcatagttcaaacttgtgttgttcaaggttcaactgtataaacaaactctgggaatggtaatagtactctcatagtgttgtgagggttaaattagtaatacaattaaattacttaaaactgtgtgtgacacatagtaagcactcaataaaaactaattgctgttgttattttcatatcccacccccattctcaagatgtggttgtcattggctattataatcctagacttggcagagtataatttctaatagtatactttaaagatgctatgcacatgtaaccaccgccaaaatcttaattctgtttagtttgtatctctgaaggaatcatggtggtatgcatgtatatttgctttacaataatctcagtacaatgttagtaatcattttttaggtgattaaaatgtttatattaaaattgattttatttaatatatattaagtaccttctttaaaagaggcagtttgtgtgctaggaaaaatacctgatagaatactggaaatttaggattttggaggataaacgcatctaccaagattagctttagagcactcattcaatgctcatctcacttttgtttttaataatcctgaatatcacttgttgaaatacagatttggacttggctttggctttgatagtgcgtgtgttaactagtgatgacaactttaagaattggggctgggttcagtggctcatgcctgttttcccagcaccttgggaggctgaagtgggaggttcaagtgaagccacgaatttgagaccagcctgggcaacatagcaagacccattatctacaaagtttttattaaaaaattaaaattattggggccagtctaatcacttgagcccttaaaagcagagaagtttctccagctaaagtcagatgtgcagcagaaaaggaaatccaagagctttcacgtgtgagatggatttgatgtgcaatcactggctctgagatacagttgcccagatacaaagctaaaaagagaattctcaaagctaatagaaattcccaggtgacagccagcaaggaaatggagacctcagtcctacagctacaagaaactggattgtgcccacaatttgagtgaatcttcctataacccatgctgtcaacacagattatagcttggtgaaacctgaagcagagaaaccagtcaagccaacccagacttctgatctacagagctatgagataataaacatgtgttgctataatgaaaaaaaaaattaaaattattattagtccaggtgtggtggctcactcctgtaatcccagcactttgggaggcagaggcaggtggatcacttgaggccaggagttggagatcagcctggccaacatggtgaaactccgtctgtactaaaaatacaaaaattagctgggcatggtgctgctcacctgtaatcccagctacttgggaggctgagacaggagaatcacctgaaccctggaggcggaggttccagtgagctgagatcgtaccacttcactccacctgggtgatagagcaagactgcatttcaaaaaaaaaaaatctgattttcctcttctctgatcttgaccttatgctaaggagggattatttcttagactgatgcaaagacctccattctcttgagtttttcttttcttttttttttttgttttaaatgaaagcaagtttattaagaaagtaaaggaataagagaatggctactccataggcagagtagcctgttttttaaccctgacttttttcttagttatggataaggaaacttaaacacactcttgttttctctgaccagcaattagtatagatagtaactagtttaatggttagcaaagtaagctgagagtaaggtttatgagtaattcatgtttaatacaggctgaatgtcctttatctgaaatgcttgggaccagaagtgttttggattttggatttttttcagattttacgtttattatttcagcatcctgtttctgaaaatccaaaatccaagtgcttcaatgagtaggcagagcgtgacactggcactcaaaaagtttcagattttgtagcttttcagattagggttattcaacctgtagctaagagttggtcatatttgattcatcagttacaacatgtatgattctgagattggttttaaatgatttatttttaaaatgtgaaatgtttattccaactttcttccagccgtctttaaatcctgagtatgagagagaaccaaatcacaataagtctttagctgcaggtgtgtggggtaagtaattttttatctatatttgaggggcacaaaatgttgatatttataggtttcactttttgtgttttttaaaatagagagcaggctagaataaaactttctttttaaagtatttgtatttgatgtgcttagctacaaaaaaggtaacattcgtctttaaaaaggaggattggaatagaagagtttgaagtagttgatttgcacatgttagtatcattaaacatactcaacttgaatatgacttaaatgataataagttagtgtaatgaattgataccattttgagagcagctggataatgtaaagaaacaaactgagtttaaattaatttttagttgttcaaagttgaaaactttaactggaaatacttctgatcatagtgtgacatgaagttaatatttttacctatgaaagtggttacgtatatatatatacacatatatgtatagactgttacagataattgtataaatttgcttgtggagctagtctatatttgaagttatttgtctctgatttctgattttcaaagcttaatgagagttcttctagaaataacccagcccccatttttttttaaaagactgctgacagttcaatttgttagcattttacagaagattaaactgaactcatatagtacaatttagacagcttttttaaagattcaagtgaagtttaaaataatggaaaattttatactaagatttgacatctgaaaaataaaattaatcatttgatactaaattcagaggtgctcaatccatgttggaacttaaacacatgttcatttgtatttttctattgaaaatcaactcactaaaacaaaaggattgtggcttttgacagcatactagtcctaacagtaaaggcattattttaaactttgccacttcctgtgctatattgtatgtatgaggtgaaactcgggaattattttgttttcttttgatcttcctctttatttaagggctttttgagggtgggggtgggggtggtcagacacttttgttagaaccatgtgaatggcattgttttttctgtattgcaaattagtatttctaccactctccccaggcctacacgcccagacacacacatacccaaccaaaaaaatctcccaagctcctctcttaggtatgtttccttattattcagtttttctgggaacaactgattgcataagaatatagaaccacctggaaggtgttaaatagaatctctaagaaattaggaataatttggatttgattagaatgaaagttttaaaaatcaagaatgccagtgagcgtttgtcatataaaactatctatagatactattggtactgatcctgggttgatttaataatcttagaaatgatttagagacaaagacatatttgaaaataatgagagtaaaatgtattaatatgaagattttggttctactgtttcagggttggtctaaggattttgagtactagttgaaaagatgttcaaaaggaagatgtactctttactgtgtttaggtaaactaagaaatgtgtctgcataaacaaaaaaagaaaatggttaattgtggaatggttaattgttaaattcccagtacttcccataggaatacaatgaaactctcattgtatcacactttactattcctctctcactttcccccctgggttcccaagtattgttttccctattgcaacatttaaaatagctatgttcctgaggaagacgagaattttaggaaagacttcaatagagcttttctagtgctacttccttccaggtaagtaaaaatttactaacgaaaatataatatttattaaaaaaaaaaagcaatttgtccctgaaactataattttgtagattgaaaactggcagacttaaacatgatgccccaatttgagaaataccctgcggggaatgtagttaagtgatttataatatagctacataaattgaattctgcttagaacctagttggctttactggaaacaccctcatgcagcttatatctgtgacttcaatagtgtttttatgttaaccagaatcatagctattaggtacataaaattaatggttattaaatagtccatctccacgctgttaatttaaaactaaaacaggaattcaagctgcctatgagaatttaaaaataatgtaattgtttgattgatttctttggtgagtgaggaagaaagagtgatgtatgttcaagtgttagtgtgcagttgagttgagttgcattaataattagtggcgaccaggcatggtggctcatgcctgtaatcccagcactttgggaggccagggcaggtggatcacctgaggtcgacaccagcctgaccaacatggagaaaccccatctctactaaaaataaagaattagccgggtgtggtggcgcatgcctgtaatcctagctactcgggaggctgaggcaggagaatcgcttgaacctgggaggcagaggttgcggtgagccgaggtcgcaccattgcactccagcctgagcaacaagagtgaaactccgtctcaaaaaataaataaataaataaataaattagtggctactgatcatgtgtttttagaagtcctatggagtactgtttttgtgccagtgaccatgtcagcaacatactattggcagaacttaacatttacttaagatattaaaaaatcagaaatttcagtgactagtaattagcttaagcatggtcttcttccaactcagcatttatatattttttcagctccttggtagtttgatgagctttcttgattttagctcatatttgatatactacttaagaacataaaggttcattgctcagagttcttttggtttgttgagcattctgaatcaaagcaaattagtcaccagttaatataaatggattgttttctagagaattccaatatttgccacaagcatacagattgagtgacataattgcattcagtgaggtaaattatgatgaaagccaatggggattgattttattaataggaactttggtaaacagaattaagggaagggaaaattcttcgttggatttttttgacagtattctgttgatgaattgctttgtatgttgaaatgacttttaatatctgtcttatatgaaaacagttgttgaaattatagtgttttaagaaaaaagtagtacaacgtgttcatggttgaaaagggaaaattaataggatttgagtagacagcttgatacagcttgacccaagtacattttatttggtctgaattacttgttcaccatggaaattgttgatatttgtgaaatgcatttctttaagcatgttctttatatgaataacgttgagagcccccgttaaagggggaaagtaccatatcgattggtgttgatataaattataacagttagtgaaactcatttgactaaaactcacagtattgtaaaccaaaatagatttgttaataaaataaagacgttaaaaaccagctgggcgtggttgctcatgcctgtaatcccagcactctgggaggccaaggtgggctgatcatcagaggtcaggagttcaagaccagcctggccaaaatggtgaaacccgtttctactaaaaatacaaaaattagctgggcgtggtactgtgtgcctgtaatcccagccacttgggaggctgaggcatgaaaatcgcttgaaccggggaggcagagtttgcagtgagccaagatcgcgccactgcactccagcctgggcgacaaagagacactccatctccgaacaaacattagaaaccaacaacattcaaacagcaccaattgttgtaaaaatgatcttaaacattttttttggtattaaaactagtgttcacaatagaaatttgtttaaattgctgccttatagagtctttgcatttggtctgtgtatgtactattgtcttagtgataagttttctcttcaaattaattggaaagcttgctgggtgcagtggctcatgcctgtaatcccagcatttttggagcacaggatgggggtatcacttggggccaggagctctcatagggagacccttgtctctacaaaaataaaaaataaaaaattaactggacgtggttgtgtgtgtctgtagtcttagctacttgcgaggctgaggtgggaggactgcttgagcccatgatttccaggttgcagtgagctacgattgtgccgctgcactccagcctgggcaacagagcaagactctttctccaaagaaagaaatgaaaacttgattaattcagatactgattacccttcacttggctacatgcttttgttgatacattaaatttacctcttctgtcaaaataataggaaactaaattagtaactggcatcaatgtgatgatgactcttgacgtcacttggtatagtgcacacttataagcctcttaccccaaccattcagtgtaggtttactagtggagttggaatggtaaacattttgaaatatctgccacaggaacaatttccattttcttcattaatataatggtggaagaatattgagttcagaatcagatgtggctaacattagatcttttgcttattgattatttagattttgggcacattgcttaatctgagtgaatttattcatctgtgaggtgaggatgaccacaaaaattataatgagaaaagcactgttgggccgggagtggtggctctcacacctgtaatcccagcactttgggaggctgaggcaggtggatcacctgaggttgggagttcaagaccagcctgaccaacatggagaaaccctgtcactactaaaaatacaaatttagctgggtgtggtggcacatgcctgtaattccagctactcgggaggctgaggcaggcggaggttgtggtgagctgaaatcgcgccattgcactccagcctgggcaacaagagcgaaactctgtctcccatttaaaaaaaaaaaaaaggcattgttaaggttaaattgtctactatgtaaaaatatttggtcatgtcacaggtgtttaataaatgtcagctaattatgttgttcaaatccaataaatgaaggagattctagttgtagctttgttagaaggcaaaaatgaatttctaggtagtgggccaaagaatgaagtagttaaatgtagtgattgagtcagaaacttcatgtatgtagaaggtagctatatggagagtgtagtgaaaggaaagaggtgaggaattgaaatgtcaactctgaattatctgtgtggccaatttactttgtattatatgtggcagtatttttgttctaatttgtcttcctgagaattgggccagttccccgtcatcactgcatttatagaagaaaactaattcttacattcataggtatgggaagagcatgaataacaagacaataaaagtgatatttaatatttaaagtcaattatagggccaggattggtggtccaggcctgtaatcctagcactttgggaggccgaggtgggaagatcagttgaagccaagagtttgagaccagcctgggcagcatagtgaaccttgtctctacaaaaataaaaataaaaaggtcagttattgtcaggctacatttatttgcgaggatagagggaaataatgttaagaaaatccaaaggtcacatttgccttcagttgttctgaaatttgaacatgagaatacctgtgtaggtgaggttgatgtaataagcacatgaaacttatagaagatagtcacttactttctcattttatataggtattaaggtctgtcatcaatatataagttttctcttttaaaatgtaaacatttggggtcttcttcatataattaaccaagtcagaaagtaaacattggataatgtttgactctaagagcttaaatacttggcaaggttttcctaggagaatttgtggagaaaatctgtgaatagatgagccaatttttaaataatataaaatggggatacatgatgcaaattaattcttgccttttagtcccacatcccttcttccattacttacaggttattgttaccattaagaacacttctttttcttaaatgagcaggtttatgtcgattattcagagttgttacacaggacatagattggttttatcatgtctatcttaaagtttttctttttcttactcttaccagtcaacctaaaattcttttttccctctgatatctaattgcaggttaagcaacctgaaattcttgcaaaaggacacctttaatttgaattgtaattggaatcctatgctagtgacagtgtatggcttttctgtattgttttctaataattatttgaatatgaaacattccacagtaaatcccagacaagagctattgtttttcattttataggtgagagattaagtaacttatataagattatacaactggtaaggttggagctagtattcaaattctgataaatctggtacaaaagtacacattcttctgtaatatttaaatgtgaattctttttgcagtttttgagtcagagtcttgccctctcccccaggcatgagtgcagtggtgcgatcatggctcattgcagccccagcctcctaggctcaagcgatcttcctgcctcatttttaaatttttcatggagatgatgtctcattatgttgcccagcctggtcttgaactcctgggctcaagtgatccatcccaccttggcctccgaaagtgctggaattacaggtttgagccaccatgcctggcctaaatatgaattattattattttaaatggagtctcacactgtcgccctggctggagtgcagtggtgtgatctcatctcactgcaacctctgcctcccgggttcaagtgattcttctgcctcggcctcccgagtagccgggattagagaggcctgccaccacacctggctaactttttgtatttttagtaaagacagggtttcaccatgttggccaggctggtctcaaactcctaaccttgtgatccgtccgcctcagcctcccaaagtgttgggattacaggcgtgagccactgcgcccggcctaatatgaattactttttttgtttttttcttttttttgagatggagtgtcactctgtcgcccaggctggagtgcggtggtgtgatcttggctcactgcaacctccacctcccgggttcaagcagttctctgcctcagtctcccgagtagctgggattacaggcgcctgccaccatacctggctaatttttgtatttttagtagagatggggtttcaccatattggccaggctggtcttgaactcctgacctcgtgatccacctgcctcggcttcccaaagtgctgggattataggcatgaggcaccgtgcctggcctaatacgaattcttaataagcacaataacggtatatccctcccctttcctctcagtccctatcctctttcttcagggacttttgtcatctcttactctgctacctactcttctgtgaatgatttcttaggtttcactttccttctttatagaatatttcatcattctttgtactgaagacctcattgaggaactagccagaatatttcttactcctaggcatctaggaatccagctttaggaaaggtgaaatttgtactcagaaactatattgaggcttaaagatagtatatctacttgcctatctagttttcatgtcttctgcttccttgtttttgttttgagacagggtcccactctgtggcccagactggagtacagttgtgccatcacagctcactacagcctcaacctgggctcaagggattctcctatgtcagccccccaagtagctaagactacaggtgcacatcactgtgtctggctaattgaaaaaatttttttttgtagagacaaagtttcactatattgcccaggctggtcttggactcctggactcaagcggtcctcccaccctggtctcccaaagtgctgggattacaggcatgagccaccacacccagcctacttcctggatctgataccttcatatttataaaaatttttatttcttcttatatcttcagctttccacattggatcattttccttctgcctaaagtacattctttagaattagtaaggatcttttgaattattctatttttatcaaagttgcatttctgccttctaccatatctggcattttcaagtcctgatccctttgaggctctatgtggtagattaggtcctcctcagctgttaggttcctttgtgtacactctaaattgaaactttttatttacttctctagaactgtgtgttgaaatcattttcttgctgatgactctactcctattttatatagttgtgtttggtttcctcccttacagtaattttaatataagaatctagaagaagataaacttgtgtgcttagccacattgaactagaagtctctgttagccatgtttaaacttacttagttgtagtatagtgatagaactgccccctgctttaacacctggattcctctcagatgagattacctttcacattttgtagcactgatcattcctcagattcctgggctttactcaatttagattttgagttacatgctaagattttctctcacattttattaatgtcaagaattttttttatacttcatccatgccattatcatctgtttaccaaaaataattggaaatcttacattgttgagtacaatcctaatattatttactattctttgtttgagattttttttttttttttttttttttgagatggagtcttgctctgtcgcccaggctggagtgcagtggcgtgatctcggcttactgcaacttctgcctcccaggttcaagtgattctcctgcctcagcctcccgagtagctgggattataggcacatgccaacacgccccgctaattcctttttgtatttttagtagagacggggtttcaccatgttggccaggctgttcttgagctccggacctcatggtctgcccgcctcatctcccaaagtgcagggattacaggcttaagccatcacgcgcagcctgtttgagatctttattcatttttgttttgttaactttgttgtgtaatatcagaaaagctatactttggtagtaatactttgtgtgtttttgtgtgccagaagttgtcttttttagccctttatattgggctttttttagaccgtcaggaagtttcaatctttaccctagtaagtcaacatgtgtttaatttttggaaagatgaaccttttctcagattattttaagcccttgttctttttatcctttagcatttcaataggtgaagcaccataccggctttatcttttggagagcttgaatcctcccatgaactggagagtccctccgggtttccctaggagtccatatttagttttgggttttgagatgatccatgaggaagcttgatttagtttttgaggagggaatcattacagatatctacccagctcactaattcacatgatcttatttaatgtggagaacttaatttattctaaactttccagctgtgaaactgatgcttttaaaagtttttgtaagggaagaaagaaagacttcactgcaatgtctgtttgattacacacacacattgattaaattataggaataataggtatttttggcaactgcagtagtcttgagaaaagtctgcctttagcaattattcgtagtatttatcttcagaaatcaggattgagttggttggtctgcattcatataatgctttgaatgtagataaatggtcaataaatacatgaatgaattgatattgtgaaatagaattctcagtcataactgaagtatttagaaataaaaggaatgtaatttcttgcttattggtaataactttgtaagtggagtaaaaagaatgaaaaaattgaaattttaattctcttcaaatggggaagggaaaatagaaatgtattttatattctaaatcttaagagtcattaggttgatgtttgcaattttttatagttaatgcaaggcatgttaaaatataatttgtcttggttttaacattctgagccactgtgtagcagaatttatctgtattacttgacattgcccaattcttcctatattctgtgggataatgttttagctttacttgttcaattggaatatagtttgtacttttttagtttagttattttacccaggaggcagctgttagttaaaaaaaaaaaaaaatttggaatatactgttcttttggtggttttattctatactaaaacttgaaattgtgagtgactcttggtcatgctttatttatgcagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaagtaagttctaaattaccacaaatgtaaattttgagttgataaccaatttatgtcctatggggggaaatgttaaagaatttaaagtgtgtatggaggtacttcgtggggtgctgagttctaggtggcaagagttgacccatatgtgctcttaattatctttgatgtggtgtgtgcgtgtgtgtggttttattgttttagcagtagtaagtgaaacttaaaaattttttttttttgctagatgtagttgtgatatatttgcttaatgataatatataatgctgttttacctggtgctcagttttaggttttggaaactcacatgttttttcttattctcaagtgaaagaaacccaactttatgtagctttggaaaaatagcaatttagttagatacctaaatgttcagtttttattttatttgttgaaaaagaaagggacagagaactatgtaggaataatgcagtgtgatacaaaaataattgtttccatgagcctagcgtagtcatttttgttttataatattcactgtttttgtctttctcctgtaacctgtttttgatagccattaatgtttgtgtgtttttctttagcctacacaatggaaaagccaaacaaaagaaaataaagttggaacttctttccctcatgagtccacatttggcgttggcaactttaatgcttttaaatcaactgccaagaactttagtccatctacaaattcagtgaaagaggtatgacattaaaaatcacacttgaggaatgtaacattttaattatgatagtttaacagtgaataaaaggtagaaattcattaaatgaatacattaaaatgagtttcattccttcagaaaactggattcatttacttcatttgttaaccaattttgcactttgggaaagtaggaatcatttaaaatattttaaatgaaaattcccagctcattcctataatcccaacattttgggaagtgggacaggaggatcacttgagcccaggaatttcagaccagcctcggcaatatggtgaaaccctgtctctacttaaaaaaaaatagctgggcatggtggtatgtgcctgtggtcccagatcttgggaggctgttgtgggaggaacacctgagcctgggaatgtcaaggctgcagcaagctgtgattgtgccactgtactcaaacctgggcaacagagtgagaccctgtctcaaaagtggtggcagagtggggatgggggggaattccaaacatcctaataaacaaagaataattttttggggggtggtaggagggacagagtctctgttgctcaggctggagtacagtggctcgtttgtggctcactggtgccttgacctcctgggctcaagcagtcctcccatcttagtctcctgattgtctaggactacaggtgcttgccactgggccagctaattttttactttttgtagagacgaggatcttgctatgttgtccaggctggtctcaaactcctggtgtcaagtgatcctctctcctcagcttcccagttcctgggattacaggcatgatccaccacacctggaccaagagtaatttttaagaaaacaattaagaaaattgcaattttcttaatttgatacttgtgatagttaccttgtaggattgaaattaactaatgaggatttgtattgtataatgtcttcttttggggatgatggacattttattactattaacactgattggggggaaaggaggaacaagagagaaaggtatgtattgttactgtactgactgtgagtacctggtagttcaggtattttctttctcatttgatcaaggttttgaaactcccagaacagggagttctctgaccagtctagtgtcaaaggacacccatagcacttatattattatacctgaaattgctttgggtactgtattggaacccctcatatactattttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggctgggcatgtagccactacgcctggctaatttttttgtatttttagtagagacggggtttcaccgttttagccgggatggtctcgatctcctgacctcgtgatccgcccgcctcggcctcccaaagtgctgggattacaggcgtgagccactattttttatttatgatctcagacagaatttttgagctttgagggaaggactagcattcctagctgcttaattctgctaagattagttataatatacatacattaatgccaacaagtaagcattattatggtttgtttccgtgactaataatccatatgacacagagttttaacattctgttttgtgttccactgtcaaaacaccaaagaaccaaaaacaaaaggattctttctcctctcctccctgccatctcacaaacattttaccaggtgaaatccactcttataaaccctatgtatgtgtataaataattataaaatacattttattggagctgttactgaactctagaactctgtgtaacacagtttgaaaagctgctcttctgtgtattatagaaaagtttaaacaattctaggatgcatttataaaataatagacacctaatttagaatcatagttctgagtattatcagaccttcattgtttgtgggataagaaaattattttgttgactcattcagtaggggaaaaaacagggatagaactagactgtaacatagacattataatcaattttattttgtgagtaaaggtaaaataggaagctgtggtagtagtgaattttatgttgacattgattccttggctacatatttatcagtatttctgaatttcctcttagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggtaattgaatttatagcaatacttgatttgacattgatatgtcattgaaatatttgagcatgtattaggaccttggaatacatttgaatcatttccttggaaagaaacttggaaagccatttgcataaataatgacttggcttctcccctcctctctccttttctcgcctccccccttccccctcccccttcccctctccccttcccctccttcccccctccccgtccttccccctccccttcccgtccttccccctccccttccctccttcccctttcccccttccctccttcccctttcccccttccctccttcccctttcccccttccctccttcccctttcccccttccctccttcccctttcccccttccccctcccctccttcccccttccccctccccctcctcctcgtttgagacaaagtctcactctatcacccaagcggagtgtaagggcatcatcttgggctgcagcagactccacttcccaggttcaagcaattcttgttcctcagccttcctggtagctgggactatatttatgtgccaccacacctggctaatttttgtgttttttgtacgtttggctaattttttcattttttgtagagacggggtttcaccacgttggccagactggtcttgaactcctgacttcaggtgatccgcctgccttggcctcccaaagtgttgggattacaggcgtgagccactgtacctggccatgacttcatttctaaagtagatttgcttcattctatagtttctgtggaaaaatacatttaaaaagcattcttgtttatatctgctctcttttgcttgtcccatcttgcctgccttcatgcttttaattttgcatttgttgtatagatatgaatacttagggtaagaaagctttggatatccatcctggcttaatttttcattcctaaatttaacaattataagtattacgtttatggttgttggtttttttttttttttttagagttttgctcttgtctggagtatagtgtacaatggcatgatcttggctcactgcaacctccacctcctaggttcaagcaattctcctgccacagcctcccaagcagctaggactacaggcgtgtatcaccacgcccagctaatttttttgtatttttagtagagatggggtttcaccattttggccaggctcgtcgcaaactcctgacctcagatgatccacccgccttggccttccaaagtgctgggattacaggggtgagccactgcgcctggccgcatttatgtattttcaatggaagcttagttaggatctattaaaagtttttaataactgtattctgtagaactcattcttttttttttttttaactctctaaaaatcaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacaggctagtatttgtttgtactttttgctcagcattttctgtattcgagatttcaatattatagagtttttacgtgatttaacaggtttattggaatacaacttacgccataaatttcacccattatgatatacagatggtttttaatatattcaaagtagccctttgttcactcgcatttacttttcatttgcactctgtcctaggcagctactattctttctatagatttgccttgtgtatgtatcttatataagtggaataatatagtatgtgatttttgatgtctagcttctttcactaagtataatattttcaagttttatttgcattgtaagcacgtcagtactttgttcctttttattgctgaatagtacactatatgactatactgcttttttgttcatcagttgatgaatattagttgtttccacctcttttttttttttttttaacagtaggctctagtccaatctactttttgactgttttggataatgctgctgtgaacattcatatataagttcttgtgtggatatgtttttatttctgttggatagatacctaggagttgaattgctgggacatatgatagttgtgtttcacatttttagaaactgacaaactattttccaaaatgactatgtcattttacttccttatcagcaatatagaaggttctagtttctccacattcttaccaacacatggtaccatctatctttgattacagtcattctagtgggtgtgaagtatgatttccctaatgactaatagtgttgagtatctttttatgtgcttattggccatttatcctcttaggagagaaataactgtataaatacttcgctcatttaaaaattacattttcttactaagttgtaagagttctttatatatttgtgtataagtctcatatatgattggcagataatttctcccattctgtgagttttttcattctctcagtagtgcaatcacctcccacccacccccacccccacccccacaggcaccttttgagatgaggtctttctgtgttgcccagactggtctcaagtgatcctcctgagtagctgggattacaggcttgcaccaccatgcacggcttcagtggtacctattgaagggcagaaagttttaattttgatgtagttcatttttttccttgtatggtttatgcaggtttcctggatgatgtgaggtaggagttcagactcatcctttcccacgtggacagcgaattgtcccaatatgtgatttatttttcgagacagtgtctcactctgtcacccaggccggagtgcagtggtgcggtattagctcactgtaacctctgtctcccagggtcaagtgatccccccacctcagcctaccaagtagctgggaccacaggtgtgcaccaccatacccagctaatttttgtatttttttgtagtgatgagggtttcactatgttgcgtaggctagtctcaaactcctgagctgaagcgatcctcccgtctcgccctcccaaagtgctaggagtacaggcatgagccacagtgcccagccagtcatttagtttttattgtaaattttttttttttttttgacaggtcttgctctgttgcccaggctggagttcagtggcaggatcttggctcactgccacctcacctcctgggttccagagattcttgtgcttcagcctcctcagtagttgagaatacaggcacacgccaccatgcctggctaatttttgtcttttagtagagatgggatttcatcatgttggccaggctgttctcgaattcctgacctcaagtgatccacctgcctcagcctcccaaagtgctaggattacaggtgtgagccaccactcccagcctgctgtaaacttttaacagcactttttgcttccatcagtatagtctaaagcgttttaaaaaatagtgatctcttaagtggtttagtcttagaattgaagagtattcatatctagaatttatttttgtttttttgtagttaaaagcaggtatttttgcagaaatgacatacccttactgtattccttaaataaccacatggttcggcataactaaaagatgttgaaaactacgaaagcaaagaaagttaatagtttatacccttagattatcatattattattctgtaattgctttgtataaactgatttttttttaacttaaaaagtcttacatcttctaagagcaagcttagggctaagttacatttattaacagcccagttgattgacttgactttttgccagttctagaacctcatttaattctaagacagtggaaaactgggttatatctcctcttggataacttttgtggaatttatttataatttcaacttctattttaattaagaacataagctacatgaggccaaacattttgtccatcttgttcactatatctagcacctagaatggtgcttggcacattactttgcttaaatttgttaaatgaatgagggaagtaaatattgcagtatttttctacctgttatgtaaatctgtagtttttttgaggaatattttaattttactttttatttctaattttttcaaatgttttaatagtttatatttctcctgccaagggttatggctgcccccttaaaaacaaaaaacaaaaaaaacatagagatgagctctcactgtgtcactgtgtttcccaggctgatctcaaaaactcctggactcaagtgatactcctgcctcagcctcccagagggctgggagtagaggcgtgagccacgacacctggctagatcttctttcgttcttttctttctttttttgaggcagggtcttattccattgtccagcctggagtgcagtggcacagtgatggttcactgataccactcaaatgatgctcctgcctcagccattggaacagctgggattacaggtgtgtaccaccatgcctggctaacttctgtattttttgtagagatggggtttcgccatgttgcccaggctggtctcaaactcttgggctcaagcgatcctcctgccttggcctcccagagtgctgggattacagccaccatgcccagcccttccccacgcccctcgctttttttcccttagattgctccttcagaataaatctttatctttctgtctttaatcatatattattactttatcttcgtggttacttttgtttcccttctccaaatcatgtcctgttttgcttcttaaatgtggctgtaactattgtatgtgaatgtgtaggcatttaattttgtaggctgggcgttgtggctcacacctgtaatcccagcactttggaaggctaaggtgggtgggtcacttgaggtcaggaattcaagaccagcctggccaacatggtgaaaccctgtctctactgaaaatacaaaaattagctgggcatggtggtgcatgcgtgtaatccgagctattcagatggctgaggcatgagaatcacttgaatctgggaggcagaggttgcagtgagccgagatcgtgccattgcactccagcctggatgacagagtgagactgtctcaaaaaaaaaaaaaaaaagagtaagttttgtatttggacctttctcctaaaataatttattgggctgatgataattgcatttgagaattaatttagctagattaatttataactaacttaatcagatatctataaattcacttgtttagacaaagtataatttattgtacatttaatgtgaacagatgaataaataaccacactatttttattgcctcccaaattgtggaacttcatgctaccacataatacagtttatgacttgtgactaacaggcttgagtgatggctgaaatgtcaaatacagaaaaaatttagcaaacatgaattcttttttaaaaagattaacataaacagatatttcagaatttttttgatcattctaatgaatcaccttgtttttccccctctgccatttgaagccactattctatagtatggatataaattgtgaaactgttttcctgtgatcaagatttatgtgtgttcacgtcctctctctcttctctccccttctctttccctttctctcccctttcctctcctcccctcttcctctctttcctttcctcttccccctcttattccaaataatgctgttatcagcatccttgtatttatattcttgaatatttgtgtaaatgtgtaggtaacagattactaggagtgaatttgattggtcagatggcatacatatttaaaataatcagctactgccatgttacccaaaaacattctgataatttgcactctcaccaatgatcattgaaatatttctagtcacacaattggtagaaagggaaaaggcctgtgtgtagaaaggagaataaaacacaaacatatcagatattctaatgatagtaaaagatgaatgttacctcttaaggagatagagcataggcagtaaaagaatacagataaaagatttttttaactcctagaatctattcattaaggccatagtgagaaagttgtcacctaatatcttgtcttctgatttcccttcagtacttagtagcaaaaaaacagttggcccatacctttagaaaatgtttcttataacccctaatagacatatctaatgtttaattatatttttttaatctgcagagcagatgtttagtgcaggaagcattttgatggttcttctttcatttaggaagacttgtggaagagagactttagtttcataacttgacagaatttggttctctgtgactactaacaggagaaaatggagaggatgagatttagaaactaaggcaaatcaagatgaaaacatccggctggggacaatgactcacgcctataatcccagcactttgggaggctgaggcaggtgggtcacttaggccaggagtttgagaccagcctggccaacatggtgaaaccccatctctactaaaaatacaaaaattagctaggcgtggtggcgtgttcctgtattctcaactactgaggaggctgaagcacaagaatctctggaacctaggaggtgaggtggcagtgagctgagatcgcaccactgaactctagcctggacggcagagcaagactccattctcaaaaaataaaaaataaaagacaaaaacatcctaaattggagtaagctctagagggagggggaaaaaaaaacaccccatactgcatgaagagatagtatcagtgatgacctacttgaatgattattttagtatatatgttttaattttttttgagactttatagattacattgttttcgtctttttaaaacagtggatacttttcttttatatttaggttactttaaaagttttaaccaagtttttttcccttaaaccatatagtttaaactataaaaagagagagttatgcatacgaataccattatctagtgtggacatgaagatgaagggggcaaacaataagaacattttgttatttgccaagaatagaataaaattgtggattcaagatttcagatttggtagccgctagttggaatagagggatagttttatagaaatgttgcacttgctgaaaaagatcctaagacaagtaaaggggctagttgatatgaaactgtttttatttaaatttcttagtttgagtttccttgactgtttaagtagaatatgtgtttgtaaatgtttcaaagacgtatatcaatacctttttccccactcttaagctaagagagttaatggcttttagattttaggggtttttttccctgtcaaaatggaatgttacttcttttccattgcttcatattttctgtaaactttgtgacttcttaagttatatacatataaatactcatattagttgaattcaataatatggggcagtgatagtttttgtttttgttttttttttgagatggagtttcactcttgtcacacaggctggagtaccgtggtgtgacctctgctcactgcaacctccacctcccgggttcaagtgattctcctgcctcggcctcccggaatagctgggattacaggcacccgccacaacacctggctaattttttgtatttttaatagagacgaggtttcaccatgttggccaggctggtctcgaactcctgacctcaggtgatccaccgccttggcctcccaaagtgctgggattacaggcgtgagccactgcgcctggccagtgataggttttttaaggataatgcttttcaaatattaaaatatgaaatattcaatactaaggcacatagatcattcttagttttattgtcaagttttagccactttatcagggtatcgaggtagcctcaacatcaaagggatacagttgtcaacttgtttaagcagacaccaaattagtggaagtaaatgctaaagaaattcagagggtttggggatagagatcattatgacttgggtaccagtcagaggtttctttctttctttccttttaaaatagttaattgtataaatatttattttttagagacatggtctcactgtatctcaggctggtcttgaactcctagcctcaagtaatcctcatgccctggcctcttgaattgctgggattacaggcatgaaccatcacacctggccctagtcagaaagatttaattgggacctaaattaaatcttgaaagggttagacgtaaataagggcaagcgtgctagaaaaagaaaggatgtaaagacatggttagaatggtgtatatacctagtttgttttaagggtgttgagtgggatattttgacacaagcaggcaatttactcactgaagttaaagatcatattgaaaaggcaggactttagagatgtcttatacttggtttgtgatagagtaggaactgtgacccaggtcttctaacttctaatcctagattttctctactgaggaatttgaatttgtgaccatggcacaaacacagttaaggagtttgttctttagaaagtgagaagccaccgaaaatatttatcagaggatggtagttgtgaaactggtatcaggatgatttggcaatagtttgaaggagagtgggaaggaataattgaaatgaaaaagcaaagtacagataagggttacagtaatatagtcagtcatgcattgcttaatgacagggatatattctgagaaacgtgtcgttaggtgattttgtcatggcgtgaaactcatagagtgtacttacacaaactagatagtatagcccactacctacctaggctatatggtatagactgttatttctaggctacaaacctgtatagcatgttactgtactgaatattgtatagtatttgtaatcataatacagtggtatgtatttgtatatctaagcatatctaaacatatacaaaggtacagtaagaaaatggtattacagtctcatgggattatgcatcatatgtgcggttgtctgaccaaaatatagttacgtggcacatgtttgtatgtttaggggggaaagggaaacacagattgtttttattttttcttatttttctttttgtagaaatggagtctcactttgttgcccaggctggtcttaactcctgggctcaagtgatcctcccacctcggtctctcaaagtgctggaattacaggcatgagccaccatgctcggctagattattttgaaagctatttcaggaacagttaaaagctacagcctctggtggagaagtagaaatacttgccttctgttatattctctttcataatagttgataattttttccatctgcattattgcttagttacgattcagtttttaaaagtaaaacagataaaagtttggatccagcaaaagagcagttagattgttttgctagtctagatttaatagtctctgtattaggtgtcattgaatggtaaaagtgaatggaaatgctattccaaaaggaggccatccagattaaagagtaaagatagtgcattggaagaagtcgtggctaaaaggaatgaaagaagaaatgattaatgctgactgtgacatttttgttcagaagcaacaaggtgctgtgcaatacatactaatttgggagacagaaaaccaaaattctatttgtctttgccatcaagtaagcaagttattttacttatatgatcttgattgttcatgtgtaaaatgtggatatcatgttatgttttattcaaggtctcagatattctgtgagactctgaaaaaaggtctaaaagtctataagcagctattgtgtagcaggtgcaagttaaaagatgagtaggtgtaaataagaggggacttaaacgtttgtggaacaatgtaattaaatgataaaaactattaactctgtttttcaacataactccatcaagttcaagacccttttgtaagcaatgatagcagtcatttagaccatccctgaagaactgagggccctggcagtttaaccgtgtcagtgctgtcttttttacattaactgaagaaaaatgggccccctctaaaatttaagattaggaaatgaagtcagaaggagccaaatcaggactgaaaggtggatgcctaatgatttcccattgaaactttgcaaaggtgcccttgtttgatgagaggaatgagcaggagtattgtggttaaggactctctggtgaagctttcccaggcatttttctgctaaagctttcccaggcatttttctgctaaagctttagctttccttctcaaaacactctcataataagcagatgttactgttctttatcccttccaaacaactgttgccatgacctttgctcttgactggtcctcttttgctttgagtggatcccttccacttcttggtagctagtgctttgattgtgatttgtcttctggatcatactggtaaagccatgtgcagttctttgaagaaatgcttcagaatcttgatcccacttgtttaaactttccattgaaagctctatttttgtctgcagatgatgtgggcacacattgagtggaaattattcaactttaatttttcattcagaatcatgtaagctgaaccaagtgagatgtcttgtctgtggtattggctatttctgttgttaatcgtcagtcctcttcagttagggcactaacaagattaattttttccttgtcaattgatggggatgatctgctgctgcttctgtgagggcttcatcttcagaatcacctcatcttttcttaaaatgagttatctatttgaaatttcttgtttccttggggtattgtccccataaacttttcgtaaagcatcagtgatttcattattcttccacccaagtttcaccataaatttggtatttgttcttgcttcgattttagcagaattcatgttgatctgataggggcttttcgcaaactgatgtcttacctttgtggtgccttaaacaagattctgttgaaacatgttatcacaagttagcacaagtttattttggtgcagaatttttttcttgaaattcttgcatagtttttccatgatacacattttttatgaactttttgaagactccttgtaggagtaacagaagtacttaggggtttcattttttaaaaacaaaccctttcatatcaatacaagatatgtggccatataagaaacaagcttggaggtttcctgatcaaatgaagtagctattgatgcagtgttcatgactgcccaagtagaaaacctaatgagtagtcagaaatatggtggtactgaagaaaaagaggagtgatattgctgttacttttagtataagaatttagcagatttgcttcacatctgttaaaagtttccagcctgaagagcctttgacaccaaggattaagcagtcaaggagttcattctaattttaatatcagtttattaatcttacctgtttattcattttcagaaagatactcaaagcctgagctcaaaaatccttttgatgtgtcttggggtctttgtataatggatcctggtggatcatgttttcttatacataatgtaaatgatactgtcctactcagggtaagctttacattaaacttaatttcctctccttttcagattgttaaaggaaatgggctggcaggaagacagtgaaaatgatgaaacatgtgctcccttaactgaggatgaaatgagagaattccaagttattagtgaacaggtaagaaaacctgaatcatacaacttcacttttaaactgcccttatttagaacaatataattatatgtaagcatggagtgggggagatttaggaatttatcacgataggtcagaattgcttttaaaaaaaaaaagagggaggacaggcttttgctatggtgtccagctggcctctagaactcctgggtgccaggtgatcctccaaccttagcctctggagtaactgggactacaggcaggaaccactgcacctggttgaattgactttatagaagtctgcaatagtgacttatttaaactattgggtgtgcaatagttaggaattagtgtaagtgatgtctatggattagtcattttccagaccttttttgttttgttttttgtttttgtttttggcttttctgggggaggagcaagagtgataagaagtagagagtgttagtagcttcctaagtaacttcatcttttatccttttcttgcacaagagtatttcatattctaaaacatcttgcttaatgtctccctagttacctttctgaaagagtattagggaatttttgttagagcatcaggaagttgagatgctttttttcaaatcgattatttgtttatttaaagagttggggtctcactctgtcatctaggctggagtgcagtggctggtcatagctcactgcatccccaaatttctgggctcaagcaatactcttgcctcagcttcctgagcagctggggctactggcttgtgccactacactgggcttattttctgtctttaaattgtttctaatttgggccaactatcttttttcttctttgatgatgttttgactcaattcttatttattaccaaccttttagttatgatttctcattttcagaaatagagaactgtattttttctagtatcttcatctccggttaaacgagacaattttgtaactttatatacctcattctactttacaaactatgaacaaagcagattggggggtgtattaatttaggtcagaataataaaaataacagatacagcttaatggtttctgattatattctggtaagtccctgaaggtatttattacagttgtcacttgaggcaataaaaatgtgggaaagtttagtaccttaatcagtgtgacaattattactcacatctactttgtctggatccagaattttttcagaaatatcattacttgtgtagtttttgggttaggatacaattttattatattcatgcttatattattacagtaggtttgtaactcttgagggataatttatttattttgctgttaacattttagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaagtgtttgttgttttttaaaaagtgttttctcagatggctgcagtgtttttgctatttctgcataaataccctacctggactccccagttttcaccagaaactgttatttttttttgttgttgttcccactgagactgatggtgatggggaaattaaaaacaacacactagcacactcccacaaaacttgaggaagagttagaatggtaataaaatattaaatagaccttatacttaaaataaggtttcactatataatttgtcacaattcaatctaatcagctaaagttaaatgtagttagaattagccacaggagaatgtaaagcatgctttgacgaagctatcggtaacacatattgaatgtctttgagactcttagattgtactatttgcttaatagattaatgaaatttatcagatacaacctgtatttccaaaaacaagctagaaggaacctgaggaatgtggtttacatttgagatccaccttactgtgttttctactttcagaaaagattctgtagttttggtttttggcatctttcttatactcagttttttctgccttaattcccatttaccagcagttaactcatgtttattgtgctttcatgcattgtgatatggaatgtgtttagtaatttactccttataaatatggtaaagtacagtggta

SEQ ID NO: 376 - DNA, 134930 bp, Homo sapiens
aggtggctgtccccgcacggttcccagctaattccccgctaccgggttgcggccggaagccgggcgccgcggctctgcttccctcggggtgagtaggggcagctcgccggaggccggcgcagagctcgggccgaccagcctggcagggccgcaccgcgcctggagcgcgagggaaccggcatggacacgccgggagtcggcctctgctccggttgtgcagccgccctgggcgccgggagggacagccccatgaccttgtcacctgggcccggcgcgcggccacgtggctcgggtgactcgcattgccccgcccccctgcagtgacttctccagtttggcacaccagtgggctttcatgtgacctgtccacttcagtggcacagtcttgcaggcacccgagtgggcagagctggaggagggccggaggtggctcacccagacgccttcaccccctggtggccctgtgagttccgaggcagaagcagctggagctggagcgtggtctgggcaagagcagggggcgatgcccatatcctggccctccacccggtcttgcgaacgtgccccagaccgctgcttatctccagcatcttgcagggccctgggcttccagatcacacagtagatatgtgctaacagcagccagtgtgtgtggagagcaacctttagataagacacctagaacagccctctcccagggttaagtggcatttactttctactaacaagaaagtcattcaacaagtatttattgtttacctccatgatacttggcacttagtaggtgctcaagaaatatttgcagagttgaagtgaattagactttatctgtggcttcatatgttttatttaataattttcttggggctggatgtggtggctgatgcctgtaatcccagcactttgggaggccaagatgggaggattgcttgagggcaggagttcaacaccaggctgggcaacatagtgagactcccgtctgtattaaaagaaaaaaaggaaaataaataaaataattttcttactacagtggttctcaaactttagcatgcaccagagtcacctggagagctagtaacaacacacagtactggaccccatccccaaagtttctgattctgtaagtctggtatgaggaccaagaattggcgtttctaacatgcacccaagtgatgcagttgctgttggtctggggaccatacgttgagtaccactgctttataggaaaaaaaatcctgtgaacttaaagcactatctcttcacacctggttacgggtctttctgtctttatttgccagttttacttttttggtgattgtaaatatgtgcatattactttgtacactgttaactccctccatattaatttatatacagattttaatgtagtctatacttgtcatttttcctggttacatcatattctaccttattgggtcattctttgcttggccatttctcaactggcctcagggatgtgcgatttgatctgtactagaagagtgtgcatattcttactttctgctatgcagtcattttcttgtcagacaaaggacctgtaagaatattagttggggccgggtgcggtggctcacacctgtaatcccagcactttgggaggctgaggtgggcgaatcacttgaggtcaggcgttcaatgccagcctggccaacatggtgaaaccccatctctaccaaaaatacaaaaaaattacctgggcgtagtggtgtgtgcctgtagtcccagctacttgggaggctgaggaggagaacagcttgaacccgggagacggaggctgcagtgagccgagatcgtgtcactgcactccagcctgggcgactgagcaagactccgtctaaaaaaaaaaaatttagttgggtcagccatccatttcttcaccagggtaactcactaaatatgcctcctgggttaaggtttccatgttgcagggactccagtggcctatttcagggcccagcaagctgcttgttcttgtgcactttttgctctcttggtgggagcagtcatacatggattcaagttctgcctccatcacttaccagctccttggccaagttttctaccttttctaaaacaccacttccttatccatagattgaagctctaatagcatgcacctcggaatctggttgtgtgagttaatgagctaataagtgcttggtactgtagctctcccgttggaagctcactctcttctcttacctgctgcttgctctttgcatctggctttgccctattctccctcagtctgcctttcctaggatggactgaatggaggatttctattccttgcctgggtgagaattatttttgttgtctattctgggaccttggcatcagtcagggattcctttttttattttttgagacagagtgttgctctgtcgcccaggctggagtgcagtggcacgatcttggctcactgcagcctctgcctctcgggttccagcaattctcttgcttcagcctcccgggattcctttatttaatcaacattgatttaaggaccttgagtgcttaggcatcaaacactaggaaagggagtttgattaaaatttggttcctagccgggcgcggtggctcacgcctgtaatcccagcactttgggaagccaaggcgggcggatcacgaggtcaggagatcgagaccatcctggctaacatggtgaaacaccgtctctactaaaaaaaatacaaaaaaattagctgggcgtggtgccgggtgcctgtagtcccagctactcaggaggctgaggcaggagaatggctggaacccgggaggcggagcttgcagtgagccgagattgcgccactgcactccagcctgggcgacagaatgagacttcatctcaaaataaataaataaatacaatttggttcctggactacattactatcttagggagggcagactgtaaacctgctcaggccaacttcacacagtcccttgctattgacttggtgtctttggcatctttccagacttgaggcatgatggtatcattcactttgtgtgctttctatccatatcagggaccaggttcttctgaagaccctatcactctctccaagggtatttttgggtcttttttcagttttgggggcagactagaagaaataatgctcattggtataatagtctctctaggaaatgggaggaggccatggtcacttttcatggaactagagacctaagtgccttttctctgtggtaattctcatttgtgcaccaaacagggaaaggtgattccaggcctttagtcctgaaatgtagcatagggagagggctgccaatggatggaaactgaaaaggcctagctagtcactgactccgatgaacagtaagtgcttggtttcccatttagttctgtcaaggggacggacatttcgtgtgaccatcagcttcccatttgtacgtcccagactctcctgttgcttcattttcataacctactggggtgtttcctgtggtccagcgagatggattccattcttgtcattgatttgacaataaaacagccatgtcagctttgcagctctcctaaacatttgatagactgaaatggcttgtttctagtgggaggcattggttgatcttgtgacatcctgttgattttgggggctccaaacagtgcctcccacatgcctggcactgggtcagaaatcatagtctctgcccacagcaacagttgcatttacttgagaacagcagtaaggactttagtgaacaggagtccaggtgttcctatcaaagacgttacctgtcataaagagaagggctgaatacttggaatgagtgggaaggccctgctcaagctcttagccattttactagctgagccacctgggacaaatctctcaccctctctgctccttggtttcctcatttatacctggggatggtaataatatttgtctctcctcactgggttgtgtggaatatctaatgagttgagtgtaaagggctctattttaatataaaggctagttcttgctagtgttattatctagtgattaggtttaagggttttggtggcctcagaccccctgtaaggtatgtactgttaggagaggtgactcaggtgaaagtcaaaaaggctagtaagcagaacagggcaggtgattcattaacaaagggtttaataaggaaaaatgttttcaattgacagacatatttcacgcctgacagggtcttttacaataccccgagggaagcaactcatttgcatgttaaagactcagggacaccttatggaaaactctagctccagtctatttagatgccattcggctcctgtatcatctattttatgtatttcaatttccatctcttttatcactgaggacatttgcacgaaaacagggtttcgagagttgtgtctgcttcgctgttacttcccacccagaggtggtctcaagggtaggggtggcctcattgcatacaggggacaggtgtggaggttggtgtaacaggaagagggggttcaggggaggcaggggctgggaggtggtgttggggtgggatggggtgttggtgatgaattgtcagcccagggcatgtggttttcacctggggacctgcattgttccttgctctgcacaggtctcaggcctcactggctgtagtttgtccattcattgattcattcgttcagtaaatgcttttggagcgccccctatgtgctaggccagggtttggcaaatgacagcctgaggttcaattctggccacacctattactttatacatcctctgtgtttgccttgtgccacaatgcagagttgagtagatgcgtcagagatgttatagaatgcaaagccaaggctgggcacggtggctcacgcttgtcatcccagcactttgggaggctggggtaggcggatcacctgaggttgggagtttgagaccagcctgaccaacatggagaaaccctgtctctactaaaaatacaaaattagccggacgtggtggcgcatgcctgcaatcccagctacttgggaggctgaggcaggagaatcgcttgaaccctggaggcggaggttgtggtgagccgagattgcaccactgcactccagcctgggcaacaagagtgagactctgtctcatttaaaaaaaaaaaaaaaaaaagagtcatttttggctttgcattctttttttttttttttttttttttttttgagacagagtcttgccctgttgcccaggctggagtgtagtggcacgatcttggctcaccgcaacctccgccacctgggttcaagtgattctcctgcctcagcctcccgagtaactgggattacaggcacctgccaccacacttggctaatttttgtatttttagtagagacagggcttcaccacattggccaggctggtttcaaacccctaacctcaagtgatccacctgcctcggcctcctaaagtgttgggattacaggcgtgagccactgtgctggcccaaaaattactcttatatggctctttatagaaaaatatttgtcaacctctgttctagacagagaacagcaagtgcaaaagctctgggaggtcagaatatgcctggcatgtttgaggaatggcacagaggccagtgcgtttggagtagaacgagtgaaggggaaagtggtagggcatgagaccctagagggaattgagagttagaccatgtaagaacttgtccagggggctcagtctgaaaaaaatctcaaaaaacctcccaatcttaggttctacaatagtgatgtttatatattctatgggaacaattaggaaagtcacaaatcttgtgacctctgatcacgtgactcctgagcagtaagggattatagaaactatgctacattttagcagagttctggttcctcccataatcctattcttacggctttttttttttttttttttttttaaagtgatgaggtcttgttgctgggtgcggtggctcacatctgtaatcccagcactctgggaggctgaggtgggcggattgctcgaggtcaggagtttgagagatgaggtctctctatgttgccccggctggtctggactcctgagctcaagcggtcttcccacctcagcctcccaaagtgttgggattacaggtgtgagcactcgctgcacctggccttgttagttttacaaaggtggttttaggtctctgagcaagagggattagttttatggagggatggttatcatccttgctttcaaattaaactataaactatattcctcccaaagttagcttggtctatacccaggagtgagcaaggacaggttggaagtcagaagcaagatggagtcaactacggcaaattttcttactctcataattttgtgaaggtggtttcaattatcagtggtattgttgtatttgcttttaatttggtcttgaggtctctctccagagagatctagctctgccttgcctggaatccaagggctttggtcatggactttttcagtgtgcctttcgtggagttcttctttatcctgctggacagcctaatgcctgtgtctgacttgtgcctaggtgtctctcccacagtaaacttgtttaaactggcagacgccctgtggctcatctgacctgtgtccaggttattcccaccaagatagccactctttttttagacagagtatcgctttgtcacccaggctggagtgcagtggcatggtcccagctcactgcaacctccttctcctgggttcaagtgattcttgtgcctcagcctcctgagtagctgggactacaggtgcatgccatcacacccagctaatttttgtatttttaggagagatggtgtttcaccatgttgcctgagctggtcttgaactcctgacctcaaatgatccagccgtctcagcctcccaaagcgttgggattacaggcatgagccactgcgcccggcctaagatagccactctctctctctctttttttttttttttttggagacagagtctttttttttttttttttttgagacggagtctcgctctgtcgcccaggctggagtgcagtggcgggatctcggctcactgcaagctccgcctcccgggtccacgccattctcctgcctcagcctcccaagtagctgggactacaggcgcccgccaccacgcccggttaattttttgtatttttagtagagacggggtttcaccatgttagccgggatggtctcgatctcctgacctcgtgatccgcccgcctcggcctcccaaagtgctgggactacaggcgtgagccaccgcgcccggcctggagacagagtcttactctgttgcccaggttggtgtgatcttggttcactgcaacctccacctcccaggttcaagtgattctcctgcctcagcctcctaagtagctgggattacagccgtgcgccaccacgcccagctaattttttttttttttttttgagatggagtttcgcccttgttgcccaggctggagtgtggtggcatgatcttggctcactgcaatctccgcctctggggttcaggcagttctcctgcctcagcctcccgagtagctgggattacaggcatgtgccaccacgcccggctaattttgtatttttagtagagatggggtttctccatgttggtcaggctggtcttgaactcccgatctcaggtgatccacctacctcggcttcccaaagtgctgggattataggcgtgaaccaccatgcccggcaatttttgtatttttagtagagatgaggttttcccatgttggccagtctggtcttgaactcctgacctcaagtgatccacccgtctcagcctctcaaagtgctgggattacaggcatgagccaccactcctggcctgagagtcactctctaagagagacctgaccaagacaggaattggcttcaggtgtgttggtcaagtgaaacacagacacaggcagcacaacaaaacatacgaaataacagaagcctttcctgacagatccactggagaaaagggtgcccatgagggtggataggaagcctggagacagcatggagttcaaccagcaggtgggtgggagcgaggagagagagatcaagagaggagacctgtgcaccaaagccttttttggggtcaagagtgttaagccaggcagatttctcatggggagttctaattggtgggtttacaataagcaggcatgagttccgtggagtcacacagtgactgaggggtggtcactgtggtatatctgcacagtccatggtgggtgtgcaggttgatggggtgattaaagtaggctgtaggtagctgtcccatagtggggtggtcaccaggaggcattgtctaaggcagatttctggatcaatcacattgaggaactgggaggaggtagagaactgaaactgtcaagggtttaacatgcctctggccttagaaagttaaaactatgttcaaaatggatgccaaggcaacataaaattatagacatccactacatttatttatttattaatttattttgagacagggtttcgttcttgttgcccaggctggagtgcaatggcgtgatctcagctcactgcaacctctgcctcctgggttcaagtgattctcctgcctaagcctcccgagtagctgggattacaggcgcccactaccacgcctggttaatttttgtatttttagtagagacggagtttcaccatgctggccaggcttgtcttgaactcctgacctcaggtgatccacccgccttggcctcccaaagtgttgggattacaggcgtgagccactgcacctggcccactgcagttatttattcatttatttgttaacagagtcttccttttggatctagtggagagggcagatataagacccaatcattatccataaaagcagtatataattagactagtgaggaatgaatgaggaattctgagtgattggctcacaagaagcttcatggaaggataatgagggattgagtgtggaggtatattttgggagaaaaaggctggaaaggcaagttggggtaagaatttggtgggccttgagtgtcttgcaaggagtttgggctttgtggtaggtggagaggtgataagaatggtatgaatacacttgaggatgaccaagataacttgagtggcagagtaaagattagatgggatgtggagaagtcagtttggaatggagaatggttgagtagttcaggcaagatatgatggcctacttcccctgtttatgttttattttttaatacaaaaaattttttgagatggagtttggctcttgttgcccaggctggagtgcaatggcgtgaccttggctcactacaattaccgcctcccgggttcaagcgattctcttgcctcagcctcttgagtagctgggattacagacgtccaccaccacgcctggctaatttttgcatttttagtagagacagcatttcatcatgttggccaggctggtcttgaactcctgacctcaggtgatctgcctgctggcctcccaaagtgctgggattacaggcgtgagccactgtgcctggcctccctgtttattaattatttgacgttatgccaaatcctggttccttaggtgctaggagtttttcataagctctttgacttttgacttttcagtaacaaataaatgaggtttaaaatcacaagagaggctgggtgtggtggttcaggcctgtaatcccagcactttgggaggccaaggtgggagtatcacctgaggccaggagttcgagaccagcctgaccaacatggtgaaacctcttctctaataaaaatacaaaaaaatttagccgggcgtggtggcacctgcctttcgtcccagctactcaggaggctgaggcaggagaatcacttgagcccaggaggcggaggctgcagtgagccgagatcataccaatggactccagcctgggtgacagagtgagactctgtctcaaaaaaaaaaaaaaaaaaaaattacaagagagtcttatttactgggtatgtcaggcattgccttaaagtagtattcagttaattacttttttttttcttgagtcttgctctgttgcctagggtaagtgcgatggcactcaccactacactcactgcagcctcgaccttccaggctcaagtgatcctcctacctcagcctcctgagtagctgggagttcagggacacaccaccatgcccagctaacttttttattgtttgtagagatgaggtcttgctgtgttcttcaggctagtcttgaactcctggactcaagcaaccttcccaccttggcctcccaaagtgctgggcttaatggcatgagccaccacgcctggccagttaattcttacaatgagcctagaaggtgggtactctcaagagctccccttcatagataattatgcagaagctgcaaggagttgtgacttactcaaggtgttcagaggctgggttctttttttttttttttttgagacggagtctcgctctgtctcccaggctggagtgcagtggcacgatttcagctcactgcaagctatgcctcccgggttcacgccattttcctacctcagcctcccgagtagctgggactacaggcgccccccatcacgcctggctaatttgtttgtatttttagtagagacggggtttcaccgtgttagccaggatggtctcgatcttctgacctcatgatttgcctgcctcagcctcccaaagtgctgggattacaggcgtgagcctccgtgcccggcaaggctgggttctttacccacggtctcttcatactgccttcctaatgtgggcttctctggatgcccacaggaagggtccctggatcactctcatgatcttgactgaagaaggaagctgtgtaaggagcttaagtcactcagtctaatttaaggtcggtttctggatctgattagggacctgtgtctcggtggaaacaaagtagagggtgagtctgttgcccctttcagcagaaaatactccaggctgagggtgtagagagcaaggagaaagggtagggttaagtgggggccacctagaatgttggaagtagggtgtgcagaattcctctgggagctgataggcaggggagcatttgttaaagcctggcactgggtgaggagataataataatgataataatactaatgctaataatggaggataatagcatctgccactcttgagttcttactgtgtaggtggcaccttgctaagcattttacatgatttatctcatttcccaccactccatcaagcaggtattgctgttatcccctttgtgtatggacgagatcatgaggttcagagagatttagcagcttgcctatggtcacccagttcataagtggccatgccaggactcaaacctgggctgattggactccagagttcatgatctccgtcagtacactctcctgtccagaaagaatccttgcctaggtgcagtggctcaacgcctgtaatcccagcactttgggagaccgaggtgggaagattgagtccaggagttcaagaccaacttgagcaacatagagagaccctgtcactacaaaattgatacaaaacaatattagccagacatggtggtttgtgcctatggtcccagctacttgggaggctgaggtgggaggattgcctgagcccaggaggttgaggctgcggtgagctgtgattgcaccactgtactccagcctgagtggcagagtaaacccctgtctcaacaacaacaacaacagcaagaaaaacaatgataacacccaaaaataatccttggcttattaaaatattggcataataaaatggggacagggaaattttcataaaataaagagaaatatcaaggaaataaagagcatgctagaaagcaaggttttaatttattcttttaatttattattttccagctttattgaggtgtaattgacaaataattgtatctattcaaggtgtacaacttgatgatttgatatatgtgtactgtgtaatgattaccacaatcaatcaacatatccatcacctcagatagttacccttttgtgtgtgtgtggtgaggacacttaagatctgctctctcagcaaatttcaagtaaacaatacagtagtattaactagagtttccatgttgtacattagagtccccagaacttattcatcttgtaactgaaactttgtaccctttgaccaatatcgcctaatttccctccaacccccagcccctggtaaccaccgttctaacctctgcctctaagagtttgacttctttagattccacctaagagtgagatcatgcagtatttgtctttctgtgtctggcttatttcacttagcaaaatgttctctaggttcatccatgttgtcaccaatggcaggcttccttcctttttatggctggataatattccatagtgtgtgtgtgtatatatatatatttcacaatttcttcatccatttgtggatggacacttaggttgtttctacatcttggctattgtgcatactactgcatattcttttttttgagacagagtttcattcttttgaccaggctggagtgcagtagcgtgatcttagctcactgcaacttctgcctcctgggttcaagcaattctcgtgctttagccacctgagtagctggaattacaggagtgagccaccatgcctggctagtttttgtatttttagtagagatagggttttgccatgttggccaggctagtctcgaactcctgggctcaagtgatctgcccgcctcggcctcccaaagtgctggggttacagatatgagtcaccatgcccggctgcatattctttttatttacaaagtcacaatctcattcttgcagaggtaggaactgatcccaggagttgggagagattgagcatttctgtttagggaaagaaataagtgagtttcttaaaattttttttttgaggcgaagtttcactcttgttgcccaggctggagtgcaatggtgtgatcttagctcactgcaacctccacctcccgggttcaagcaattttcctgcctcagcctccttagtagctgggattataggcatgcgccaccatgcctggctaattttgtatttttactagagactgggtttctccgtgttggtcagtctggtcttgaactcccgacctcaggtgatccacctgcctcggcctcccaaagtactgggattataggcgtgagccactgtgctggccttttattttattattattatttttttggagatggagttgtgttcttgttgcccaggctggagtgcaatggcatggtctcagctcactgcaacctccgtctcctgggttcaagcaattctcctgcctcagccttccgagtggctgggactataggcgtgcatcactacgcccagctaatttttgtatttttagtagagatggggtttcaccatgttggccaggctggtctcaaactcctgaccttgtgatctgcccgccttggcgtcccaaagtgctgggattacaggcatgagccacgtgcccagcctgagtttcttaaattatttccttaaaaatcgttgcttgcagttacccttgtagagtgaatacagtcctctggtgttggggaaggggaggcatgtttttggggaatattcactgatgaagttgaacactaaatttcagcaaagcctctctttgttttcctgttttttttttgttttttttttgaggagtctcatgctgtcacccacgctgtagtgcgcagtggtgcaatctcggctcactgcaacctctacctcctgttcaagtggttttcctgccacagcctcttgagtagctgaaactaaagatgcatgccacaacacccggctaacttttgtatttttagtagagacagggttttgccatgttggcaaggctggtctcaaactcctgacctcaggtgatccgcctgcctcggcctcccaaagtgctgggattacaggtgtgagccaccacgccgagccttatttttttttttaaattttatttttctgagacagggtctcactctgtcattgaggctggggtgcagtggcgcaatctcagctcactgcaacctttgcctcccaggctcaagtgatcctcccacctcagcctcccaagtagctaggacaacaggtgcatgccaccacacccagctgatttttgtattttttgtagcgatggggtttcgctatgttgcctaggctggtcttgaacttctgggctcaaatgatcctcacatcttggcttcccaaagtgctgggattacaggtgtgagccactgcacctgacccctttttttttctgacccattggtagacaatgaagcctctctttactgaaaaaaaaaacaaaaaacaaaaatcctttctgagcatggtagctcacatctgtaatctcagcactttgggaggccaaggtgggtggatcgcttgagctcaggagttggagaccagcctgagcaaatggcgaaaccccatctttacaacaaaaattagcccactccggaggctgagatgggaggattgcttgaacccaggaggtcaaggctgcagtaagttgagattgtgccattgcattccagcctgggtgacagagcaagacactctcaaaaaaaaaaaaaaaaaaaaaaaagaagaaaaatagaagtgtggctctcaaacttgagctttcagacaaatcacttgttatcttattaaaatgcacattcttgaatcttacccctagagttggtagttcggtggcccatggggtggactctaggaatctacatttatttattttattttactaaaaaaattaaaaaaaaatttttttttttttgagaaggagtctctgtcgcccaggctggagtgcagtggcaccatctcagctcactgcaacttctaccacctgggttcaagcaattctcttgcatcagcctcccgagtagctgggattacagaggcacgtgacaccacgcccagctaatttttttttttttttttagtagagacggggtttcaccatgttggttaggctggtctggcattcttgaccttcctgccttggcctcccaccaagcctggcccaggaatctacattttaaaaaatgttttaaaattttgttttgtcttttttttttttttttttctttaaaacagggttttactgtgttgcccaggctagaatgcagtggcgtgatcatggctcatttcagcctcgagacctcctaggctcaagggatcctcccacttcagcattttgagtagctgggacttataggcgtaggctatcactccaggctaatgtttaaattttttgtagagatggggtctcccttttttcttccccaggctggtcttgaactcctaggcccaaacagtcctcccattgtggcctccggaagtgctgggattataggcatgagtcactgcccccagccaggcacctgcatttttttttttttttttgagatggagtctctttctgtggcccagactggagtgcagtggcataatctcagttcactgcaacctccgcctcctgggttaagtgattctcctgcccctgcctcccgagtagctgggactacaggtgcacaccaccatgcctggctaatttttgtatttttagtagagacaaggtttcagcatattggccaggctggtcttgaactcgtgacctcgtgatctgcctgccttggcctcccaaagtgttgggattacaggtgtgagccaccgcacctggcttttttttttttttttttgagatggagtctcgttctgttgcccaagctggagtgcagtggtgcgatctcagctcactgcgacctccacctcctgggttcaagtgattctcatgtcttagcctcccaagtagctgggactacaggtgtgtactaccacacccagctaatgttaatagagatggggtttcaccatgttggccaggctggtctggaactcctaacctcaagagatccgcctgcctggtcctcccagagtgctggaattacaggcgtgagctacctctcttggcccaggaatctgcatttttgaaatggcatccaggctaatattttttcaggtgttcctctgattatactttagaaatactagattaggaaatgaaggttccaaagggaagagcaatggaattataaaaaaggactattgtggtgttattatatatattggtttttgtctgctgttcttggttcataactcccacagcccttgttacggttttttttggtgtgtgttaggcctcagggccaggccttaggaatcagaatctctttcctgccctcctctcacctgccccaaggcaggatcgtggtctttccccacctttctgattgtggatcttaaccctccctagagtaggttctgccctatacactgagggaaggaatgctgatatcatgaagcttccataaaaacccaagaacccaagagggctgatagctgagcacttggagatttgcggagtgtggtgcgcctagggaagtcctggaagcttcacgccctttcgctgttaactgaccctgcacatctgttaatcagtattttttgcagtctcctttataataagccagcaaacgtaagtgtgtacctgagttctgtgagttgctgcagcagcttgatcgaacccaaagaaggggttgtgggaaccccagcttgaagctggttggtcagaagttccagagacctggacttgtgactgatgttgtggggggaagtgggggatgcagtcttggggactgggccctcaacccatgggatctgacaccatctccaggtagtagatggtaaatatatatatatatatatatatttaaaaaatgtggctatattataaggcataagtcaaagtagactttaaagaaaatgagtagggcgtggtggctcacacctgtaatcccagcactttgggaggctgaggcaggcggatcgcctgaggtcaggagtttgagaccaggctaggcaacatggcaaaaccctgtctttactaaaaatacaaaaattagctgggcatggtggtggccacctgtaatcccagctactcgggaggctgaggcaggagaaacgctccaacctggcaggcggaggttgcagtgagccgagatcgcggcactgcactcccgcctgggcgacagagcaagaccctgtttcagagacaaataaaatgaagataagcttgtttgtaataatagtttccatacaaaggggaaacaggcacagagcagggaggtgacaggcacagactcattccagagcagagggatgagggtacaaggcgtgcaaggctggtgcctgcaagtggcttggtggcgtgctgctgctctcgtgtggcacttctctcctggcagctgcagctgtggtcatggactttagtctgacataaattgctcaggaattgaaggggaagcactctgttgggtgcactggccgcaaagagtgactgtgcagccacctggtggactgagcaggtacaagtagggtggggaaaggtcacattgaccaggagtatgaatttgaacagatcaaatcagcaggtaggcattaagcctctaactgtaaaaaactccacaggactgtgagtgggcagagtagtgacagtcatagtgtctgccctcaaggagcctccattcaagacaaggggtagtcttcttttttttttttttgagacggagtctcgctctgtcacccaggctggagtgcagtggcgcaatctcggcttactgcaagctccgccttccgggttcacgccattctcctgccttagcctcccgagtagctgggactacaggcgcccgccaccacgcctggctaattttttgttttttttttagtagagacggggtttcatcgtgttagccaggatggtcttgatctcctgaccttgtgatctgcccgccttggcctcccaaagtgctgggattacaggcgtgagccaccacgctgggcctcaaggggtagtcttctctaaccaaagtaaatgttttgaaaatcaaccatacacagagggctcacctggctgctcctgagtagccgccattttggctgtggcctgaccacttttgacctgagtgtagtgggctagtgatgcctgtatgtgcattgtggtatcatgatagacacagtagcaatggttaacctgctcttctgctttgcttctaaaataacattcttcctctctcctgatcccttagccctctctgcttttttttgagacagggtctggctctgtcacccaggctggagtgtggtggcacgatctcagctcactgcagtctcctcctcccgggctcaaaccatcctcccacctcagcctcctgagtagctgggaccacaggcacgtgccatgatgcctggctaatttttgtatttttcgtagagacggggtttcgtcttgttgcccaggctggtctggaactcctggactcgagtgatctgcacaccttggcctcctaaagtgttggtattacagacataagccaccatgctcagcctctctctgcttttcttgtcagcatttataccagctctgatattctatagtgatctatctgtgtaagctccaagtgggcaagaactttgttttgttcactgtctttccccatgtctagaacagtgcctggcactgttgaaggaaggactttgaggactgacttgccccaggtactatgctaaggattttatgtacattatttcattttatcccaactacttttgaggtaggtattatcctgttttacaaacgaagaaactaaggctcagtgagattaatgatccaaggtcatataatctaagtggtagagctgggatttgaacttcagtttgactaactatgaaacttttaactgctattctttctcaactttccttttttctgcaggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacggtaggtttttcccttttgggggtagcagagaagctgcaggattacttgcaggtgttcatacatgtagcagatagacatgcctgctatgcatatgtggagatacttgtgtatccttacatgtgcaaaagctacatctgcacaggtgtacacatatggatgtgtgtcctcatattcctttattcctgaacacacaacctcatattcctttattcctgtacctcaggggttcctgtgatcctgaggtaacatagaatgggactgcactgggtctgtgttctgaagcctttacattttaggttctgtatcttattttaacaacacaccaagaggggccgtgctcttcagtaaatgcatgtgcaaggaggactttacagttttgattaaattctactagaaaactcaatccctctccagtgagctaggatgaatggttcctgatgcaggactcatacccagatggtctagccctcagacaactttgagggatcccctccagtctccaaactgacagagaacctgagttgaatattttatgtttagaggttttctccagtggctcaacaggaacgtcatcctggtgtgatcaggtcctcttaattctgctgacaacaactctcccagacattcctatagaattgtcccattggtgggtagatggccacatgcctcatgcttgctttcctcctttatctgctgcaggatgagctcaagctttcttccccttcacgtagattcaatctgatgcacagtctattgtggttgtcatctcaccatctccctaatactcagtgttgtcaggtgtcttttgagccctggctcacaggggagggcactgatgtgcctgtcttcaaggctgagctgagtcgtagaaccaatactgacagatagactttggataatcaggctacggaacataaaacaattcccaagtgtttaccgaatgcctttttttggtcgagcattgtcttacatgctttgaggggcagaaacaaactgtcccacctagacccagctacgaagtagcttctggttgaggaatgcctacatgaataggttaaaaaacaatctaaatccatgcattgtgccaaggtgggtgattcagatgcccgctactatgttcagacactagagtgagtgctgtggcctgggagtcaggattggtatcctaggggtagcaggttttattttatgatatatatatatatatgtatatttttttaaatctttatttttttgagacagggtcttgctctgttgtccaggctgggatgcagtggtgtgatacccacttactgcaacctccacctcctgggatcaagagatcctcgtgcctcagattctcgagtagctgggaccacagatgcctgacaccacacctggccaatttctctatttttttgtagagatagggtttcgctatgttgcccaggattgtcttaaactcctgggctcaagcaatctgcccaccttggtctcccaaagtgttgggattatgggtgtgagccattgtgccaggccaattttacgtgtgtgtgtgtgtgtgtgtgtgtgtgtgtatacacacatatatggttgagtaatgcctacagtaataggttaaaaaacaatccaaatccatgcatccaaatccatatatatatatatttattattattatttttttgagacagaatcttgctctgtcatccaggctggagtgcagtggtgtgatctcatctcagctcactgcagccttcacctcctgggtccaagtgagcacatctggctaatttctgtatttttagtagagatggggttataccatgttggccaggctggtctcgaactcctgacctcaagtgatctgcctggcttggcctcccaaagtggtgggattacaggtgtgagccaccacacccggcctgtatatatatatttttagactagtcaagtgcaatagtgagaaggggagaaagagtagagcaaggagtttgatctgtgactgactgtgaacaatcaattgagataactcaataccttcaggccagccagaagcaggttttaaatggaatcttagagatttgaatagttggaaaggagggaggcagatatggatcaggaatggaatcttagagatttgaatagttggaaaggaggaggaagatacgctttataaacagccacaaagctgtccattttttaaaggccagagctctggtctggattgtctttgaacactactcagtgaccaagtcttgcttgtggttggtgtccagcaagcatatgtcgaataggataaagctttgtagagtgcaaaggaagaaactcttcttaatatcaactttgtaagtccctgaacttctagggtcccagttactcaattctataaaggaaggtttggggtagataatccctaaggcccttccatgcctaggatatcgtggagattggaattttctgattcactctggataagggaacacagaatcaagacttatgctattagggccaggcgcggtggctcatgcctgtaatcccagcactttgggaggctgaggtggaaggatcgcctgaggtcaggagttcgagaccagcctggtcaacatggcgaaatcccatctctactaaaaatacaaaaattagccgagtgtggtggcatgtgtgtataatcccagctacttgggaggctgaggcaggagaattgcttgaacctggaaggccgagcctgcagtgagccaagatcaccgagatcatgccagtgcactccagcctgagtgacagagcaagactctgtctcagaaaaaaaaaaaaaaaaaagacttatgctattagagcaaacatacatataaaataatgtttatttgtgatgtggagaagtgggctaagtttatgtaacaactttattcaagtagctttgattgagcatttactcaatgtgcctggcagtgtaaaaggtgctgtggtaagtgatggacaggaaggacaagcccccgtgcttctagagcttagagtttaagcttataggaagagacagttcataaacaaggagacaaatgagcaaggtaatgttggatggtagtttgttatgataaataattgaatgtttcaggtaagaggggcaattttggcgtgggcccctgcagaggtggcatttgcacagagtcctgaataacaggaggaagctagctagaataagatccaggggccaggcatcttaggggtgggactggccactcccccagacatagcagctgtgtcagggacctgtactgcaaggtttgggcagagtagtagtacttaatgtccaggtgctaagcttttctccactgccttggttcacagacggctgtcatcagttacgactacctcacttccctgaagagtgtcccttatggctcagaggagtacttgcagctgagatctaaggtaagtaacccatgggacccatctgagccaggccaggactggataacccttgaactgctatgctctagtgatcctcccacctcacccccgcaaagtgctgggattaaaggcatgagccactgtgcccggcctaggattggataaatcctgaagcagctgcctagccacgaagcttcctgtgtacagctggaattgggcagagggcagtgtaggggattgaggctgggggcattggccactgagggtttggaaggaaggagaggaggaccacttcctccttcacacagaggtttcagtgcttctgaggggtgctgtcagactgtcatcaagctggatgccatggtactgaggttatcaatttgcaaggtgctgtgggagaggccagtgtgtgtttctggggagtacaagggtctgggatgactcaggagggatgtaggctctgtcccgcagataactcagctggcttctaaactgttttgtcaggcaaaacccagttgaaagaggttacttgctgtcctatcctctgaggcctactctggggcctctcgtaggcctctgagttgagctgtcaaccccaaactctctgtcgtcacttggaacagggtagttgatgttgatatgtgtttagatatcccggagacttgggagatcaaacaagagggcattttttgtggatgtaggttgagtttgaggtcaagtgtagatacctttggctcctccagagagaggtttgtgatagattggcatgtctgtgctcaggcagtcctctcagccaggaatgcaaaggaacccctttgccccttagaaaagtcctcgtcatccttctggactcggctcaagctctcctctgtgatgcttttcttctcagttttcctatgtggatggaataattaatttctaaatttttatttaaactttttattatgacaatttcaaccatccacaagagtagagagaacagtagaatgaactctggtggaactgtcatatagcttcagaaactatcaacattttgcccatcttgttagtcatctttcccccctttatttatttatttatttatttatttatttatttatttatttattccatcacccggtctggggtgcagtggtgtgatctcggctcattgcaacctccgtttcctggattcaagtgattctcctgcctcagcctcctgagtggctgggattacatatgcacaccatcacacttggctgatttttgtgtttttagtagaagcagggtttagcatgttgtccaggctgtccttgaactcctgacttcaagtaatccacctgccttggcctcccaaagtgctgggattacaggtgtgagccactgtgccaggcctgtttcatttatttttttattcattcatttatttgtttattttttgagacagagtcttactctttggcccaggctggagtgaagtggtgtgatcttggttcactgcaacctccatctcccaggtttaagtgcttctcctgcctcagcctcccaagtagctggaattacaggtgcaggccaccacgcctggctaatttttgtgtttttagtagagacagggtttcgccatgacggccaggctggtcttgaactcctggcctcaagtgatccgccgcctcagcctcccgaagtgctgggaaaacaggtgtgagccaccatgcctggcttcattcacttaatttttttccccaaaatatttaaatgcaaatctcaggcatcacattgttttatctgtaaatactttagtatatacctgcaatagataaggacctttaaaaaaatataaccagaagaccatgatcatacctaacaaaactgacaattccttaataatctctaatagatagtccatattcaatttcccttgtccccaaaatgtcttttcctttctttctttctttctttctttttttttttttttgagatggagtcttgctctgttgcccaggctggagtgcagtggtgtgatcttggctcactgcaacctccatctcccgggttcaagcaattctcctccctcagcctccctagtagatgggattacaggcacgcaccaccacgcctggctaatttttgtatttttagtagagactgggtttcatcgtgttggccaggctgctctcgaactcctgacctcaagtgatccacccaccttggcctcccaaagtgctgagattacaggcgtgagccaccatgcccagccccaaaatgcctttttacagttagtttgttcaaatctggatcaaaatgtccaaataaggtagatatattaaggttgacattttctacatctttaaaagtctataacatttcgtcgctctccctcttttttgagttgtttgttgaagaaaccagataatttatcctgtagaatttcctaccttcaggatttggctgattacatcttcaaagtgttatttaatgggaaatacattcaaatagtacataaatcaaaatatacggtatttgaaacatacaaaatgaccctcctacccttgttcctcaggtacccaattttcttgcctggaggcaattattatttcttgtgcattcttccagagatgtcttcctatttgaatttaatcattttatctttattcttgccacagacgatagttggttacatgcctttctttttagactatctgttcctttagatcagggattgagtctttgatttttcgatctgtatctctagcgatgatgcgtaggcctgtgttgatttaatgtctgtttcaatgccagcctgtatcctgccacctccctacctttggggaggtcccagacagagcacgaggttaatagttagaagacccgagtttgtgacttagctaagccggctttgggatattcatttagccttttggagatgccatttgtcattagagatggttatgccacttactcaggattatgtagataatatctcagtgccttgtgaaatagaaagcaggtatcaaaaacaagtcagatgtctcctacaaggtatgttccatgaggacagagacttggtctgtgctgtgaatctccatgtctgcagcatccatcaccaggatgtgacaggtcctgaataaaggtttgttgaacgaacgagtgaatgaaatgttaggtttttttttttttttttgagacggagtttttgctcttgtcacccaggctggagtgcagtggtgcgatctcggctcactgcaacctccgcctcccgggttcaagtgattctcctgcctcagcctcccgagtagctgggactacaggcaccgaaatgttagtttttatggaggatctcaaagtccctgcttctgagacataattgcccactgcgcttccctgcccctctttctccagctaaccggtgctatgggccttggcatccactggtgtaacattctacggagagcttgcaggctcggacacaggggcaaggcctctgctttacggaatctgcagaggaggcaggcgatgggtgtcaaaaagacagttgcctgtcacgtgtcacatgtaagtcatctgaaaggcagtgacactgtagctcctagataagctgacagttttggggaatgcagtaaggaaagtgcagcctggcatttgacaagagaacagcacgtggcggctggcaccagataacagggtgtaggcccgtctctgggagttgtgcctgggaagggggagctggctggcactaagagcatgagtaaataccgcaggagtgttttcttccattggagcgcttatcccttctcgtcagtgtggctgataaaggaatgagtgaagggtaaaacatagttatctcaactgtcaagccagcatctccaggtctcagagtatgtcagagccaggaggctagcttcggcaggcggtgacttcgagcactttcaaggttggcgcaggaaggctgggatctcagtgactcagatctggaaccagagggctaagagccaacgtgaagtgtgttctagaggcatagtggccctttgctaggcagccaaggtggtggggaggggctcatgtgctttggagaaccagatccctggtgttcaagatgcttataaactgagatgtgtgtgagctggcttattcataaagcatacagaagtcattgctggtgtagacatccaggaatggggctggaggagagaagatagagttgattctgatgagggtttgtgatgtagtggatatttgttaatttttcagtttggaagccattctcattttggggaacagcatataaactttcctctggggagccgctgtattgatgtacactttatgagtttgggaagggctcaccccacccttattagccaggtgatcagcggagtctattctgccggccctggaggttgattcaggaaacctgagcaccagagccagttctggccagtgcgcaggacttttctgggaagagcagctctctcttttctgctgagtgagctgagaatgtaagatgttggcttggagctgttggcagccatctttgccaccatgaggggaaagcctgtctgtgaatggagctagtattgcaaagaaatgcataatttggctgggcacggtggctcacgcctgtaatcccagcactttgggaggccgaggtgggtggatcacgaggtcaagagatcgagaccatcctggccaacatggtgaaaccctgtctctactaaaaatacaaaaattagctgggcgtggtggtgggcgcctgtagtcccagctactcgggaggctgaggcaggagaactacttgaacctgggaggtggaggttgcagtgagctgagattgggccactgcactccagcctggctacagagtgagactctgtctcaaaaaaaaaaaaaaaaaaaaagaaatgcataatttgagtccctagatctagctgaaattgaagctagactactgctggaatttcagttatagctaccaggaaattcttttttttttgcccaaggtggtttgagttaagtttgctgtttcttgcagccgaatgagtccttatatactgtggattcttggagaagcatactggggttatttttttttctttttctttttttctatggccctcagtttgccacttaaacatgctgggtcttttaagcataaatggagttttgatagtcacaggagggcccgtaactcaagggaagaaatgaaattcaaaaattttagtgcctaaggagggtgcagagaggtttggatggtgctgggtagaattggagccattttggacctggagccaggtcccctggcacctagtcctactccactgccaagcacctctgcttttatttttttagtttttaaaaggcttttttttttttgagctagagtcttgctgtatctcccaggctggagtgcattggcgtgatctcggctcactgcaacctctacctcctgggttcaagtgattctcctgcctcagcctcccaagtagctgggactacaggtgagtgccaccatgcccggataattttttgtgtttttagtagagacagggttttactgtattagccagaatgatctccatctcctgacctcgtgatccgcccgcctcggcctcccaaagtgctgggattacaggcatgagccactgcgcccagcccaatttttgtgtttttagtagagatggggtttcaccatgttggccagtctggtctttaactccttacctcaggtgattcacctgccttggcttcccagagtgctggaattacagacgtaagccaccatgtttggccagcctctgcttttctatccacaaaatgatggtggtagcctttgcccctgttccgtttataagaatggaaatgagaagctttgcttaatttaacattgtggattatttaaaccagccagagaggagatcctgagcatagggttagccttgatagctccttatcattttaatgaacatgttaatgatattctattttcctcatttcttctatacatttattaattggaattcttctgtgagaaagacctttccgttctcccctagttatttaattattgttattattattaagatggagttttgctcttgttgcccaggatggagtgcagtggcgtggtctcagctcactgcaacctctgcctcccgggttcaagcgattctcctccctcagcctccctgggattacaggtgcccaccatcacacccggctaattttgtatttttagtagagacggggtttcactatgttggttaggctggtcacaaactcctgacctcaggtgatctgccctcctcagcctcccaaagtgttgggattacaggcgtgagccactgcgcccagccatttaattatttttatcactatgaactcatggatatttattttattctatggggtctatgtcccatatataatccagacaatacttttcctttatatccaaaacaatcattattttattgctcaaatggttccacctttggccactgggagctctttcaggttggctcctgtgtccttttgatatacccccaacctatattgagcactgccttacattcttgtactgaaagatacttcaggcttatcctgtattttccttgtcctggaatcaattacttctccaaggagccctggttcctgttactggagaatggtatttagaaaccaagttgtagaggttaggtatatcgttttgctactggggtaccattgcttctaggcccttctaggagacagagtgaggatatatatgtgtgtacactcactcacacatacacacacttctgtctttctactaaaaaactaagattttttttttttttgagacatggtcttgccctgtcacgacccaggccagagtgtagtggtgcgatcatggttcactgcagcctccaactcctgggcttaagctatcctcccactttagcctcctgagtagtggactacaggtgtgcaccaccatgcagggctaattttttaaagtattatttgtagagacagagtctcactatgttgcccaagctggtcttgaactcctggcctcaagtgatcctggtgccttggcctcccaaagtgctgggattatgggcatgagccaccgtatctgggcaaaaaactatgaaatgatgcttatatctccaattttagtccaacatcacagagtccatattagcattctcccttttttaaatatcacctctttctctgacagtgataaacctgcctcttatctacaatatatttccttatttgtttgactctcttacactctaaaatagttaagaccactgaagcattcatgagcagagacaatggtctgaaataggtgaggttgaatgagttaagttggtatgggagctgagtttggaaaggtgggttgatggaaacatgtagccttggggacaaggtgattttggctgagcgtgatgggtgaaattttgggggttgtctataagaaaaagattaattcaatgttactggagactaggagagtgaaggggcatagtggcaaataggattagagctaggtaacagagggactcaaggccaggttttaagccatagacaatagggagccatggaaaattctccagtaaagttatttattaagcctttggtgattgagaatgcttaaagttattgcatcattaaattttcttttttttttttagacagggtctcgctctgttgcccaggccagagtgcagtggtgcgatctccgctcacggcaacctccgttcactgcaacctctgcttcgcaggttcaagcgattctcccacctcagcctcccgagtagctaggactacaggcatgcgccaccacacccaagtaatttttgtattttttggtacagacagggtttccccatcttgaccaggatggtctcgaactcctgacctcaaatgatctgcctgccttggtctcccaaattgctgggattacaggtatgagccaccgtgcctcgccaattttttttttaattaaatatgagacagagtcttgtcatgttgcccatgctggtctcaaactcctgggtacaagtgatcctcccacctcggcctcctaaactgctgggattacaggcgtgagctactgtacccaaccagttattgaatttttttttttaacaccagtgccacttgccaaaaatattttttgagcttctgtgttggacagtgggtagaagtgtgtgaacctgcatgtttatatgtgtctgtgtgcttatgagagagaaaaagaacaggaaccttttcttttttaaatcagagttaaatgtcggaggtgaccttgattgctactttgagtgtgaagtttttttagctaagctcaaattcttgttcccaggtaggtctctgggcttctgtggtatcagatgattcaggtcagtagtatgtgtttgtttggttagttactatagcgcctaatatttggactacaagtaatggttaatatcttcttccttacctgagaagcagagtcagggagatgcaggaccctgccaggtggtgatcaaaattcatcagcttcattactgatagacacagggctgagcatatagtttggggtctggaggaggtgggcttgctgaacttcacccctgaatttgagaggcttacctacccaggcagacatggctggacaagcctctcagttgggggactgcctcttagaggaggaaggagctgaaaatcaatgctttgcagataagcagatcccaaacagagaggagagaggaaggggtgagctgagcaaactctgtttcttctcctaaattccttaatctgattggtgattatctctcccacaaggagtgaaggagtgggacagagaggtcaggagtgttatgcatactagggctccctccgcatggttgtgtgaaacatagggatagaatgttctcctgtagtactgattgtgggaggggaggtagctgtaaatttgctataagaaccatttgtttctatcaaattctgctaatctttacatctaactttgcttaggaacatagggtgttttgggttggagtatgggacagctattttggcattactaaaatctgcacttagaggcaagagtcagacactgtcaacttttattttatttatttattttttgagacagggtcttgctttgttgtccaggctgaagtgcagtggtgtgatctcggctcactgcagcctcgacctcctgggctcaagcagtcctcttgccttggcctcccaaagtgttgggatgggattacaggtgtgagccacaatgcccagcctcctgcaacctttagaaccatgggatatggtagagtgttttggagaaaaagggactcaaatttctggcctgtggatattggttggaggggcagagtaaggggctaaggtcgggtgacaactctataactattccactgcacttgagaaagacatcttgggcatcagcaagctcaagcctctaatgtacacatgtggaagtagagttctgtaaaggtgatgtgatggcttttttttttttttgagacggagtctcactgtatcacccaggctggagtgcagtggcatgatctcggcttactgcagcctctaccttccgggttcaagcaattcttctgcctcagcttcctgagtagctgggactactggcgcatgccaccatgcctggctaatttttgtatttttagtagagacaggatttcaccgtattggccaggctggtctcgaactcctgacctcatatgatccgcccgccttggctgtaatccccaaagtgctgggattataggcgtgagccaccgcacctggccagtgatgtgatttcttacatccccagcaggtgtgtagcacatcatgaacttgatcttgatgttcagatactgcccaatctcatgttctttgcactttatactctgtcgtttccctgtatatctgcttccagtctggggaaaagcaccaagttggacagaaagtagacacaaagatgcctgtgcagcagctcttgccaactggctgctgctgctggagtcgctcctcctgcctcttcaccctccctcctctgagcctgaggctctgctgctgcctgggatggatttgggaaacaccggaggaggaagaagggcaatagagccacctccctgaagttcctttactcatttaatcaataaaacagttaacaaatatttagcattctcctatggaggggagggtagacccttcaaaaggaattgataggtgctggctctttgcttcaggaaagagtttcaactctgaagctattgaacaactgccagttttgaggataaccatcctaccagtctagtgaaggtataattcactaagcattttaaagatcctgtttgtctgcaaagggaactgtagcaatgtctggttcttcaggaatattccctgaaacctgggatctggtctggccaaaccaggacatttcttcaccatccttccatccatctattacattagctaacgttaactgagcctgctctgtgtcaggtacagggtgaggctcagaggagaaaatgggaagtaagactcaacctctgccctcaagttgtcatagttgagggttgggggtaggggggcagaaggcatgaaatcaccagctacaggactgatttgtctattagaactctggcccctggtctggaattacttctcctgatccctgacagcagctaacttccaggcaaggtgggcatgttcaggggtagcttttcttgggagatggggctgggatgcgttcctcctggagtagtggtctgggtctcattgagctacagctcctttgcacgtgcagcacctgtcgacctgtcatggaatcttttcagtgagttttcaagcactgtgcgtctagacccacttttgctgcttttgtttgtcatcacggaatgtttgcttgggagtgttctgcatagaggaggagagaaattgaatccttgctatcttggtgactggctttctcggagtttgtgataatttctgcaggagcatgagctgcatttaattctctctggttgggtcatctaaggaccagttctttggaattagggagacagagtctgtgagtctagcacctcctttttagctttctgaatactgcatcgaaatctgtgcagttttccacagtggccctgacctcaaaaccgttctgattctggaggattctgtaggagtaggttcttgagccttgacgtgacctggggagaaacttggtagggcccatggccatcagtgggagtcctgggggttaatgtgggcctgggagaaaatgtgattctccctggagattgggctcactgtgtagtggcttctctgtaggtcctaggcaatcagggaaatgccagctaccctctcaattggtctagacttgttagttacctagggaccatggccaacaccagcgttttatttttccatatctgtatacagcttgtattttaaaaaatgtgtaatatttaagacctaagacaaagtgtaaaaaggaattcagtgatcaccctcatgcttattgcccaatttcagaaatagtacactttacccatgcagttatagcccgtgggtacttcctccctgactccaactttcttcctgcatatccagaattaagcagtattttcaattcattgtttattattcccatacacttctttataaccaactattcaggtatttctgtgatatttttcatcctgtcaacactttttcctttcttggctttgttctaagcaaaaatatctgtgaaattacaggtttgattttctctctctctctgtctatctaatgcatatgcaaataaatattctgggtaccagctgaaattgcctcttgtaccaccttttgcataccatcactgctgcaaggtcgtactttgagaaacaaggctgcagcatccgtagcagatgctactgggctatgccctggcttgcacccactcttgtctcgatctttaccctgctgtttttggctactctctttccggctcttctcttttcctagctcacaccattcatctcctgggaatgctttaggattggagatgcctgatgtgatggtgtttgctgctgtggttctaaagcagtgatcttttccaaaggccacagctataatgaaacaaaacaaccccctgggtttttggtggtatgagcccgttgctgtgtgctgggcatctctccattctgatcagcacacagttcctctcgtgtgcatgtctgcagctccctcacctatgtgggctgcctggacacatgggtgggcttcctgctacttcagagctgccctccagttgcccctaccacctggttctacagggtaagtggagcaggcacaacacccagctccacagagaaggtcctgcattgtgaggacctacacttctaacaaggccctctatggggcaggaactggagtaaccctggtttcagcctacccttgcccatctcagaccctatcccagaccaacccaggctgggcttttcattgctgattgctttccccactgaaaacctccagcagttttctgacccgccctggactgggtgcttcggagctgtttccacctctgctggaaatggatgtggcaacatcatgagagatgcggggtaggcataagctaggacttccctgtggctgaggcaatttagtactggagtgcatagaagtatccttggtctagacttattagttacctagggaccatggccaataccagcattttatttttccatatctgcatacagcttgtattttaaaaaatgcgaaatatttaagacctaagacaaagtgtaaaaaataattcagtgatcaccctcatgatcattgcccaatttcaaaaataataccttacccatgcagttgtagcctatgggtacttctttcctgactccagccttctttctgtataaccagaattaagcagtattttggattcattgtttatcattcccatgcaacaaagccaaatgtccttcacccagaacagctgtaaagcagctttccagaaacagaagagattttatgtctgtcattaaggtgggaatgggacagcacccaggtggttcacaacctgtcagacaatcagtcacctggggagccttataaagcacacattccttggtcctgtacactaaagatttattgtcagtgattctgaggtaaggcctggaaagcctcactctggtgtccaggctggagtatagtggcttgatcatggctcactgcatcactgcatcctctacctcttgagctcaattgatcctcccatcttagcctcccgaatagctgggactgcaggcttgcaccaccacacctggctaatttttgtattttttgtagagacaaggtttcgccatgttacccaggctggtttagaactcctgagctcaaacattccccctgcttcggcctcccaaagtgctgggattgtaagcatgagccctgccaaaagccatatttttaatgagttcatcaggtaggctcctactaatgggtatctccaagttcgtgttttagaaacttaatctgcaaagcaagagtgttgagaagtaggaccttcaagagataattaggtcataagggctctgccctcatgaatggaataatgctgttaccgtgggaatgggttcattttgggtaccttccctctctccctctctgtctccacccacaatccccaccctttcatgggctctctgactcttctaccttccattatgggatgacccagcaagacggcccttgccagatgcgggtctcttggtcatgggcttcccagcctctagaactatttaaaacaatgttttgttttgtttttaaaaagtgatccagtctcaaggattttgttatagaagcacaaatggatgaagatggcttctgctgcactgtacttaggggtctctattatctcatttaatttttacagtagcccaatgaggtaaataccattgttatcatccctgttttacagatgaagaaactgatgaacagacggatggagtgacttgttcaagcgtccacagctagcaagcgggtgtactaatttcctgtgattgccataacaaattaccacaaattgggtggtttaaggcaatagaagtttattctcctacatttcttaaggccagaggcccaaaatcaaagaacccccaggaccatgctgctggtgggaagcattctagggaagaacccttccttgccttttctggtggcaccaggcattcctgtggctgcatcattgcaatctctgcaatctaagcctctatctcctctaccttttctttctttctttcttttttttttttttttttgagatggagtcttgctctgtcatctagactgaagtgcaatggtgcgatcttggctcactgcaacctctgacccccgggtttaagcgattcccctgcctcagcctcccgagtagctgggattacaggtgcctgccacctcatccggctacaggggaatcaactaattttttgtatttttagtagagacagggtttcaccatgttggtcaggctggtctcgaactcctgaccttgtgatccacctgccttggcctcccaaagtgagccgccgtgcctggcctacctcttgtttttaataaggacaactgtcattggatttagggtccacctgggcaatccaggatgatctcatcttaaaaattcttttttttttttttttgagacagtctggctctgttgcctaggctggagtagagtggtacaatctcttctgcctcctgggttcaagtgattctcctgcctcagcctcccaagtagttgggattacaggcatgcatcatcatgcctggctaatttttgtatttttttgtagagacagggtttcgctgtgctggccaggctggtcttcaactcctgggctcaagtgatctgcctgcctcagcctaccaaagtgctgagattataggcgtgagccaccatgcccagcttcatcttaaaaattcttaattatatctgcaaagacccttttttctgaataaggttacagtcacagattccaggggtagaacatggacatattgttttgggggccaccattcaacccactacaggaacttagaattaatgccaaatggtgcagctcctcaggctgtgcctgtaaccactctactccccggctcactaatctggactggatgagctcccagggttcctccaggccagtggtccatacagcatggggttctgtgttgtatcagggcatcagagccatctgtcaagcctcgagacatcagtgtttttttctctacctctctcccatcccctcagccctctgcaatttttcctgaaaccctttgggctgttcatcttggactcagaaaattcccatgtattaacatgttgacaaagttaggctgcaggtgctgtgaggacagactcatactggcttggatgagatgtgtttctcttgcctcagtggccacagctccaaaatgcgaattgctggaatagcagggctagatggaaggctgtaatataactaataaaattgacggaaggcactccgcagccgtaagggtgatcgagatgcttgttaacagcagtaataatctaatagcctgttcttgatttcccacttctcactgtcttggccccaagcagctattttctaccaaattaaaatccactcagctctcttcctgtccctgaataaaactactctcaaagctcttgcctgttacagcaagactttttaatagacttttccctgtagaaccgtgagacatatgtccaattagccgaataacttcacttaaatatacaaataaactgttgactgataacagcaagacatatgtgaagctaatttaaggcaaggtggttcaggaactggggtgctgtccctcccacagccccaatctgtctttaagcttctcttccctccaatctattattattatttttgagacagggtgtcactcttgtcgctcagggtggagtgcagtggtgcaatcatggctcactgcagcctggacttcccaggctcaggtggttctcccacttcagcctcccaggtacctgggaatacaggcacgtgctgccatgcctggctaattttttgtatttgtagtaaagatggggtttcaccatgttgcctaggctggtctcgaactcctgggctcaagctatccacctgccttggcctaccaagctgctgggattacactcgtgagccactgcacctgctcccgctccagttttttgcttatggaaaagatctttaccccctaacccccaacatgttatgggatgaagggggatgtctctctgctgtgcctggccacagtgcagactatctaagccactattcattcagccaattgttcagtgatatttattgaatgcctactatgttccaggcactgtgtggggtgctgggtgtacaatggtctgttcttgggaggacaagaggtaattcacaatgatgggactcaaaagcacatccgctccaggaggataggggacttgtttgtattgcttgctgctgtgtctgcagcactaagaacagtgcttgccacacacagagtggtctcagtgtacacttttcaggaaatcactgtgggtctaagtaaacaaggtcatttcagctcttgctgagtgccctaaaggagataaaatgtagtcatgggataaagaggggctgagggagagtctgggaagggctctctcgcatgatgtttttcagctgaaactgaagaatgatcaaaggactagcaagtgaagggctgcggggagactgttagaggaagaggcagggccggccatgtgattacgaggactagtgcaaaatgaaaatgctgggctctggctgggcgtgggaaagcctcccttcccatggccctgctgccccaaccttcaaaggatgggcaggttccgggaaatggcaagctgtgtgctggggcgagctcaggatctggatgggggtgggtgagaggtgcctgccaagctgtgtgctcagcttgctgtggctgttctagtttaggatggggctggataacatgtggcacctgtgtgaccccaaccctccccgtgcctgtgtcaaggccacctgcagggtggagagcagtgcacaatgcaggcctccccttcccggtgcactgcttgcagagagcagcagtgatggcaggtagaagtagggagatggggcccgatgtggtggctggcctgtaatcccagcactttgggaggccgatgcaggtggatgacgtgagatcaggagtttgagaccagcttgggcaacatgatgaaactaaaaatacaaaaattagccaggtgtggtagtgcgcgcctcctcagctacttgggaggctgaggcaggagaatcgcttgaacccgggaagtcgaggctgcagcaagctgagattgcaccactgcactccagcctgggggacagagtgagaccctgtctcaaaaaaaaaaaaaaaaaaaaaaaaggaaaaaagaagtagggaggcggggaggagctggggtactcggggcagggaatggtcagccaaggaggtgggactgtgtggagctgaatcttctggcgcaccttcctttgtcctatcagacttcacttccaaaacacaaattcaaaaatttcaaattcaagaatagcgtgaaccagggaggtggaggtggcagctactaatacagtagcttcctatgactattagtttcctgtgactgctctaacaaatgttcacaaacatagtggcttcaaactatacattcattctcttatagttctggaggtcagaagtctggaacggttctcactgggagaaaattaaggtgtcagcagagctgcgattcttctggaggctctaggggagaattcttttcctttttttttttccatcttgtaaaggctgtccacattccttggctcatggtcccattcctccatcttcaaagcctgtgacatctggctaagtccttctccccctcccatctccctggctctcttctgcctttctctgccacttataaaagccatggtgattacaccgggccaatctgagtaattctggataatctcactgtcaaggtcagcagattaagaaattaaactggccgtgtgtggtggctcacgcctgtaatcccagcactttgggaggctgaggggagtggttcacttgaggccaggtgttcaagaccagcctggacaacatggtgaaaccctgtttctactaaaaatacaaaaattaaccaagcatggtggtgtgcgcctgaagtcccaactacttgggaggctgaagcacgagaatagcttgaaccagggaggtggaggtggcagtgagctgagatggtgccattgcagtccagcctgggcgacagagtgagactcaatctgaaagaaagaagggcagcagggagggagggagagaagggaaggggagaggaggggaggggagggaagagggagggagggagggagggaggaaggaaggaaggaaggggaaagaaagaagccttcatttcttctgcaatcttcattccctgtgccatgtaaggtaacacattcatagattccagggagctggacatgtacatctcaggtggcaagggcattattctgacttccacagtgactgcagggcattaaaccacacactcaggccttcccaagtgcagggcagctgcatgcccttgaagccagccctggagagggaaactgcaagcctaaaagccccgatgtggcaatgagcttggctcactgaaggacatggagggaggcccgagtgatagactagagtgaacgatagggcatgtggtacaaaatgagacgagagagactggcacaggtcaacggaacaacacggaaccccatgctgtatggaccactggcctggaggaaccctgggagctcaggtcaagaacacagggcctcctacgtggcagtgaagagttaggaacagcaggctgggatctgctattggatctttaggggaaaaaaaactctatataaaaaatttcaaatgtaattaaaaagtgtggagaataataggctgaacccctatacctggcacctagatctgaaatttgccaggccaggcttagtggttcaggcctgtaatcccagcactttggttgggaggctgaggcgggtgtgtcacttgaggtcaggagttcaagaccaacctggacaacatggtgaaaccccatctctactaaaaatacaaaaaaaaaaaaaaaaaaaaaattagccaggcgtgggtgtgtgcctgtaatcccagttacctgggaggctgaggcaggagaatagcttgaacttgggagatggaggttgcactgagccgagatcacaccactgcactccagcctgagtgacagagtgacagagtgacactctttaaaaaaaaaaaaaaaaaaaaaatttgccaggccaggcatggtggctcatgcctgtaatcccagcactttaggaggctgaggaaggagtgttacttgaggcctggagttctagaccagctgtagtcccagctacttgggaggctgaagcaggaagatcgcctaagcccaggagttcaaggctgcagagagctatgatggcaccattgtaccccagcctgggcgactgagtgagatcctgtctctgtaaaacaatcaaacatgacacacaaacaaacaaaaaatttgccataattctttcattattattattattttttttgctgacaaatttaagcaaattatagaaatcatggcatgtcacctgtaatttcagtgtgcatctctaaaaactgatatttttctaagttatcatgtgattatctcagctaatgatattaacaggagttctttaatttcatctaatttctatgtgtgttcacttgtccgccaaatgtgctgcctgttggtcttcacattgtccctgagctttgtgcctattttagctgtctctctgaggttagagtgaggccttcttccctgtatctttcagggtatttttttttccttccttccttccttccttccttccttccttccttccttccttccttccttccttccttccttcatttcctccctccctccttcccttcctcccttccttcctttctatttttttttgtttgtttgtgatggagtctcactctgtcacccaggctggagtgcagtggcacaatcttgcaatctccgtctcctgggttcaagcaaatctcctgcctcagcctccagagcagctgggattacaggcatgcaccaccacgcccagctaatttttgtatttttagtagagacaggtttcaccatgttggccaggcttgtcttgaactgctgacctcaagtgatccacctgccttggcctcccaaagtgctgggtttacaggtgtgagccattgtgcctggtcgagggtattttttctttttcttttcttttcttttctttctttctttttttttttttttaagactaggtctttttctgtcatccaggctggaatgctgtggctgaaacatggctcactgcatcctccacctcctgggttcaagtgattctcctgcctcagcctcctgagtagctgggatcacaggtgtgtgccactactcctaactaattaaaaaattttttttgtagacatggggtcttactaagttgcccaggctggtctcaaactcctggcttcaagtgattctcccatctcagaatctcaaaatgctgggatcacaggcgtgagtaaccttgtctagccagagttttgttttctattctttcccaccagcccccaagagccccaggctttgaggaaatgaaaaagactcctgtcccacattcaggcctgtggcctgagcaagcatggtggggaagggaagcaggctggctgctgcattctgctcgcggcctaacacttgtttttcttgactgtaattgccattccagagatgccctcactcttctagccgctgaacaactgttgagaacaaattaattatgcatcttctcagtgtgtgtgattaaggggcagatggagggaagggtcctcttcagcttttctggcaactgggttcccaaatggatgctttccagaccaaagagtacatgtcctgggctcctgtgggcatctgggtttgtctgtgtgatggcaggcttgctcactggcaggcagagtcacaagttgccagtaataatattattaatcccttaaatttgcagcccatttgctgtttgctgagggcttgcacagtcacatcagctcatttgttgggatttcagggatgctggaacaactttctttgcttaattcttccctaaatcattattgatgcttgtaattccaccattagaaagtaattcctttcgcttaaactctgttctctattaaaatgcaagtatccttggcagctgtgttgtatgttttattcattaagctttcttagccactagcaactgccctctccagatacccccatctgccaccttccttttaggatgggcttctctgaaacagaacttacatttggaaactgtcccatttcatagaaatctgctctaggttagttgctctggctggaaagagacaggtaaagaaactcctgccaggatgtgaatgactgatcataatttctttttttcttttttttttctggagacagagtctcactctgttgctcaggctggagtgcagtgatgtgatctccccttactgcaacctctgcctggaggttcaagcaattgggttcaagcaattcttgtgcttcaacttcccaagtagctgggactacaagcgcacaccaccatgcccggtgaattatttttgtatattactagagacagggtttcaccatgttggccaggatgatcttgatctcctgaccacgtgttccaaccacctcgacctcccaaagtgctgggattacagatgtgagccaccacgcctggcctgatcataatttcttatgttaccacctctagggaagattcttattttgactggaaccttctggaaacagtgctcaatgcaaaggaaccggtgtcccttcatcctatcatgtcagtggcgttggtcttagctctcccccctgttggactcccttagagaggcagtgtggggagccggccccgtcaggtccaccaagagcagactcggtctgtgtaactcagattgggcgttggcctggagtgtagttcattgggacaggggagaaaatggagctgaccacatagatgatggtgtgacagactgtccatcttgcagaaggaagactgaggcatagagacaataatctacttggagttggggctagaattaaaattttgtctttagaaccccagtaacagttataggtttttaagagtcagaagacaccttagaaacatctagctctgggaaagcaaagacatttcatttgcaaactccacttgattagtagtggttgtctgagtgcaggttggagaataggcaagtcgtcacctggactcagagtgcgtgctgtggttgattagtgatgtctgatgtgtgccacgggcacagtaacagaggagaggcgcatatgcactcacttcctattcctgaccctgctcaacttctcaatttacagatgagctgaggcccaacaagctgagatgatttgttcaggattgcataagtaggggcagtaattggcagaattgtcccagaatccaggtcccttgagtcttgattcaaaactttttcttctgaattatactggtattctaagaggtatttcattatggtcttggagttagactgccgggattcagatcccagctctgccactaataagctgtgtggccttagccaagccatttaacctttctgagccttaacttcatctttaaaagagaggataataattatgcctaccataaatgagaaaatacatgtataaagggttcagagtagggcctaacacatagtaaatacttaatccatgatagtagctcaattaaaatgttcctttttttttcttcctttttgttgagactgggtcttgctctgtcacctaggctggagtgcagtggcacaatctcagctccttgcaacctccatctcccgggttcaaacagttttcctgccccagcctcctgagtagctgggactacaggcacatgcatcaccacacccggctcatttttgtatttttagtagagatgaggtttcaccatgttgaccaggttggtctcgagttcctggcctcaagtgatctgcccacctcggcctctcaaagtgctgggattacaggcatgagccaccgcacctggccaaaatgttcctttttaaattgctttatctttctagattcttggtggacacagacacaaaatcatcccctgctcactccctctgcagtatccctcagagttgcctgtcagaaatacctgcttctctttcttttccatggtatgctctggaatcatttgggtttgaagtgctcctggaatttgcaatttcataatgaaaagtcccacagtactaataaccaggtgtgagatggtgctggatctgtaactacctgtggctctggggcagcttttgctatcgtacttcacactccagaagttcattttggtttgggtgtgtgatgcagctctggaggcttggctgtggttccccaagaaccagctgccacatggggcctctcttggccattttgcttagttgctcctctgaccagaacatcactatagtatctccttccgaccatctctgctcccctaagccagtgtatcttctcccacctaccctgaacctcgttcttagactggacttcaatagccagctggtgccacccccgtcttctcacagctgcctctcctataggcttagaaagcagggcctagtcaaagcctagacccaaagctatgctatggtcctctccccatcttaatccagccatgcaggaccctgggtaacagttccctttgggtgaccctgagggggacccagggaagccttgagaagcagtcggagtccatgactgtcctggaagccaggcctggtgtgatggggctttgagctgacccctgcatgattcaagacaggactgtggagggctttctgggtgtcttgtgatgggcaggtggctctcattgagtgaatcatctgtgattccatatcctgactggtttttgggaaaaacccctgttctggatcctccaacagagaccctctagtgatctgcccagctgatccctgctgagaaagggcagagtgggggctggtgggaaggaggccttcccactggggaacggtcaagtcattgtccctgacattggaaagctctgttgctctgggtctctcactgggtcccagactcgtttggttgcaacctggccatgtctagggttgctcccctgctttttcttctgtggacccgaagcggagaagctgatcatatccatggagctgctgcatgggcagaagccccatcttctccaagagaggctcagacaaaaagaggattttgagccacactgggtgaaaggaactccttgctctgcccttcatcctgggattgtggaaggcagtaacatcacttgtgagaggggagaggcgtggcacggagaatgggtcaagtcaggactaggaggaggtgaagggaggcaggcttgggtccaggctgagaggatttttcgcaggtgaaaaggagagtggtgtggtgagattatggagatgctatgcaagggcctgggggcaggggatggcacaggagagagctgataactgtggttggagggtagagagtgaggtggggagtgtaagagatgaagccgcaggacagctgggctgccttgtatgggcctgtcaggagtttaaacttcataccaggctgggcgctgtggcctacacctgtaatcccagcactttgggaggctgaggtgggtggatcacttgaggtcaggcgttcgagatcagcctggccaacatggcaaaaccccatctttactaaaatacaaaaattagctggacgtggtggcaggcgcctgtagtcccagctacacagaagactgaggcaagagaattgcttgaacccaggaggtggaggttgcagtgagctgagatcctgctactgccctccagcctgggtgatggagtgggactgtctcaaacaaacaaaaaaccccacaaaaaacccacttcataccagggccagtgaggcagtgaggacctttgaagggttatcgttgaagattgtttcccttttcccactgtggccagtgtgctgcccttcctggccctgccttgttgggctgcacagtcctctagtgtggcccagttgctgtcatcagagaccccatgcttctagggcttccctggcttccttctcacaatgattcccaatctgtttctataacgaggccttccagatccccctgtgtgttcatgaatttgttcccaatctcagagtttgttttctggcttactggaacagttcccgggagcccagacgtggccagagccatggtggccgtgtggcctaaccctgagacttagctggggctcagctggggaccagggtgggtgggtgttgtgaggaaccggggagggcaacactgagggccccatagtgggtagtggccacctggatgtttttcttcttcttttaaaaattttttaaaataaatagagatgggggtctcattttgctgaccaggctggtctcgaactcctggcctcaagcagtcctcctatcttggcttcccaaagtgcttggattacaggcatgagccccggcctggatgtttttcttctcacttacaaggaatgtgtaatggtgtggatgggcagcagagtgtagagaaagacagatgttttgcaattagagggcaatgtttcaaaccctgaatctactatttactggctgagtaagcttggtaagacctctaactttttggagcccaagttcttgcatccgtgcaatgaggagaatgatagtacctatctcaagggcttttacctgggtcaggtgagataatgtgtgtgaaagacttcatgcattttattttatttatttatttacttaagatggagttttgctgtgtggcccagactggagtacagtggtgcgatcttgggtcactgcagcctccacctcctgggttcaaataattctcctatctcagcctccttagtagctgggattattggcacgtgccaccatgcctggctaatgtttttatttttaatagagatagggttttgccatgttggccaggatgatctccaactcctgacctcaggtgatcctctcacctcagcctccaaaagtgctgggattacaaagacatgagtcaccatgcccggcctgtttattttttttgagagagtgtcttactctgttgcccaggctgaggtgcagtggtgtaatttttttttttttttgagacggagtctcactctgtcgcccaggctggagtgcagtggcatgatctcaactcactgcaagctccgcctcccaggttcacgtcattctcctgcctcagcctcctgagtagctgggactacaggcgcccgctaccacgcccagctaatttctttttgtatttttagtagagacggggtttcaccatgttagccaggatggtctccatctcctgacctcgtgatctgcccgcctcggcctcccaaagtgctgggattataggcgtgagccaccgcgcccggccacagtggcataattatggctcactgcagcctcaaactccttggctcaggggatactctcatctctggctcctgagtaactgggaccaaaggcatatgccaccacacccagcaatttttaaattttttgcagagacagggtctctctatgttgcttaggcaggtcttgaactcttggcctcaagcaatcctcccgccttggccttccaatatgttgggattatagacatgagccaccttgcctggccaactggtactctctaatttacctttgattcttctttgccctatgagttctttagaacggtgttatttagttttctttcttttttttgagatagggtctcgctttgttgctgaggctggagtgcagtgacatgatcatggctcactacaaccttgacctccggggctcaagcagtacttccacctttcagccactcaagtagctgggactacaggcatatgccaccatgcctggctaatttttcttcatttttattttttgtaaagatgggctctcattatgttgcccaggctgctctcgaactcctggcctcaggtgatccttccagctcagcctccctaagtgctaggattacaggcatgagccactgagcccggccttggttttcaaatatttgggaattttccagagatttcttggttattgatttatactttggttccattgtggtcagagaaaatattttatacattttgatccttttaaatttactgagatctgctttatgactcagaatgtggtctgtcagctgcatgtggtggctcatgcccataatcccagtgctttggaaggctgaggcagaaggatcatttgaggccaggagattgagaccagcctgggcaacatagtgagaccagcctgggcaacatagtgagaccctgactcaacaaaaaattttaaaaaattacctgggtgtggtggtgtgtgcctgtagtctcagctactggggaggccaaaacaggaaactcccttgaggccaagagttcaaggctgcagtaaacaatgatggtgtcactatacttcagcctaggagacacagtaaaaccttgtctcaaaaaacaaacagaaagaatatggtctctcttggcaaatgttcctcttatacttgaaaataatgtatattctgctgttgttggacagtgttctataaatgccagttcagattggttgatagtgttcaagtcttttatatcctaactcattttctatctatttgttatatcatgtattgagaagatattgaaatctctgcctataatgtggatttttctgtttctctttgcagtttcattagtttttttacgtcatgtatttcgaagctgttattgggtgcataaatgtttaggatggtatatcctcttgatggattgatccctttattgttatgaaataattttctttatccctgataatattcttttctctgaaatcaattttgtctgctataaatatagctgtttcagctttcttttgattagcattggcatgatatatcttttttttttttttttttttgagatggtgtcttgctctgttacccaggctggagtgcagtggcgcaatatctgctcactgcaaactccacctcccggattcacgccattctcctgcctcagcttcccgagtagctgggactacaggtgcccgccaccacgcctggctaatttttttttttgtatttttagtagcgatgtggtttcaccatgttagtcaggatggtctcgatctcctgaccttgtgatccgcctgccttggcctcccaaggtgctgggattacaggtgtgagccaccacacccggcccgatgtatctttttttttatccttctattgggttggtgcaaaagtaatcagtttttgccattacttttaatgaagacagctattacttttgcatcaactccgtacatttaacctatttgtgtttttatatttgaagagcgtttcttttaggcagcatacatttgggtctttttttttttttgagacagagtcttgctctgttgcccaggttggaatgcagtggcacaatcttggctcactacaacttctgcctcttgggttcaagcaattcttctgcctcagcttcccgagtagctgggactacaggtgcgtgccaccacgcctggctaatttttgtattttcagtagagacagggtttcaccatattggtcaggctggtcttgaattcttgacctcatgatctgtccactttggcctcccaaagtgctgggattacagctgtgagccactgcgcctggccatatttgggtctttttaagagtagtttgacaatctcttacttttacttagggtgtttagggatagttgataaggttggatttatgtctttgttctagttattcgttttctgtttgtcctatttgttcttcattcctgtttcctttatcacgccttcttttggattgggtatttttcatggttgtattttacctcctttgttggtttatgagttataattctttttgttactttaatgattgctttagtttatagtatacatcttgtcagtctatatttaagtgatattatagtacttcaaagagtataagaatcttaaaatcgtatactttcattgcttctgaagttttatgctattgatgtaatacatgcttttatgttataaacaccacattacattgttaataatttggttaagcaatcatttgtcttttaaagagatataaaatataaaaaagttcttgtatatttactcataaagttgctatttctggtctctctgttcccttatatagattcatatttttatctggtttcatttttcttctgcctgatgaaggctctttattatttatgtatttatttatttaatttttttttttgagacagagtctcgctctgttgcccaggctggagtgcagtggtgcgatctcggctcactgcaacctctgcctcccgggtgcaagtgattcttctgcctcagcctccagagtagctgggactacaggtgcgcgccaccacgcctggctaatttttatattcttagtagaggcggggtgtcaccttattgtctaggctggtctcaaactcctgacctcgtgatccacctgccttggcctcccaaagtgctgggattacaggcatgagccaccaagcctggccagttctttaacatctcttgtagtgcaggagatgttatctcctacagttttcctacatctgcaagaacttttatacctttatttttgaaaaattttctttgctgggtttagaattctttgttttcagagatgttgctatactaacttctgctcatattgtttccagtgaaaaatctgccatcattcgtatctttattcttctgtctgtatcttttttctctgtataaattgtttaaaaatattatgtagctttcttcatgtttcttgtgcttggggcttgttgaggtccttgaatttattagtttatacatttaaaaaaaatcaaatttgaaaaaatttcagccattatttctttaaataaataaatatatatatatatatatatatatatatatatatatatatatatttcactcctcatctcttctcctttggggacttcaactacatatttactaggctgcttgaatttgttccacagttcactgatgttcttttcagtaagaaaaaattatttttacttctatgtgtttcattctgaatagtttctattgccaggttttcaagttcactaatcttttatgtgtgtatatatatatatatatatatatattttttttttttttttttttttttagagacagggtcttgctgtgttgcccaggctggtctcaaaatctctggctcaggcaacccatcgtcccccttggcctcccaaagtgctgggattacaggtgtgagccaccatgcctggcctgatatttttttccccctgcaatgtctaatctgccattaattgcatcttgtgtgcttttcatctcatgcattacatttttcatctctaaaagtttgatagggttctctttctgtctcttttatgtcatccatgccttggcttactgcaacctctgcctcctggtctcaagcaattgtcctgcctctgcctcccaagtagctgggatttcaggtgcatgccaccgtgtctagctaattgttgtattttatgtagagatggagttttgccatattgcccaggctggttttgaactcctgagctcaggtgatctgcctgtctcagcctcccaaaatgctgggattacaggtgtgagccactgtgcctggcattgtgcttttatttttagggtggtagatatttttgtattcttataaatattgagctttgttctgggacacagttaagttacctgaagtagtttgctttttttggatcttgcttttaatatttgttagatgggaatggaacagtatttgttttgggatatatgccattactgacgcaaggcccttctgggtgttgccacaaatgtcccatgaactatgagatttttttcatcttggctggtggaaataggtcctgtgtgaatgctgggtactgttaaccctaagctttttgggttattcttttcctggactcagacaatttttggatatgcacgtgctgattggtactcagctgtatatgcggtggggtctctgcagatctttagtgttctttttttgtacagctctctcctcactgctctgtcccttgaactctttctggactctcagctgtatctcctcaattgaggagtcttctggtcactgcctggcttcccctccctgccacttcagcctggaaactcccaatgcagtgaactggggcattcatcatgttcaccttgtcaccttgtttctttctcatctttcaggaatcactcttcttccttgcctaatgtcaagtgtcttgaacaccattgttttatatatgctgtccagttttttcagatgggaaggtaattttagctcctgttttggaagaaatgtcaaggttgacatcatgatttatggcctgaaaaagtccaagtttagccttgccattttctaagatggagaagactgggaagaacaggtttggtggtggtgggagtggtgggaaagtcaggctaagtttgaagagcctgttggatattggagtaattgatgttagagaggcagttgtaatcagcaagctccagtaagaggagaggtctgggaaggagatacacatttgtgtgtatcaatgtgcagatggtatttacagccatgatactggatgagatccccaagggagtatagttagagtattggattaatcctgttttttattttctatattttctggtgctttgacatcttgaagttttgctggcattggagggaccgctcctcccagggtcaactaattcttagagaggtagcagctctcttcggagtgggctttttttttttttttttttgagatggagtctcactctgtcatccaggctggagtgtagtggtgtgatcttggttcactacaacctccgcctcctggattcaagtgattcttgtgcctcaggctcctgagtagctgagattgcaggtgccctcctccatgcccagctaatttttttatatttttagtagaggcggggtttcaccatgttggccaagctggtcttggactcctgacctcaggtgatccacctgcattggctccccaaagtgctgggattacaggcgtcagccacccactcacaggagtgtgcttttcatatgcaaatcaacaaattcagagccctacctcacaaccacctactttattaggctcttgaactctggactactattcttctgccctaattgccccatcattaggtagtagacaagtagggagagctcccatgccaactaaccagtcctaatcctgtttaccctgccttgacctttccttcgcatggaatagcagcaaagactcttgtccacattttcctgctttccccctctgcctttgactctggtgcttctttccccacgtggcctggcatggcatgccatcatgccgtctatttctagagacttgtgagtaaaggcttctgctttcatggtaatcatttctgtgtttgtgtgtcttaccatgcgtgattgaaacaaatcccaatccccttgtagtaagtatggaaacactagccctggctaaatggataccccatgtaatcttcgtagcagccctatgaggtgtaggtactattattatcttacttttatagatgtgaagactgaagtaggggaaggttatgtaacttgcccaagtccaccagcttctatgtggtgaaattgggatgtagcctgagacactctgaagtcctgtgttcttaactgcagaactatcccatgtgtggtcagggtggggttcagtctgaggttaaactctgttaatatgtttacaaactgcaacttgttttttcccctaagacatgatgagctttactttgctgtctaaatgacaacgtaaagattagcatctagaaaagagaccttgcggacagtgtgggcctgatttcttggggatgaggggttacaatttcatttttctgatggacagtacacatgtgtgccatgggaccctgccaaattaggaaagagatgctggattctctctaatcaaagctggtctagtctgcgtggcagaatcttgtccatttagagctgaaaaaagtaatcagctggactttccattttcagaagatgctgaaaagggatgataaaaaaatttcccccattatcataatatttattattcataagaaatttgggaaatacaggtcaggtgtagtggctcatgcctgtaatcccaacactttgggattacacccgccaaggtgggtggatcacttgagctcaggagttcgataccagcctgggcaacatagtgaaaccccttctctactaaaaatacaaaaattagctaggcgtggtcgcgggcccctgtaatcccagctactcaggaggctgaggcaggagaatcacttgaacccggaaagcagaggctacagtgagccgagatcacgccattgcactccagcctgggcgacagagcaagattctgtgtccagaaaaaagaaatttgggaaatacagaaaaacttatatagaagaaaaaaatactcttataatttcacagcccagagataacactgttaatgtttcattcctttagggcttaagtttctgactagaagaattaatcaaaggtcagtttggggtctgttgccttctctttccatgtctgcctgtctctctgtgtgtggggtgtgtatgtatgactgtctgatggtctctttccactctgacacttacacacccctaagccccattggagatattgcccagttctgaaggggagtcccatggattcagtgtgacattgatacctttctgcctagcttggggactagggcccctgctcttggggctttagatatggtaaaggattgccctccttgggctttgactccatctgacctaatcaataactaatcaacactgagttgatcttattagctattcactgcctccctcccaaaccccaaaccaagctggctgtgacaatgcttttaattaatatgaggcaggttaaaactcattacataatcctagcactttgggaggccacggcgagtggattacttgaggtcaggagttcaagaccagcctggccaacatggtgaaacctcatctctgctaaaaatacaaaaattatccgggtgtggtggtatgcgcctgtaattagttactcaggaggctgaggtaggagaatcgcttgtatctgggagatggaggttgcagtgagccgagactgcaccactgcactccagcctgggtgtctccaaaaaaaaaaaagtctagcaaagcttgaagtggacaggcccctgcaggcctaaggatggcctgctagtgcctggagtctgagacagcccctctgctgtgtcgggaggtgggcggatgggccctctggctgctgggttgagggtgttcagggctgcagcagtctcttctgagcagcagcgatctgggcgtggtggctcatgatggtaatcccagcactttgggaggccgaggtgggtggattgcttgagcctgggagatggagactgctgtgagccatgattatgccactgtacttcactctgggagacacagtgagaccctttctcaaaaaaaattgtgcaaatttatggggtacatgggaaattgttacacatttataatgtgtggtgattaagtcagggtatttagggtagctatcacctgagtacaatacagttttctaaatatagtcattctcctctgctatcaaacattgaatttatcctttcaagtttactttatgtttgtaccctttaatccacttctcttcatcctctgcctgcccaacacccatactggctggtttgttatctgtttttccactctctacttccaatatcacatgttctctcttacatgtgggagctaaaacaaaaacgaaaacaaaaaaacttcttaatttctaaatttcctgtgtggttcacttggcaactaattatacaggatctttgaatgctttttccacctttgttgtcaactgttatttaactcctcgcatgattttatggcccccaatatgtgttattacatcagcgtcctacgtggcactgaagagtataagtccatcctcgtggttcactctcttggttgactgagatgggaggaggcaggtaccaggtccccacagggtactggggtcccttgtcttctgcatgtgcccatggccccatcctgcctcagaggctttagctcctagaaggtaggaccttcatagtaccaaggccctcaactgggcaggggggatgactgtggatatgcagcctggcggcagatggggccacctcccaactctggaaggaccggtgagcatccggatgttaattaaggctactctgtcctaggcaacctgcccagatgccttctccatgtgcctcataccccccactacagtgactcctccagttaataggagacccctgctaaagtttgctgcactaaagagccctagattttggagtgttttctagaccttcctttgatatttattagtgatttctttctttcttttttgagacagagtctcgctctgttgcccaggctagagtgcagtggtatgatctcggctcactgcaacctccgcctcctgggttcaagcaattctctgccttagcctcccaagtagctgggattacaggtgcccgccaccatgcctggataattttttttttgtatttttagtagatatggggtttcaccatcttggccaggctggtcttgaactcctgacctcatgatccacctgccttggcctcccaaagtgttgggattacaagcgtgagccaccgcgcctggcctagtgatttccttagcaacaaaacgacggagtttatcttctttaaagataccaaaacttgcttccctgaggtgctgtgaagattaaaagataccatacatatgaccatgttttataaaacgtagcaatccaaacaaacaaagcataattggtatgtctgaggggtgggtggcaaatactttaactctgtgtcccttgaatgagtcattagtaggttagacttggttaaaagccttgaatgcttatttctagggagtgggacccagactaggtaagttttgatgaagaggaggagataggaagcactgggccgtgtttgaagggcggcctctgtatgaggttggagttgactgccccgtgtaccaggaagctggacaccaagggaaaaggtgtgtgtgtgtgcgtgtgtgtgcatgcatctgccctgggcattgtggggtaatgagggttttcaagcagagcaggaaggtgaagggaacaaggtgtagggaacagtctgcactcacacctctctggtcctggcctgtcttcctgcaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggaggtacccacctttgcaggggggatgggccttggttgggatgcttcagaaaaggccccggctgaattcttgcagcctcgaccagggtgctggggatccaccagtgacacaaaaccaaatgtcacagccactctcagtgctgaaatcaaagaggttagaaggaatctcagtggccctcagtgaaacataccagttcaaccatatgaaatagttcatatgagactgttattgacctgaaacctatatatcattcatatggttcaacctaataataaatgtcacttactgaaggtttaaggccttattgaagctttatcctcagtagggctttgaagccccatcccatctggtttcaacctacctgtctgtaagttggtggggcagagtgacactgtggtttagactctagagccaagagcttggaccttgcacaaatgattgatcttggcacctcactttccttatctatagcccaccacataaggttgctgtgcagattacacgggataatgaatagaaggtgcttagtatagtacctgatgtagagcaagtgctcaacaaatattagctattatttgtatagtaatggtgttctatactattgtggttgttgtttccctacgctctggtcccattgtgctacctgtctcaaactcactgtgttgtcttagtcctcagtgcttgtgccgtggtctaccatctgcctgatgtctttgcttcattctctacttgtcaagtgacttcaggccatctgcctatctgtccacccagctagcaaatcccaggcagggtgctaggtgctgggtttcccgtccaaaccccagctcttctaggaagtcttctgtgaccctcccttgaccgatcttatccctcctttgggctctgcagaactttgctccctgcacttgtgcaacttgtggcttgattagttgtgtctaaggatttccctgcaagtcatagtctttgaggatgaagaccatgacagtccttttactctgtatttacagctctggaacagtacctagcaggtgccctgggtctgcttaaagagccaatggatgaactagaaatagtgttgttaggctacttggcgcagggccaggagagtagggcagaggtttgataaagaccagtggttccctttttacagggagctggcactgactattggtcccttaatgtggagctggccccaggtacgcagcatccattcaaaggtgtcccacttctcagtgatatcctggcctggagcgggggttggatcatacagcaggtgaacatagaaacatctctgactcctctgccactgaggaacatgtcctccaaagggagagacattgagtgaaaggtaaacccgaactgtggctggagtcagggagcaggctgcaagctgggaggagcagggtcaggagagagggaccccaggcagaggggactgaattggcatagtgctggcccactcatggctttgcctcttgccaagactcttggcccccagcttctaacagcacgagattcacccccaaattaaaactaaataaatcacggtaataacagtgtgaagtgcatcattgctggcgtgtggcagctctctgggggtggaaacaaggagcaggaggcagcaggttaacccttggaggctgacttgtctggagagctggggagggaggtgggacaagggcaggttagtggctgtccccaagccagggtggagtgagggaagtttggagtgtcagcagtcatggtggcccacccagctggctaaagaatgtttggggttggaagacgtcgcctgatcttcagggccccttctccagtcccctccaccccctgccgattagccctgagcacagtggccatgtggctcctgcccccacaatgcttctttagacccctgaggaaatgggctactgtccatgtcatggttctgaggggtgtccctcgcagctggggagcttcttcagagccctctgggttcttaccagggccccacaggcacacactctgtcttccctgccctcttcctcctcctcccccttggaagatggcatttgttccctggtgacacactttcccagtgtgtgggtggagggaggggagcggggccatgtgggaagaagggtgggtgcgtgtgggggtgtgagggcggggtaatgtcactcacttggcatttccagcctcctccagcccctcccatgacacttctcggggagcagtctcgcctccaggatgcttgagtgggccccactcatcctcagctccatgccagccctaagaccttctgcagaaagctccatttcatccctggcttaaaagaggctgtcagttatgcctcaccaccttcctaggtcccagtcctcggataggctttgaggttaccttgagctcagagattccataagtgctcctaaagctcagactgtagagagcggtggtgtggtgagggaggtgcttggatggtcaacagcagtgttagaggtcactatgtcctcagacccatccctgttgcaggcaggtggggcccggccctgtggggcattcccagcataggtgtgggggtaagattgagggtgcagtacttctggaccccacggttcatatgcatttctggatcagccagaatttctgcacatcagctggcaccatcagtgcagaggtgagggcactcgaaggggcactctccttgcatagcattggctcaggcagggagtgcgctggggccacattgctaagggagggctggtgacaagcaatgggatgagacctcatgtcctctaattcccaggctggtgattcgtcccctacataacagcttctgtttggcaggaaaaaaagcagttgtgtgtgtgtctgtgtgtatcttggaagtttctcagctagtattaccagaaagaaacttactttttttcctttatttggttgttaggcttatatcctgaaagacaggttccaggaagcaatcaggagcccagcctctgggaggtggggtcgtttctgcctcctcaaaagtgacctcgttctggactgggtcaggggtggtcccagccttggtccccttgactgcccttggggctgtgggtccagatgcagtgctgaccttggccagcagatggcgcctgagcttgcaagtcagggatggttgtaaagacctggcccttctctttgtggggggatccctgaccaggtggatgagactgggggtctttctgctcttgggcatggttcgtgctgttgaaggaacgcaggctgacatctctacaccctgaatgggcatgcatagcctcagccacgaggctgttgaccaccctgggtgcctcagcccttgactccatgttggaggacgtggtattggagttaggagttctctgatgctccgcagtctctgatggccagtgattctgtgcttcagcaccttttccttcattccttctctctcctgctggtctacgcggttggcatttagtgaaaaaggacagtgccggacatttgggtgtagccagggatgggtacgacctcattccagtcctcacagtccagggtcatgggaggttcactcatcatggtaatacatggccacatagtgcccaacgagcttgcagaggagagagaggttgccttgggcagatggaggctttctgaagcaggtggcctctgacccagccccttagagatggatggaattggaggaggtggatgttggaggaagtgattactgattaataagctgggttcagcagaggtgcagggacaggaaagcataaagcatggaggtgaacagtgaggtcttgttgattacaatgtggcgttcagccggtgaatagtggagcagaggttgtaggattggggctgaggtcacattatgaagggcctagaatgttcttttcagaatgtgagtctgagggagaggaggacttggggagggacctgatcaaaagaaggacgaagagactgagatatacggagtggggtggggcatgtggtcgggtggttgaaggaatttgcctaataggctgaatatttagtaatgtgggagatgaggtcatctttgaaaagtggaggaagatatagatggggaggtttgaagtgggtgggaagcttggggatagagttatcgtggaaattaagggatgatctttgaattgtcagccacactatgctgttatctttggtcatgcacacacatacacacacgcacacacacacacacacatctatacctgcccccatgacatacagacaagtcagatcttgttacagcctatttcaagaaatggtccaagccgtgcgtggtggctcatgcctgtaatcccagcactttgggaggctgaggtgggtggatcacttgaggtcaagagttcgagaccagcctggccaacatggggaaaccctgtctctactaaaaatagaaaaattagctgggtgtggtggtgggcgcttgtcatccaagctacttggaaggctgtggcaggagaatcacttgaacccaggaggcggaggttgcagtgagctgagatcaggctattggactccagcctggtcaagagagtgagactctgtctcaaaaagaaaaaaaaaaagaaatggtccagttctgtcctagaatatagttatatcagataaggttctgtccacctctgaaatcccatgagaaactgaaggaaatgaggccagctgctggcatggagcacagaaatacctctgttaggggcaatgcttatattggtgtctgggtggtgtggtttggcttttgtactctgaaatttgtttttatcagtttttcaccccctggtctttcctcccaggggaacttattttacagctccccatagtacgtagggacaagcgtatgctgcaggtgctctgtgttcttgatgcaccatctgactggagtttcaatgagaatgaaggagagagaaggtgcaggggtaccgttgtgcaacgggtagaataattcatatccagttgttttgtaagagcctgtgggtgcagtgggagggcagcttgtcttgtttgctcaaggtttaagcaaatgttcagaaaagagataaagaagcctttcctccaagaatataaactgtttatccaacttgttggtggtagaggcagagagcaggcactgtaggcgcaaggaccagcatgaacaaggcagaagtggagagatgaggcaggagaaggcctgcctgggcgaggggcacacagcacctctgttgtcccatggagaacttgatgggagggggtaaaaggtgccctctttttgcatctcttcctccaggctatggcaggttggccagagctgggctggatttcattcctgtgtaactcagggctctctagagaaacagaaccaataggatatgaatgtgtgtgtgtgtgtgtgtgtgtgtatgtgtgtttgtgcatgcatgtttgcttgtgtgtgtgtatttagagctagagagagagagagagactgattgatgttaaggaattggctgatgtgggttatagaggctgggaagtccaaaatctgcagagtggcccagcaggctggagacccaggaagaaccgatggtgcagttcaagtctgaaggctgtttgaaggttacctgctggcagaattccttcttgcttggggaaggtcagtctatgttctgttcagacccttatctgattgcatgaggcccactcatgctatggagagtaatctgttttattcaaagtccactaatataactgtaaatcttggctgggcacagtggctcatgcctgtaatcccagcactttgggaggctgagatgggaggattgcttgtgcacaggagttcgagacaaacctgggcaatatagggagaccccatctctgttaaaaaaaaaagttaaaaaaattgaattaaaaaaacaaacaaacaaactgtaaatgtcacctaaaaataccctcacacagctgagtgcgatggcttatgcctgtaatcccagcactttgggaggctgaggcaggcagatcacctgaggttaggagttcgagaccagcctgggcaacatggtgaaacctccgtctctactaaaaaaaatacaaaatttagccaagtgtggtggtgcacacctgtaatcccagctactcaggagggtgaggcaggagaatcccttgaacccgggaggtggaggttgcagtgaggcaagatcactccactgcactccagcctgggtgacagagtgacaccccgtatcaaaacaaaaacaaaaacaaaacccctcacagaagcatccagagtaatgcttggcccagtatctgggtgctgtggcccagccaggttgacatgtaaaattaaccatcatgattccctatgtggccctcagccaggatttcacatgtgtaccctcggtctgctttcacacggcctggagcttcatagcgagccttggcggtagacaggagccaaactgcctgttggtatattggctttgtggccttgggcatgttacttaacctctctgtcctgtccctccatttcccgatctctaaaattggaatcataacactacctgccacctaggcttgttgtggggatggattgagttaatgattgtggagcatctagtgcaagcttgctgcagggcaaggggcagtaaacgttaataattctttctgtgtattgtgctgtgtgctttttatgagcaggtactggggttctgagagactcgtaaatggcagagttccatctttacctgggctttctgataactggtacagctctctgtcccatattcagtcatatgttgcttaatgatggtgatatgttctgagaaatgcatcattaggtgattttgttgctgtgtgaacatcatagagtacttacacaaacctagatgggacagcctacaatatactttgggtatatggtatagcctgttcttttcagaatatgagactgagggaggcttgaatctaggcaattgtaacacaatggtgcgtatttatctgtctaaacatagaaaaggttcagtaaaaatatggtattattaatataatggatcgcttttgtatatgtggtccgttgttgaccgaaatgttgttatgcggcacatgactgtactgttttgctagaataatcctcctttctcttcctcttcctgatcagtacccagcactctatctggtcagcctcttcccgctacttttagaaatccccacaggctcccaggcagcctgggtttctagggctctgtctcccactttggggggttacctggggggcagctcagctggttagggttaattgctgcagtttcccaaggccctttggcagctctcctctggattagggactctgaagtatgtgctcttggtctccaggcagggctaattccatggatgaggggtgagaggaggtggaagtctggccagatcgccaacaaggagtcacaggtgcctgtagtcatggagttggtggttgtgctgtatttaggacccactcacctaaccctcttcacttgcaaggtggcagccagattcagcttcccttacagtgtcctggtggggccgggtgtgggctatatccagggctgagcatgccctgggctggactaggagtagggaagtggttagagcagaagcggggcaggagagcccctcctaccctggggtctgactccacctgtgcctgcagcccccgcaggggagagatgcctccaggctctcatattgtttgcttctttccagcactgatccaacttctccccatcctcctcttatttactcatgtgcatttattgagcacctcctctgtgccaggtactacaccagcccctggggttcctgccccctggagcgccctggctgtgccccttggagtgccattctcccatgctggcagggtccagctgaggtcagctcaccctctagcagcccaggctgcatcacgggcccaaagctacctggaaacctttggcggtctgtagacttgcttctcctggtcctgagcaccacctttgtttgttcaggcatctggtttgtctccccagactgtccccaagaaggctaccaaatgaatattctgggaatggaacagaaggatctggtggccatgaagccatgtacaggaggactaggggccagggagtgggatcgcctcctcccagctgggcctcatcctgccttcccagcagctctcaataaaaaatacatttgtattaaaaacataatgaagaataaaaaaacccatttcccccccaataatgctgacatcaaaagaagatttttatcaattatgagagagatttcggccataaaattgcaatttaactagtgggagatggatggcaggaagcattgctgtcagcacggacggatggcctgctgttagtcactgcgggagaggcaaggcaatggtcgaggtggccctggcttgtgcttcctgctgatgccccatctggcccgaccttctccctgtgaccactgccctcctgcaggcctgtaccctgtctgtgccctgctcccggcctgtgtcctgcaccttgaatcctggtgtcaccatgttctatgtcatcctgggtaagttttgtgattttgctgagccttggtttcctcatgtttaaacagggatgataagagagccttcacatgaatagggctgtggtgaggaatgaatgctatagcccagccaaagtgcactgcctggtgaatggtaaatgccagttcactgtcagctgtgcttgttacgtgtcgagttgttgcgagagcaaaatttggcagttaagaccagcaccctcatcttgtatccagcaccttgcctggtgcctcgatcttcctgaggtttaacaaatactgactctgtttgttcaccttctgttgttcagtggcaagtgctttggacaaaagttatctgggagaatcactcatgggttgtgagggcttataaatcatttagtgcgacccccacatttcacaggtgaggaaactgaggctcagagaggggcagtcacttgcttaatgacacaactggttggtggtagaaacaggactagaacccaggtctcctgattcctgatccagtgctctttctcctggactattctgtttcagatggaagctcagtgcccggaagagagggcagcactcaatcgagcaatcgggctgggcttgctgtcagagccacccagtgggcctccgtagcttgcattgtccttgggaccttgtagtttcctgcggactttgaggaagccatattttcctaagtccaggatcctatggttctttttgtccttcttccagtcttttgtcttgccagtggtttggggtgattatactaatgtgctcaccagttcactctcagtccacaggctgcacgtggggtgcctcccctttgttgggatctagtgctcagggtcgtgcccaagccctctgatcggctggtgtgtctggattgttccatacccacttcctgcagataaaaggcctcaacccatggtggccccattcactaaccccgggaaggttgggacccaccacttgttggtttgcttacctagagaatacagatttgtagagcaactgctattctcttacccatgtgccactgcagcgggggatatacagaatgttaaagctgtgcccctccctccaaagccaagcaggcagaaccgtgcacagagggagtaattagagaacaattaagccctcagctgtggggctgatggttgggaagttcaggggaagttcagaggcgggttcctggtggtgggggtttgggctttgaactggtccttgaagggtgggtaagatttgaggaggggaattctgagggcacacagggttggcagttggtggtgagtaatgaccacaggtaattcaatgcccagagagccgacaagctggcctggagtggcagggagctttggttggatggcgtattggttttctcgggctagccgcaaacctctggcttaaacaacaaatgtattgtctcacagttctggaggccagaggtctgagatcaaggtatcagcagggtgggttccttctgaggccgcgagggaggatctgttctaggcctcggccctagcttctggggggtttgctggcaatccctgctgttccttggtttggagatgcatctccccaatctctgccttcatcttcacatggtatcctctttatgtgggtgtctggctctgtgtccaaatttcccctttttataaggacacagtcatgttggattatgattgtgctattccagtatgacctcatcttaactaattattaatatatctgcaatgacctcatttccaaataaggtcacattctaggctggggttaggacttccacatatgaatatttatggagcacagttcaacccacaacagatgggtgcattaggtcttctgtggttgtaaggatcttaactccaacttgaactagctaaggcaaaaaaggagatgtgttacattgtagttagggttgggctagagttgggccttggggtgtcttctgggactcttgtatctctcccagcaacttctgtctgtgggtcagcctcattcacagctgcttccctccatgaccagctgccattgacagcttttagcctcacctcttctcagcttcacacctaagagggcctgaccctgctccccaatttcaggactctgattgacttagcctaagtcagatgttgtaccgggttaaatagtgtccactccacccagccccacttttctttataaattacccagcctcaggtatttataaaaacgtgagaatggaccaacacagatgggtaaaggcagacaagatggtaggtattagtgttggtggataataacatatggttgtgtttatttggtacttgttatgtagtgtgcattggctggatgtgttacagatattgtttgtaacctttacaataactctgtaaggctggtagattaccattctggttttccatctgaggaggcagaggccctgagaaggtaacagctatgttcatgtagccagtaagaagcagaaccaggatttgagctctgatgacatctccactcttcccgctatgcagctcctagccctgcagaagggctggtttctgggggacgttaaagagagccataggcattgggtcttgctgtggcaagttttagggtatcttcttaggccccaggtcttagaagtaaagtcaaatcagctaatagcctgtgtgttcttgtgtgtgcccaagactgataaagagacattttaggcaaagtgagctaatggtgtaggacggatggagggagccaaaggaggggccctgcgaggaggctctttccatcatccatatcttgcaaaggtgagctctccctatggaacctttttagctgtctccctaagctggggcaggtgccatttttttctcccctcaacatccccctggagctcagagcgtgagtgtcccaggttgggcagtgagtcaggaggccatagcctggaggacaaatgccatggttatggctcttgaaggacttgccctggcagttggccccatgccttctaggactgccacaggggtcacagagtcctcatttcctccctgactggaactcgtggccttccctctcttctccagggagaaggggaacaggtctcccctgcaggccactcagggctggggctgtcagtatgggcagggtggatgtgattgcagtggcttctgatgcctctccctgtctcctcgtgacccagaggtctgttcttcctcgtggcagtcctgggagaggggatggctttttggaggagcctcaggcctgcccagatgtacaatgaacatactggccaacatggccaaatgagtgaggaatacatgcttgtcttagtttgggctttcctaaaaacaaacaataatttgagtaaaagtgatgttgtgggatgctcagatgttgccagtagggaagtggggatgtggttcaggaagggggaggcagctggtaactctctgctcttaaaccagtggctactgtgggcaaaatcaggttagtcctgtgggcagactgggaaatggtgtcaaatacgtacctttcacccatcccacccaagggccaaggtaggatattcattcatacaccaacttcctaacttcttcttttttttttgagacagagtctcactcagttgcccaggctggagtgtagtggcatgatctctgctcatggcaacctttgcctcccgggttcaagcgattgtcccgcctcagcctcccaagtagctgggattacagtcatgcgccaccaagccaggctaatttttgtatttttagtagagacagggtttctccatgttggccaggctggtctcaacctcctggcctcaggtgatctgcccatcttgacctcccaaagtgcccggccctaacttctttaactgacagctgctcctgggagctgatacttcctgagacttggaagtcccagggagtctctggcacagatgcaaatcctgggggtcatgcaggagctgaaggggaggtctgaggggagcaggtggagcactgtcagggctaggccagcatcatctcaaagaagcctcacaactgctctgtgagagtaagtactgtttttattattcctatttcacagaggtgcaaactgaggccagagatgttaggtctcatgcctaagtcactcagagagcgtgagcagagtcaggtctggcttcagaacccaggctttctaaccccagcattccatggctctttgcaaagggtcctgcgcttttcacaaagttttctcatcttagcagcttacgccttctgtcagcattcccaagtgggaggcagggcaggcagatgaggaaacctcgcaggtcaaggaactgaatatttagcatttcctctgtcctgggcatgaattagatgttttcaaacacatggtctcatctagtcctcacaacagctcagagagattggcgtccctttcccatcacttccagacatagaaactgagactctgagatgttaagtaacttcctcagggtcacacagcaggatggtggctgagccaggaactgagcttgagtgtcaccggactccagagacacacacttcagtcacacaagctgcttctgggaggtgagtgacccgagagatctgtctgcgaggttgggcggggccagcacctttcctctgaccgcacatcttgccttccgctccgggctggcctctgacctgtgttccctaaaagccaatcataaggtggctgaggaggttcttgaagaagagggaagtggggtgttaggctcttccctgtcttacccctgggaaaggtgctgcctctctgtgctctcagatggggggctggccttggggggagagtgggggtgccctcttgctctcccgcctgcttccttagagctgggtcttcttgctgtgccgcccccaggtcccctttccccactccttttttttttttttgagatggagtttcactcttgttgcttaggctagagtgcagtggcatggtcttggctcactgcaacctccacctcccgggttcaagtcattctcctgcctcagcctcttgagtagctgggattacaggcatccgccaccacgcccagctaattctttgtatttttagtagagacgggattttgtcatattggccagcctggtctcgatctcctgacctcaggtgacctgccggccttgacctctgaaagtgctgggattataggagtgagccactgtgcccggcctccccactgcttttaaaaaagttttaatgtttattttaatagtttttagagtacaggtggtttttggttacatgggtaagttctttggtggtgattctgagatttagtgcacccgtcgcctgagcagtgtacactgtaaccaataagtagtctcttatccctcacctccctccccaccgctttctacctgctgctgccacttggcagcagagggagccgagccctccatgtctagctgatttatgttcactgttaaaacaataatgtttaatctggaaagggctaatcaagtttttatgctgattatgaataggccagctgggcctgcttctttattcatggagcttcagaaacaagcccatttcccaggccaggcctccttggtgatttatgccatgggaggccctgttcaaggggagctcatcagtggctttacctgtgccactttggaagggaagcctcggcaactgctggcatgtgcataagtgtgcgtgtgtgtgcctgcatgtaaccgggcagtgtagcctgaccccaggtggagaactggacttgagtatgtacttgtgtttgaatgtgtgcacttgtgtgtgtgtgtaggttggctgggatgaggctgggtgatatgctttggctgtgtccccatgcaagtctcatcttgaattgtagctccctcatcctgttcttgtgatagtgagttagttctcacataatctgatggttttataaggggcttcccccttcactgggcactcattcttctccttcctgccgccatgtgaagaaggaagtgtttgcttccccttctgccacaattgttagttttctgaggcctccccagccacaccgaactgtaagtcaattaaacctgttttctttataaattccccagccttgggtatgtctttattagcagtgtgagaacagaataatacactgggctaccattaggatggaaggtaggagttacaggatcatggcattagaaaggctaatcaggatcaagtactctaacactctgcttttacaagtgaggaactaatacccaaggtgaggtgacttcgctgaggtcccacagctgggtggtggcagtggggagactgtgggactagactgccccccatccccgtactcttactgagagtgcagaactctttccacagtggtacaaatgggacaagagggttggaggaaggaactgcatgggctgctttgcttgagttctcttgattcatcacaaccaccctgatgcctctgaggagcttacattttatggtacagaaagagctatagactgaactttgaaagaggtcagcacaagaagagagaaagttatctgaggtttaggttacagcatttgggtgttcttggaatctgcaaatagggttgcaggaggggtggatggggctttctggaggaggtgagaggtgagcaggacttcagtgtggtcaagaggagaatgtacagaaaggcatggagaaggcctttggggcaggactgaagaagtcctttatggtgtcacctgagggtggggtctgaaccttgaggccagactagggaggcctatgtctcccaggctggggtggggcaggtgctgggcctggatggcttgggtgtccacaggcaggggctactgtatgtggactctgcgtgtcccctctccctgctggggcttcaccaatcatttgtgtattcattgtttgactttgcaggtatttagtgcgcttctgtgtgctggccccaggggttatgagggtgaacaagctaccatcagggcactatgatctatttataggggaatagcagctgttaaatgtgtgaggagaaaaataaagctttaataacacctgtggtaagtgccctagacttttcctcttggcatttgagtgactgcagggaggttgcagtattgaagctgagaccagaggatggttaagggacaggtggatgggacaatgagaacgagaatgcagagacctcaggatgggaaagagcctgggtctgtccagggacaggaggggcttggtggcagcagggcagacagagaccctgaaagataaggctggagagctgagctgggtgtgctgagggggtctgaggctggtgtggggaacaagagtagaactcactggaagaccagttatggggcagttatggtcatccaggcaaaatggggcggtggcttggacatagggaagtggagaggagaggactgacatatttgcagatggaaaccacaggactcaaggatgggttacatggagaggtgtggaggaggtggaggtgccacagtcacctccccaggttctggcatggacggtggtgggtgttagcaggtcatcctactggcagtcggggaaggaattttctataatgctggaatttgcatagttgcctcctctttcctcagggtaggagcgagtgggttgtggtcagaacgtcggcaagtggcactgagcaatgtggggttcagcattgagaggctgaacagcctacggtccctggtttctagatattaaaaaaaaaagaaaactccttagcaccctgatctaatgagagctctggggtgtgagtgtttccctgtcaccgggtttgtggatggagaggctgttatttcaacagctagagctgctcctgcacgtcagccacgaagtcctcatagtgatgagagtctggcctggccccactgctgtgtgtgaactatggactgttgcctgcacgtgagcggcagaggaaattgggctccttgggaagagaggaagatgtcgcttcaactgagcagggctgagcatttggccctggtgctgggaaggaatgacattgaggaggaagcccaggagggaaacagggactggtttcaagtgtcctcgcctggcatggcagaactaggaagctgtgatgttccccttcctggtctcacatcttggggttcacacttgacctatgttcccctcatctcattccccagctttccagccccaccatgaccctgcaaaatattgcaaaagactaaaaatggacttccactgagagcgtaacactagtgctgtaatcatcggtttgtaaaatttgtaaagggcctgcatgaggctcctattggctgctgtcacaaattaccacacattgcatggtttcagtcaacacacatttattatcttatcctgcaggccagcagtctgaaaattaaggtgttgactgggctgtattccttctagaggctctaggggagattcccttttcttggcttttccagcttatagaagccacctgcctcccttggcttgtggccccttccttcatctttacagccagtggtatagcatcttccagtctccctctgccttttttaccctgtcacctctgcatctgtcatgtcatctctttctctaattctgcccttcctacctccctcttgtaaggattcttgggttgatattgggcccacctggataatccacgttcatctttccacctcaaaagccttgcctttggggcacctgcaaagtatcttttgccatataaggtgaacatctttggggggctcattttctgcctaccacagtgtcagataataaatgttttaggtgttgcaggccataccatctctctgtcacaactggttacctctgtagtggtggcacaagcgcagccatgggcaacatgtcaacaaatgagcatgcgccccagtaaaccacaggtctaccaaggcagagagagatgggtcgctgatccctgtgctagtgttcttaatcactgctctgcttgctgaactgagccagtagagttatgttgactgccaccccccgacctcccaagtgtggacttcgtctccccagtagatccatggagcctgggtttacctccctttaaaattcctgggcactgctggtatcatatgccaagtgaatccagaaagctttttactgggtgcaacatccttgcatgtacaaagagctttggggctgggtgcagtggctcacgcctgtaatcccagcactttgggaggccaaggcgggtggatcacctgacttcaggagttcgagaccatcctggccaacacagtgaagccctgtctctactaaaaatataaaaattagccgggtgtggtgatgcgcacctgtagtcccagctacttgggaggctgaggcaagagaatcacttgcacctgggaggtggaggctgcagtgagctgagatcatgccactgcactccagcctgggcaacagggtgagactctgtctcaaaaacaaacaaaaacacaaagggctttggtatttacttgcttttggctccgaggcaagcatcatagcttaggcacatttgctgtgtggcattttgctacctcctgaagcccaggacgtctgtcctgatagcaaatggagctgctgtaagtgaagaatgctgtgctttgtggatgcaggaacaactgagggttgtcggaaaaggcctttggggttttgtgagggtgagcttgtcaggttttagaattcacggccctcatcagaaatgaatgtgagcctttgtggctgggcgttcacctcagtgggcaggagctgtggatggggaccccttcccaagggggaaatagggaaaccaagtctggattcctagtttgggagttgctggcttttgtatttctggctctctccagtctctgtgtctcattctccttattcatggttcacacatgctgttccctttgcctggaaggcttctctacctcctgggttcaaacgattctcctgcctcagcctcccaaatagccgggactacaggtgtgtgccacgatgcctgattagttttttatttttttgtagagatggagtcttgttaatgttgtccaggctggttttgaactgctgacctcaagtgatcttcctgtcttggccttccaaagtgctgggattacagatgttgagacactgcacctggccagcttctccttcctttcttcagctagttaactggctcctcagccttcagatctctgctgtttgtcatcttctcagagaagctctctctgctctccctgagcaggttcagcccctgagcataggctcttatggtgccagctttcccttcattgcacttgtcagagttggccattttacttttatttgtgattatgtggttactttctatcgccttcccttgacttctaagttctagctgtaactccggaggctggtggctgtacccactttggatttactcctcaaatgcccagtgattaacatcgtgccctgcacatattagtcacttagtaaacatatgttggatagataaatgagtgatccatagcgaatatattctcctttataaaatgtaggcaataatctctcctctaacctcaagagagggttgagaattacatacgagcattttgaagggaccagaccttacccagatataaggaactacccatggttgagcattcagtccgtgcagggcaaagatatcctgacattcccttgtattgacccaagctcaaattcaagggggaggtggtgggttctcacgtgggcaggcttgcagtgctgggtgcagggcccgtcttgcctgggtctaatctcctggtaccacctctctcaactgtggtggggcataagcacttggcctctggggctcagggctggctcattgcctcagtacttggatcacccaggggttacctgcctggcctgggccctggctctgggtgtctctggcttcatactgtactgtgtccaggacctctggtctcttttaccctagagatctctgttacaggcagggacatagatatgtcaccctgtgaggctatagatgttattaagatggggaatgctgaaagattagatttatgatagccaacggtggattatgaagaataatttatcaaatgtcagtgcctgtggcctacaatttacagaaggtttgcttaaactgggaggtctgattggactgtcccttccccccccacgaatgaatgacagctctactggatggcttcccaggctggccagccacactgggtgtttatctgctttttattaatcattattatcacaacatttccgtagagtcccttcatccacagctctcaaggtacccagcacctaggaggctccctcagccaccgtgaaggaactgtagccacttctgggaggtgtttcagctcccctggatcagctggagggcccaaggttccctctccctgatgaggacaggggaaatctaacctgaattccattcatctgttaggaaatacttaccgagtaccatcaggtgtaaggtgcttttgatgcagtgctgagcaaaagcagatgtctatagtctagaagagaagggggagattaagcaaatatgaagaggtaaatgtgcagctgtggcgattgctctcaaggaaggtgcatgaaccctgagaatgtacgcaggggagacctctctgaggaggtgattgttcagctgtgattggaagaatgagtgggggaagggagccttttggccagaggggacagtgtgtgcaaagggcccatggtgcatgcagagagcatgctggtggctgaacgaggtcatatgtttctagcagagggaggagggtggggcaggagaggtaggccgggtcagaccccatgggtcatgttcaagattttggctctaggaagctggtgtagtgacttatgcagcgagaagtgacatgatcagcttatgtttgggaaactcaccctagctgcatgtgtaggctggattggaagagatagggcaggctggtgaggaggtcattgcagtctctggggaaatgagggtggtggcttacactcactgatggaagcagactgagagtccgaaactgctgactctgtgcccagcactcttcactgtagcactctgccctcataactggaggcgtcatgtgaggcacccactactatggcagttattggggggctactataggctctattctagaccctttatgtatgtggtttcatatgaccctatgaggtcaatattaaaataaccattttacagataaggaaactgaggtacagtggatttgagccttggcagtttgacctagagcctgcactggaatcaccaagccttacagcttctcaggctagactgtcctgacgagctgatagacgtgtctcagagtgcgcacacagccatcctggagtatgggtgcccctggcttcttttcttccctacctgtcagccgctggtcatcatcttgagggaagaaagaagcttggtctgacctgtgatgcccttgacagagccaggggggtgatggccttgtgccaggaggcggttcagcaattggcaagcattgtgccagcctcagtgcaggaacagttttgtaatttctgggattggcccttgtcaggagggcctcaggttctgctgctggcccttcattttcttttcagcttggcaacagcaatagctaatggctctgcagaaccaatagtttgatcttttggaaccccagaaagaacacaaactccatggaagacaaggtcggcgtgtccttgagctgttattgccattattatttttattataataaattgctctgagcgggaagctggtggtgagggtattcccaccttgaggcagagcagctgttgagtgggacagaggtccagacaaggagtgaggagggagagagacacttgatgcctgttctcccctctgatcaccatggtcacatcagaggtctcctcttcttaccttgccgaacatttctttcaggattggaggaagcagcaatgtgcaggaagcactgtctccagcaggccctgctaaaatacaagtgtgtttttctgagaggctgttgcctttggacgtctcctcatggccagagactgtgttaagtacaccctatgtaattaacatggttcctgtcatatgatggtcctgcagtaaatatgtgttgactgattggcttaggctaaggaatagcaaattggtttcatttcgtatatgaactctggtcaatttgtagtggctgcctggagcactgtgttgagattccaaggcaccatctgggatcatcaggaatggactggtgatgtctggcatgggtttgcttggggtgtgttagttagctatttccacataacaaattacccacgtcccacctacaaaactttgtgacttaaatcaataaacatttgttatcttacagtttctttgggtcaggaatttgggaggctctggctgagtctctcatgaggttgcagtcctatggaggcctggcaggggccggaggattgtttccaagacggctcactgttgtcaggaggccttggttccttgccacatggacccctctgcaggctgcacgagtgtcaccatgccgtggcagctcacttctcccagagcaagcaatccaagggcgagtgagagactcgtcacagcctttatgactaggtcttggaagtcccatgctatcgcttcttccatgtgttctttgttgggagtggatcattaattccagctcacactcaagggaggggaataggtgccccctctcaaagggaggagtattatttaaaaaattatggacatgttttatttagttaattaattaatttttaacatccagttggtactaaaaagattctgttaacacctatcagggcatgtcacttccatgcttaggacactgcagtggtttctcacccttttcccccctaataattaattaattgtaaagacagaatcttgctatgttgcccaggctggtcttgaactcctagcctcaagcagtcctcttgcttcagccttccaaagtgctgggattacgggtatcagcctccatacctggccattgtgaacatattttaaagctatcaccgggaaatgagtgtgcttgtgccacttgctgttaccgtcaggtcaccttggaagatacaggaataattctgaagaggtgggttacaaatcagacatgtttaaaggagaggggcaggaattgcagcaaaagcgggtattggctgatagggcaatgacaagatataggggtatctggggcaggtccctgggaagtggtacggggagaactggatgggttccaaacagaggtgttggagaggtggtggtgggttttctgcccaaggcagacatctgagttttgcagagtcctagatagctggagttattgtgtctgccttaggctgggggtgggaaagggtgggtgaaactctctccaaccacttccattagtgtggacagatacttgtctctctgctcaccaggctccagtggatggcagctggcacccagccaggtgtagggggggccagctcgagactgcaggagccagatgttgtttgctgctgatgccatggtaacctgccctgagttggttctgccccaggtgccctaagtgggaactgcttggtcttggcatctaggcctgggcttgcctgctttgaggcaggcttccgtctgcatctggagccagacatttcggtgtttgtgagatgcattattgatacggtgatgtagtttctaaaaccaaaatcggcctgacgtgaccgagtatgggaacagcaggctgcaatatttgaaagtgggctatcttggaagaattcagccgtcccccatcctgtgattgaggagccccttccctgagggccctgaggctggccacgctgtggcatctggaggggctgtttaaggtactccaagcaaaactcctcaggaggcgtcgtgtggtttctctagaagatcctgacttcctgtcaccttattttggtcttggccagtgcttggctgctcagtgtggcagtttggaaacattgtccagtaccctggcttcatgggactctgcagggtggagtttctggatagtctcttactctgccctttgacttgggtatgatgtcacttagtctcctgattcccaggctcatgaagccagactgctgaggacttaactgccccagatttgtcaagcccctaggggatgacacattttttcttacaccacccccccccccgtgcttttttgctcattaaatgacaaacacttccccccttcgcacatgtgtgcacacacacacagagaaagaaaccaaatgataaaaagccagagaaactctttttctgattatttttccttttccagacagggacatcgatatatttgaatcacgggccgacagtaattaaaaagcacgtaactagtcatattaaaatgcagttgttttacttaactgattttgccgctagacccagagcgggggaaaaaaagaaatggggaaagaaagccttagaaaaggaggcaagtttctgtgagtgactggaggcagctgagggccctgcttgaatctaattgctgcaaatgctgcagtttgtttctggtaatggttttctgctgaaagggctgggggacgaggcctgattggaggggggtggtgtttgtttcagctgcatggggggtataattctgctttcgggacagggtctatttttccttaccatctatcagcataaagtacttccactgaacactttgaatcaaggttccatttagagatactttattcatatttaattacaggctgcagcaccaatctttaattaccttttttataagccagctaggaacatccactagcaatcaattatcatgtgtgtgtatgtgtgtgtgcttgcttaagcacaggagggtgtgggcgtgtgacttgcttcctgatagagaaggaaaagatggctgcagggacactggggaggtggtggggtggggtgtctgtgtgacaggtttccggtgcccagtgaggggtgcatcctcattccccatgcctatctttgcttctgctggtggaactgggatgtgggcaagtcctcacagctggctcttgtttagggtgctgagttggccactgggattaggtggtatcttggggcccccttgattcccctggtggggatggggaattgtgggaggcctccttcatgtcctctggggatgtggtggaccaggcttcctctcgccctggagattaggatctgctcgcctcagctctttctttccctcacctccctgtggggtgctcttggcagctgttcctgctacacagccctagtgatgccatgtcactcttcagttacaatgactctgcagtgcccctgcaatgacactggcttggagactggttgtccttctcagacaatgagcacatgttcctgggagtcaggtggaggcttggggtaaggactgatgtcagatgacccccaaatcccttttcagtgggaagattgggccattttagctgcccgagagatgagggtgtgagttcacagctctgctccagaaaaccctctgcttggtgctccttcaggaactccagagggcttgcaaagggacttggtgttgatctcattatgtaacagctgaggacattgccgaggctctgccttcccttccattcctgggtccctgtcccagcaagggggtggggaagggatggaactcacatttactgggtcttgtgtggggcctgggcaccaggtctgtgtttttttcacttatccctgctggggcctgagaacactatatccatcagagccccttcagttgtgtgtggcagataactgaaactgacctaagcaggaaaaggaatcatagggtgggtactcaggcatggctggatcaagaggctcaaacaccgtggcccgggttcactccctctgtctctgcagcagaggctttcttctttgttgctactatgtgaccctcagcagttctaccccaggcttatatttttatgttcaggttcaactgagaaaaacatctatatcaaacgaaagtaaaatgattgagtctgattggaccagttgagttacctgtatatctctgaactaatgcatgtggccagagatattcagggtcctgattggccaggccagggcctcacacctgccttggaggaacaggtgtgctttttctattttggaaagctccatgtttgaggtctttggattcataggaatgtggggacaggaaggtctagccatttcaaagggaaggaaaagttgattcaattcttctccagtggaatagtggattcattcattcaacaaatttgtttggcaccaactagttccagccctgttctagggagttgcaggaaattcagcagtgacagaacagacaaaaatctttgcccacttggagctgatgtcctaatggggtttacagggatgatgatcccaaacccaggcccaagataaagggttcttatgctgagaaactcagggtgattgggtggatgacaagggaagaattttgctattgggagtctagaattcacgaaggaggagaaaagacaagtgtgtttttgggggagcagggagaaccagacactgggagagacacaaataacaaaccaaccaggatgaagggggccagggaagcgaatcccatacccatctctcctgacagagaagcgtaggcctttcctcatgtggcctgggcctttcatctgggcaggttgttgataaatggggatggagtttagtgaaagctacaacaatgatgacagggctggagggagtgatttatgagacgagattaggaaagtgatggtgtagcctagcagatggggtgggatggtggctgtgggtcatgtgacatctgaagtccaaggagaggagtggaggggcagggcagagtggctgctgcagtagcagggatagagggaggaagggctgtgcagactgaatagacttcaaagcatgagggcctaggagggtgggccaggacagcaggcatctatacatgcttgtgcatgtgtgtgcacatgtctggactttccaggattgtgaggctgcacagaggcttaaagaaatggagaggattaggatttcagccttggccaatcttggaaaagacctttaggggcctctttcctagttggcagaatatttggatctggacatgtaggtgtgaccactcaagtcagggaattttatttccttcaggaatattggtatggcatttctaagagggaaggagggaaggaagaaagaagaaggaagagtgaggagtatattttctacttcatagaaaaagaaaatgaggcacagaaaaagcaaggggctttgtccaggcctaccttcgagtggcattgcaggtgatgacctagagcaaagttctggcttgcagccctggggtctctgctggagtggccaggctgggagtggacttggtgacccatgttgaggctgctgctcaggccggaacaaaaggcagttgttggtctggagcctctgcccaggattctttgagctcccctggttggtagaatggaaacatcctctgtctgatccctgagatactggggctgccctgggcccacatcctctgtctgatccctgagatactggggctgccccgggcccacattctgttaatgctggattgtccatatgtaagagcctagaaggcacagtggtggacagttcaatgggcaaataaagctcagttctgaagagcacttctttggcctttgatggaggtgcttaggggcccgtgcacaggtatgaggatgcgccttccatgtacgtcttctgtcccccttcctctgtatgcctaccgtgaatgtccagcagtggaggaccaggcaagaccctgggctggtacacaactgataaagcaaaaaaatctgtcctggaggctgggtgcagtggctcacgcctgtaatcctagcactttgggaggctgaggtgggtgggtcacttgaggtcaggaatttgagaccccatctctattaaaaaatacaaagattagctgggtgtgatgtcacacacctgtaatcccagctactcaggagactgaggcaggagaattgcttgaacctggggggcggaggctgcagtgagccaagatcatgccactgcactccagcctggtcgacagcgcgggactctgtctcaacacacacacacacacacacacacacacacacacgcacaacacacacacacactctctctctctttctctctcaaatctgtcctgggggcactaggcagccctgactctggcccatcttcctggctccctctcactgaactgggtcatctttttcattgctctgttctctccactcccgacagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgagagccctccctttctccttcctgtgtcctcagtctacatttccctgggatccaggccacctaggtggaactggttcaagctggtgagtggagtgtggcccttcaagcagcagagggagaggagagctgagattacgacagaggaggtgttatgacagctccctgaccatgaaaccctgtggcagcatgggttagttcttgatttgtccctggagttcccaggaactgcctgtgatggtctcaaaacacactaagtggctgctaggggccaaggggacctcagggaagggatgttgtagaaatgagctgaaccaaaggtgtgttttttgtctaccaaagggatagacaaaattacatcttaatttgttaaattgtaacaaaagggagcatgtggtcaacagggatataaaaatgacatacagatcacatagaaacatctatgcaggttgcaggtttgcttctctggtacttatttggaatgaagaaattcacgtgtctgaacggtcctaggaaaaacccttagtggacttttctagctctgtgctcagagtaagggcggaaggtgctgagcagccactgcttgagtcagtagccatcaccgcctacggggaggtcagcaatctgtttaatttgtcagtatgtcccttttcttccttttcttgtttcccttcctttgctccccttcctcactctggactcttagtttattctttcaactctaaccaaacttgatgcatatattgagggtcttctgcaccctatgctaggtgggtgctggggacatgagagtgagtgagccccatcttcatcttggggtaatcctcatttagtggagacaggcgtgtaaacagtcacagcgtgtttgcacagtgccatgtagcactgtgcctggatggatggggcaccaagggggctgcagcaagatggtgactcttgagatagccaggcagcggaaggacagccccgcgggtgtgagggcctgactgcttggaggacagagtgtacttggataacttcgacctgttcagatggtatgagctcgaagtggagatgaggctgggaaggtaggtaggacagaacacggggggtttgtattccaagctaaggcgtagaatggtatgtatggtcaacactcactacatatttgtggatctgagcagatctgatttttttcctgtagtcagtggggaaccatttaagaattttaatcaggggactgtcatgatcagatttgcattagaaataaaaatctgttgggagtctggagaatggattggaaggcagaaagactgtagccaggagacgaattgagctgctgcatgggtctgagacagaaataatgatgtgaagtgaggagtgtaatgggagtaagggagatggatgggttcaaggggcagaatcatcaggatttgtgaccagctttacacatggggtgggggcaaggactggtatgaatgagaaggagacaaatatcttaggtttctggcttaagtgattacgtttaggtatatttaactatatatagtagttcccccttatctgtgaagatacattccaagacccccagtggatgcctgaatcctcagatagtgcccaaccctatatacgctgtttcttcttatacacactgatatggtttggctgtgtccccacccaaatctcatcttgaattgtagcccccataagccccacatgttgtggggggggacctggtgggaggtaattgattcatggaggcatgtctttcccatgctgttctcatgacagtgactaagtctcacaagatccgatggttttataaaagggcagtccccctgcaaaggctctcttgcctgccaccatgtaagatgtgcctttgcttctccttggccttctgccatgattgtgaggcctccccagccatgtggaactgtgcgtccattaaacctctttcttttataaattgtccagtctcaggtatgtctttttagcagcgtgagaacagactaatacacatacatacctatgataaagtttaatttataaattatgcatagtaagagactaataaaatataattataacatataattataatgagtgaggtgaatgtggtctctttctcaaaatatcttgttgtattgtactcacctattttcaggacacagttgaccttggataactgaaaccttggaaagctaaactatagagaagggggacaactatttatcagtcagggtacagctggggaaaataacttgctctatgttactcccagatcatagacatgggagtgggagctgcagatgctgtttgaggcagaagagtttccatctcctcttgcccccccagtatgccagtatccctcagtgttgcctctgggcaaaacctagctggcagcaagttggcaagggagcctgggaaatggaagttcttataagagtaaggggatcgggatgcctctcagaacaaagtgaaatggtcaatgcagcaaccaaatagggtaaaatagtgctcttggcagttttggatagggatatccctgttggtctggaatccaggctggaatacaaattcagcatgtatgagtaaagatacttttgatagatgaatgtggtggagtagttaagatcactagagaaggtatatagagttaaaaaaaaaaaaaaaaaacagaagaagaagaaagaaggcaaggaaaaaaaactgtgcaaaacattggggggtgagcccaagaggataagttcatgaatgggactaagaaagcatggtcagagagattggaggaaaaccaggattgagcaatgctgctatattcagtggagaaaagttaaagatgaaagcactatattagttatctaatgctgcataatgagtcacctcaaaacacagtgagcttaaaacaacagtcatgtgttttgctcatgaattcgcagtttggccggggcttggtagagaaactcatctgttttatgcagctctagctggagtagcttgactgggggctggagtggctcatttcctggctggcaagttggtgctagctgttgtctgggagcttaactggggctgtgggccagggccttagttcctctccatatcagcctctacatggctgcttggtcttcctcacagcatggcggctgggttctaagagcaagtggcccaagagaataaggctgaaagtacatcacagttttatgactcagccttggaaactacataggattacttctttcttactcttttggatgaagcagtcacaaaggcccccttagttaagttcagggttggggaaatagactctacctcttaatgggagagtggcaaggttctagaagtgaattagaatgggaggtactgttgcagccgttttggaaaacatagtctgccagaattcctcaacgttgtcatatgggagatcaaatcagtaaagcactggaaagggtattttggatctggcgatttagggtggttagaaagagcagctacagtggcctgatcggggtgaaaaagaattgagactcaagaaagtggagactcttcatggagaatgtactgttttcagatatttagctgtggaaggtttgggagagttagggtagtggtcagagcagagcataggattaaatactgaggagacttcagtggaatcgtagctgatggggaagggggcaggttggggattcagcagagagaagtaattgctagatcaagtcctaagggagattcaagcgactgggaatgaagaacacaggtggaaaccttagcctttgtttcgagcccagtggaaggtgggaaggctgggtacagatgagtgtgtggggcagaggagagggggagggaaagtgggcagcagagtgtgtagcagcctgatagcctctattttttctctgaagtgggaggcaagaccatctgctgagaatgagggggtagaaggtagcattggagactcgaggtgggtgaaggtttggaacagctactgtgtgcagtggaagggagctgaccagggcaggagagcaggattgctgggtggccctgagcatccgcctacaaacctgatttttctagcacacctgtcagcagctgtggagcagccatagctgggagagacctgggagacttggaggatcccagggtttcctgaatcccagaagccactcctgagtcaggcaggaagctgcctctgcgtagtaaagccatcagggcccacttggacagtgaggacagctgtcgctttttctttgcgttttcttgctggctccctaagtaatggttgctgtaaggtcagagcaataatagcagtaataaagatttggcatcttcctccctgagataagcatcacatgcttttcttgggaagcacagcctggcaggctgtgtgcagagtacagagtggctccttagtagtggctgaggcagttctggggctgggaccacaaggcaaacctgagacccgcactcatacccttcaggagaacagctggaatggaggcctgaggccaccaccccatggatcatcaggattagcagcagcactgggtaacactgccatctcactgggcttcgtctctggtgggaaaagtcctgcctgggtctttctctggtacaaaaccaagaagggcccaactggaaagctcgtacttgaagtgaatattttgtttttctgtgttgagacctaaatggtgtcttatatttaggaatgacaatccaagaaaggtattaagcatttttggcttgaagagtgatttctaggggacatttagggctaccagaaacttagggacagagaggaggaaaagctacttttctgcatagcctctacgtctcctttcatgccaactccaggtgtggtgtgcccttatgcttctctcccactgttgtacactctcctctgccccataattgatcacagcctggtcttaagaggaaagcaatctgatgaaagcagttcacagtaaagagagtgactgataggcttaacctctttatatttgcatcttaagaggtgaccttctacacccaaactcataactactgtgcatttacagggtgatagaggtctacaggggtgagacttttgagagcaagggggtggtgactactggttgtgtcaggtgggatgctttcagttggctctaagaatcagaaaatccaactgaaagtggtatagctaatactaacccttattatctcacatgtgaagatgtctggaacttgggtcagctgttccaaggctgacagcccagcacctcattgtttgtaatgactcagactctttccatgtttcactctgctatctcagcttcctggctcgccctcctgagcgagcaccgcacgtagtcccaacacagctgcaacagttcctggtgttacaagtaggggacatcctcatattctttatcagaaaaaaaaaaaaaaagagatccctagcagagttcccttcatttgttattgtccagaagtaatgcccactcccaaatcagtcttggcaagaaaactgagaccaccttgattggcttaaaccaatcatgactcaccttctcagacctgctatccttgaaggacatgaaggatgtacaaacttggggttgtgttagccaggatgatgggggagatggctgttggtttggcctccaatagcatgtactaccctagagttttgtgtctactctgaacctggcagttttgtgtctcctgtgaaccttctcccttggagaggggagagagcctctaggatagactgttgaaggatggcagggaagggaggctgattctcagtaaatggtgttcagtgaatctgatggtgtcgatgactttgcacaaaagaaaaaggcagagccagggatgttttttcagctttgtcattatcacctgatattgtccctttaatagttggggcaactctacttctagatgcacggccagtgactcttattgatttgaatggctgtccagagccagactaattgggcccagagattggaacaatgattcagcaggagggggtgaactgatgaagcatagtccatccgtctgctggcgggctggctttgcagcagttcttttctacccacaatattggggagcttagcgggccatatctcactgccattctcactgcttgagggcagggtaggactcagatgatccctgagctgggggactaccataatctccaggtcctaatcaccctgtatcactcccagttatttctccagcttctgaattgatgaggaacactcccttgccctctcaccctaaggaatctaactcattgccaagtactatgcccttcatgcactactgggccccaaggtgctcggctatgttggggtgggactctttggcctgagcactaaatctgatctattgcttgatgtcatctggcccatcccaagggtctcaaaaagtgaaaacccatggcagtcatgtttttgaccttttctgagcagcattttcagtgcattctgtctaccatcttgtttcttcccttccttccttccttttttttttttttttgacagagtctcactctgttgcccaagctggagtgcagtggtgcgaccttggctcactgcaacctccactgcctgggttcgagtgattctcctacctcagcctcccaagtagctgggattacaggtatctgccaccacgcctggctaatttttgtatttttagtagagacggggttttgccttgttggccaggctggtcttaaaccctgacctcaggtgatctgtctgcctcggcctcccaaagtgctgggattacaggcgtgagccaccgcgtccagcctcatcttgtttctttactaaatgtgttgtttgaacagtgggtggctaggcaatgtttatgtcggcacagaatccaacagcgattttattttttaaaatatatattaaaaaatatccagagatgtgggccacccaaggaaacttctcttcaccctataaatctgttttctaaaaagcgtgtactttaataacttatcagaacaaagataaaccccgtgaatggcaagctatgtacatcactctgaactgattttcgatccttgttgaacgttcatttttaccagtttggatcggtacaggcattctatttagtgtgctgttttcccatggaacattatttcttttataatgtacagtaacttgataacagtaacttgcatttctagttgcattttacagtttacaaagctcctctgccttatcttgagcttcctattgtattgtcctgtgtcgttgtgttgtgttgcacgaggcagggctgcataaagaacgaacaagaaaagcccaggtcagagtttgttttgacaattcctgttttctactatgtaaaattggcaagaaaaggattaaatgaaagtgtatgtgtaaagtgttcgtagcacagtgcctggcatgtagtaggaactaaataatgataattccccttctcttttgctattgtaaataacagtcagtcgttttatttctttttcttttcttttcttgttttttttttttttttttttttttttttagatggagtctcactctatttattgccgcccaggctggagtacagtggcatgacctaggctcactgcaacctctgcctcctgggttcaagcaattctcctgcttcagcctcctgagtagctgagattacaggcacatgccactacacctggctaatttttatatttttagtagagatggggtttccccatgttggccaggctggtcttgaactcctgatctcaagtgatctgtccgtcttggcctcccaaagtggtgggattacaggcgtgagctaccacgcttggcccattgactagttttcaaacttatgtgtgactcttcattttttccattacatttctgtgtggcccatgattgatttttcctcctgcaagccaatgacccgataggaagatagtcttattattttaccttgaaggaagtattaatttttaaatataccttgattgattcataaggttctagatcaagtagagaattctcaggcattctgaaattacgattcccccaaattcagaagttatggctctttccactaaaacctcagaaatagaaaaactcattttctttggataacacatgtgaacatataattatctcagagaagcagacaaactctttgaaatattcatttgttcattcatttactcattcattcattcatgtgagtattcaataaacatctgtggagtgttgagtaggtggtaggcactggtgaaaacattggctgttagaagaattttatggagaagatgcattttgggagaaaaatcaaaaagtcaaattgataacaacacctgttttattttagttgattgcatgtgttgtcaaaaagaaaaattgaaatgaatctgcttaaggtgggctaagtagattcatttaagaagggagttgaatgaaaccagacggtgaaactgagttttattttactttcttcagccaagaaaagtctaaaatggcagcagcccgaactacttgaacccgacgactcttaacctgaccccctccccacccactgaatttcaaggggttggtgaaccccttgaattatgtgcaaaattatgtatgttcattttctgggcttcgtagcgggtatcaagttttaaaattggtgacctcctataaaggggatggtgacattccataaatctgagaaccactgacttctattcaaagaacccccttcattttaagtaaccaaggaagtgacccacaacccacaggatgccttagaaaccagttcgatgagcactgtaaagttttctgtgttatgaattagcttactaattagttactagcaattaatattagttaatataatagactgcttatgattaatgatgtcaggtattaccaagtgttaataataatgaatagtattaataatgactaattatgtaattgattagtaactggaaaatctttaatgtgcctttcagtgctgcttggatatcaatgataattaaaaattccacaaaaaacagtgaccatacaataaatgatgaggaattactgtttggccagaagcttcacccccaagtagagacctcactgggctacaggtagctctctgtgcatatccacgtctggcctatggtaattacctggagggtaatcagtaaatattgattggacaaatgagagagcctcattgtggcccctttccttgcccctctcgggcgagaccctctggagttgagattggagcaaaatgctggatagcttttcttgcctgcattccaagcccagaaaagtggaattcaggtgacttagatggcatggctggcctccgcctgggcctgggggaatcacttctgtttcccgttcacttgctctgcatctgctctggttgctgccaagggccatctgagggcactgtgacgagatttgatgtctggaggctgcggtgcccaggtgccagggcttgaggcatacagtccaggcctctctgttgccccctctcccttctagtcttgcttgatacaaacaaaacataaactaaatcaattatcataaggtcacaggtctagcccatgaaagaccagacaaaactcaaaagaaattaaactacagccaaatgtaattaaaagaagttttggtagaaattgagcatgataacacggtgcgatgattctttttggaatggcgtctggtacatcacccaggacatagggcttgaaaacaaagctgtaaatgccttgtagttaatagtctggctttagattgatttcttttgccaacacagcattgggcaaaatatcatagaacagggcaaaaagaagcatgagacaaggcttttatctggggctcagtaagtctttctggaaagatgggaaggggaaggtcttttggtaccaacaggcccacagcttgttagttcttattgccatctgctatagccagggttagagatggttgttctcagataactcggactgtcatttatactaagaattactgggtcaatcagtcaatgttctccccaggcctggcttcgaatgccagcaggagagcttatgggaggtcagggcccttctgtttccctcccagaattctggaacacctcctatgtccctggtatcacccttgctcacccactacagagccatcatccaggaacttgggcacccatctcaaatccagggccctggtggtggggcagccttaggattgtgtctctgctcatggcaggggctgtggtatgctgtgcacagatcactgggctcttctttaatttcacatcattaaactgacccctgaatgccagatacatcttctaaaaccccctcttaacatgtcatcactcaagaatccacagtggagtcaaattgccaaaaatcaaagcttttcatccaagtggtcaaattccttctctctgtctcctctcgtcttatccagctttgttttcttattccaatttagttttttattatgaaacattttagacgtacagaaagtatagaaaatagtattataaatgttcaagcaccaaacattcaacttaagaaataaagtaatgacagttacatttgcagcaccctcccagtgctttgtgaacagaccagaacagatcggggagcagccacagcagcagttgagctaagtgtttcagagcaagggctgtagagttggctgtggaattcccagggggaattctagctcggtacttccttgctgggcagattttttgaaaatcatataacccctcagagcctcaaattcctcatctataaaatgggatagcactttggtaggctgaggcaggaggactgcttgaggacaggagcttgagaccaacctgggcaacacagtgagactctgtctctacaaaaaaattaaaaaaattagctgggcatggtgatgcatatctgtaatcccagccactcaggaggctgaggtgggaggatcacttgagccttggaggtcaaggttgcagtgaactgtgattgatcacgccactgcattccagtctgggctacagagtgacatcttgtctaaacaacagaaaagggatgataagatgtgtatctgtgtgcctcccagagttgttgcaaggattaagtttagtagtaagtaaagtgcttagtttactattcgcagtagcaaagatgtggaatcaacccaaatgcccatcaatgggagactggataaagaaaatgtggtagatatacaccatggaatactatgcaaccataaaaaggaatgagatcatgtcctttgcagggtcatggatgaagctgggagccattatcctcagcaaactaatgcaggaacaaaaaaacccaaagaccgcttgttctcacttataagtgggaactgaacaatgagaacacatggacacagggaggggaacaacacacctggggcctgttgggcgacggttggggggtgggggagagcattaggaaaaagagctaatgcatgccaggcttaatacctaggtgatgggttgataggtgcagtaaaccaccatgacacacgtttacctatgaaacaagcctgcacatcctacacacatatcccagaacttaaaaaataaaataaaataaaaaataagtgcttagttagtgctgggcacgaggggaaccctcagcaagtggtagtcatggttaccgatgctggctgttgggctatcatcatcttggacttggtgcagagtaccaagcttatgggagagcaggagcctactatgtttccctcctggaattcagaggagggatgggccccaggggagcagtttcccttactctaggggagaaccaggcaggaaggtagggaatgtcccttggtatatgctgtgggccaaatgactggggtgcttgttggatttcaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtaggtgggacgatgcaatgcagggtatggtggtctggtggaagagtgtagcggtatgtgggtccctgccttgagcatccctttcaggacataattgggacatcttcttcctgagtcctcttactgaggatgaatgacatcactggtgatgtgcattaaatcacttgaaggcaatttgcaaagaaatatcaagtgtgattgttgacccattagtcaattaaacagatgtttattgaataatcgacaactacaagacactgagccttagccaagaacctatatgccgtggtctctgcctctgtgaggcatgggatggtgatgatgatggcgatgctgatagctaacactactgtacgctgggactgttttaaacacatgtgttttaccttggctcatacagttggttcttctgtaacaaaacatatgtgtccctagaaatactgcagttatggaaaatcacataagagaaaccacagagcttatggggaaaatagagttaggggcacaacactcaaaaaaattcatcagtggctgggcacagtggctcacacctgtaatcccagcactttgggaggctgaggcaggtggatcacctgaggtcaggagttcgagaccagcctggccaacatggtgaaacctcgtctctactaaaaatataaaaattagcctggcgtggtggcatgtgcctgtaatctcagctgtttgggaggctgaagcaagagaatcacttgaacccgggaggtggagattgcagtgagctgagatcacgccactgcattcaggtctgggcaacaagagtgaaactccgtctcaaaaaaaaaaaaaaagaaaattcatcagtaatacagtaatataggaaagaaaagaagataggaatgaataaaaaccagtagcatagttttacacatgttaaatggctaagaaatacataagaccacaatacacatggcactttaccttgagcctgctgtggaagtgggcatcagaagggttgctgcttgttagttttgtggggtggtgggaggagtcctttgaaatgggacggaggctgggcatggtggctgatggcagtaatcgcagttctttgggaggcggaggtgggcagatcacttgagggaaggagttcaagaccagcctggccaacatggtgaaaccctgtctctactaaaaatacaaaaagtagctgggcatggtggtgcactcctgtaatctcagctactcgggaggctgagacaggagaatcgcttggacccaggaggcagacgttgtagtgagctgagatcatgccattgcattgcagcctgggcaacagagcgagactgcgtctcaaggaacaacaacaacaacaaaaaagaaatgggacagaaagttgtaaggccagatgtgggtgactcaccgactcgcagcgatgtcgaggtgtgtttgttttgtgtattccaatgtggcacggctctgctggatgcagctttctgcattcacagtgtttctcgcagatgatagtacacataagcacatccaaaatttgcattatgatcaaactattccctaacatatcaattgcattggaacaaatttgtgttttcaaaacaagtattatagcagaactgttctatgtaataagagacacttaatgtgggaaacaatatcagataatatgaagtcgcagctgtcagtgccccatgagaagtacggcttctacatgctctgaggattcagaagtagggactcccatggcctactgggtcagggcaggctctgctgagaagttggcactagagttggtgttctttttttttttttttttgagacagagtctcgctctgttgcccagactggagtgcagtggcgcgatctcagctcactgcagtctccgcctcctgggttcaagtaattctcctgtctcagtctcccaagtagctgggatcataggcatgtgccaccatgccttactaatatttgtatttttttttttagtagagatggggtttcaccatgttgtcaggctagtcttgaactcccgacctcaaatgatttgcccactttggcctcccaaagtgctgagattacaggtgtgagccactgctcctggccctggagctggtcctttttttttttttttaattaattattttattattatgatttttctgagtcagagtctcactctgtcacccaggctggtgcgtagtggtgcaatctctgctcactgcaacctccacctcccgggttcaggcgattctcctgcctcagcctcctgagtagctaggactacaggtgtgtgccaccacacctggctaatttttgtatttttagtagagacacggttttgccattttggccaggctggtctcaaactcctgacctcaaatgatccgcctgcctcggcctcccaaagtgctgggattataggcgtgagccaccgcggccggccggagctggtctttaaggaccatcctggtgttctctcagagcacacaggaactggggagagagatgtatgctacaccactgttcttccaacacatttgtccttcctgaggtgtatgcctattaaaacagggttaccccctttatcccaacagtgcagggcttggagggctcttctggttgtctacactgagcttagcttccaactctaggatggatcacccttccctcttctttaccaggcctggagaatgcacgagaggggtcaccaagccctcaggagctccatgtgcaggttctagagccaacagtcaagctgtgctgttcttggggaggatggctcagaacattggatcagggaaaagggactctctcattcttccctaaggtgtccttttggcttttgaagacatcatgagaaatggaggaagtgtctatatttttgctctcctgattgactaacagggatggaatgactgaagatgtgtctattctaaccacttgagaatccgcaggaggaagaaccgcagctgtgttgatcagtgcagtgtattgacacattgactgtggtggaagatagaacccatgaagtttagctctttgtgtgtggtgagggttgggtacgtctccatactcccagtatgcttgactggcattttgttggctgccattgtcggtgtggatgtacagaccctcttgtgtgtgtaaatccaggagtgcagcctagatctggtgtcactgccccagccttggagctcaaaccaccagttcagtgaaaacttggctctttgagacaagtgataatgttaactaattagcataatgctatagagtctaatacatgcttctacttgcttattccatttcttttattcccaagcttgttgctgtgctgggagctgaggtttgtccctgctctggaaaacttctcatctagtggagggacagacacagcaatgtgttgttgcagtgcaggtttgttagcaccatgacaggcattcatctgtgtttctgtggattcccaagaggaagtacgtaattctacccaggataaagggctctggtgagtgcttctaagaagtattgactataggcaatatatattgattatttcttcttcatcaggagctgctgcattgaacagtctgcaggtactatggtgttgagtccttccagcaggcatcagcccatattgcagaggacagtttgagtagaggagctagggcaacatcccagattttctgacttcaagtgtggtgctcctctcaggatactctgctgccatttaccggcaggggtgcccctcagagccagaactatgagccagacagaaccatctcctctactgttcccatggaaacagcaaaattgtcccctggctggggccaactggcaagtgccagaccaagacatgcaataataacaataacacacatttttcaaatgaagatgccaaatgggtaaataatgaatataccaatttgacctgctgtttccaaaacttgcacacccttcctaagacagtggtggaattaaggctcttgagtaattaattttgcctaaacacataacaagggggaagtgaattttgcactgtgaacccagttcagctcttaaaactggagatagactgcttttgcacactggctcccgatcacaacatctgtgcataattaagcctccgcaaagactttacctctcagtgtgtgaggcatcttccggtgcttatgtgcggtttaagaacctcagccctgtgctataaatctcccaggctcagacaagcactgaatgcaaatatggcgtcagggggactgggagagggtgagggggcagctaggctgaatgattaaggccaggcttagtggatctggcagcagagcgtatgtgccaggggatggaaacaggacaagtggtagggtttgtgactcacctggggacaaggtggcaggggagaagctttataaccacagggtttgggactggaagtgatgagaccatttctgtatgtgtggaggtggggataggtgtgcagggccatgccagggttccttagtgtgaggtaaggagcccaggactctagaaattgtggacaaaccctgaggagatgtgcatgctttttgggaagtatgataacttcccatgaatctcaaagattaggaactacagatggatagtaattaatatataacttcttttttgcagagtgatttatattctttaattctttaattcttacaacagcctcacaagggaggtgccataatcacccccatatcatcagttgggagactgaggctcagagctatcaaccctttgggcagggtcacaaggcttaccactaaggggagggaatagaggtagcctgctccagagcctgcatgttcaccctccatatggttttgctctgtggggaagttgtgaattccagtgaaccgtctagagcataactctcagccctggtgtgtatcagagccctctgtgaaactcgatgtggctgtcctaagagcaatcgatgttttttccagcagctgctagtgtctggttccatgttgagtgccagtactctgctcatagtagtgggaaatgggggcggaggtggggttgtgcttccactgtaaccattatcaccatatttttggtggagaaactggtgttcagagaggttatataacttacccacagtcacacagcttttaggtggcagagccggggctccagccagcagcctgactccaaatctgccggtctgactgcatgtctccaggccttctgctgtgctggactcaggctccaggaggactgtgggcctagggtgatgggcactgtctcagacaagccaggcgcagcctgtttcgtgggcatgttgaccaaagcatagaaacaaagcagaaatgtgaggtcagggccagactgtgaggctgaggcccagggtcttgggctaaaacttctctaattggtgccctccttcttggggtccagattggcatccgtgtgggaggcaggaggagcccacaggagggaggcctctgctctgtggcaaagaggtagaacctggacccaggggtcctaatggtcagggtgtgaccctgctggtggggccgctgagcaccctggccatgagctccttagagtttcagcttgctttgtttgggggtgggatgggggagtgcggggtgcttattgactctttcaaatttctctttttcattttttccttctttgatggaagaagcataggacaggaaatgtgggcgctcacttcaccccacacccccaggtcctcctgcccatctggtgatttaggcgcagctcacttttttaactgagcaggagcagtttggcattttgcagtcatttccatgttatgtctgtccaggggcacctgtggttctgaagctcccatgacaaattccactgtttcccaggtttgatattttagtcatttcagatttaagcagcagaagcaaggggcacattctgtggttagactggaatggtgatgtttgcagggagaccaaaaagggggaaaccgcagtacacccaggaccctgatgcacaagcacagagaagctccagcctgtgggatttctgtttccacctgtgactctttcctagctggttttttttttttttttttttgagatggaatctcactccctctgtcaccgtggctggagtacagtggcgtattcttcacccactgcaacctccgtctcccaggttctagcgattctctttcctcagcctcagtgatctgccctccttggcctctcaaagtgctgggattacaggcgtgagccactgcgcccagcccctcgctgttttttaagctgcctctggtggggctggctagagatttgacctcttgtctccagagccttaggggcccactgtcaaaggtaggtttacaaacaaacccaagggaagaatttaacccgaaaatatgtcccattcatttggaagccatgaacaaaaacaacaggcagggcacggtggctcacgcctgtaatcccagcactttgagaggctgaggcaggaggatctcttgagtccaggagttcgaggctgcagtgcgctatgatgatgccacagcattccagcctgggtgacagaatgagaccctgtctctaaagaaaccgacaaagcaacaatagcaaacatgcactcacttttttaaaaagaaactttttgaaaaatgccaagcaagtctaaattttaagttcaaagtatcagtttcacagatttctctattggcccagattttcaaatggcagaaaccgcagtcaagcagcaaaccaaaataacaccttgctttctggtggaaactttgttccaactagagcatttcacttgtatgtacagcccccatttatcctcagaggtccttactgagatagggcagaaacaattctgctttccagtgaggaagactgggatgtaaagaagttaagtggctagtctaagacacaacagtattagcagaattaggaacaggaaataggtctgttgacttgagggccactatgttattgctagatgaatttgggtggtcagggtaaaggaaaatcttactctccaaaacatttgaaaaagctgcccatgtttctttatttgtaagaggaaataaactcctcacaatttgggggaaactcggcatgctggaagcccagtaacccctccctcctggctgtgggggtactggtgggtgtcccttgctcacatggcagcctggttgcattctagtctcttgcccgctcctggagaaatctgttctctttttggtttttgagtgttatgagagtcagagagggttggagagtgtatgttagtaatgcatttgtctgtaggcaactgaaagcctcatttagagtgccttaaacaaaagaatttgttgtcttcacatagcaagaaggtttgcagtggttgcctactgacatatggttttggtggtttaacagtaccagagctggcttctcagatttttaaatttttttatttttcctcattgttgcaagatggctgctacagcaccaacagtcacattcacattcactttcgaggcaagaagagaagtggaagaagagtagcactatgcaaatacccccttttttttaaatcaaggaaataaaaaccttcccagaatcccctagcaggtttccatttttgttcataagtcagaactatgtcacatggccatacctactataaagcaggcaaggaaagtatttaggttttttatttgtttgtttgttttcagacaggatcttgctctgttgcccaggctggagtgcagtggtgtgatgtataaggtcacagcacactggctttgacagcgatcctcccaccttagcctcccaagctgggatcacaggcacgcaccactatgcctggctaatttttgtatttactgtagagacagggtttcgccacgttgcccaggctggtcttgaacttctgagctcaagcaatccacctgccccagcctcccaaagtgctgggattataggtgtgagccactccgcctggccccagtatttagtttttttcatctctagggaagaggagggttgggaatagatgttgggttaatatccaatgttgtctgccccaggaaacgtgttttcctacaggaaacaggcatgagaaacaaaatttatcatctggttaaaactcagtcatttgctcaatacacacaatgcacccattacctgggtgaaatattggaggcagagggaggagtccgaagtaggcctggtggcgggatggggagaggaaatatccttaacagcaatgcccaggtgtgaggtgttccaacattttcctcccaagtcccaactttagttttggctcttaacagcattagaaggcactgaggagagttggcaaagccggtatctaaaggagtgggcggaggcctgctgagcagaggtggagtagccagcctccctcttggcctggctgtcccatccccactgtcaccgctgaggtccctcctgggcctcttctcccttgctctgggaggagcctctgttgctgtctggctcgctgtgccacattgtcatccttgcccgattcccagcttccccagaccatctgacctgtcccttcctatcccaggtcccccgaatccactgggacctgtccacggagcgggtcctcctgatggagtttgtggatggcgggcaggtcaatgacagagactacatggagaggaacaagatcgacgtcaatgaggtgaggtcaagagctcagggctgctgtgccggggaacgtgggcttggtcaaggctgcccaggaagtgcctgtgtgtccaggtgaggcctcagagtctggcccccttgtctttaatagggcccattgtctggagaattataaactttgagcaagaaagattctttcaggtcatttaggccagccctgtgcacacagcggcctgcagggacatgctgaaccccttctgccattacctgcttttcctttgtaccatctgagccccacaaagctaagcggccacagagaacaatgatgcaaaatcagtgggacttaatccttttggctctgtggggcctgtctgttgtctcttccctcttcctgcccttctctctccttcccacttcccagatctcaagggatcaggcaaaaaggggacagcagcaaccaactgcatcagcctcctagagcaggaaaaaagaggtgggctttgtgtgtcccccctcccatcccccttgtcccagggaatactggccagtgggtaggacctgtccctcactttctgcttcttggttgcacagggtcccacaggaatgggtggagttgtactttttcaacaacattcataatttcatttttatgtttttagagatggggtcttgctctgttgcctagactggcgtgcagtggcacaatcatagttcactgtaatctggaactcctgggctcaagcagtcctcccactttggcctctcaaagtgctggcattacaggtgtgagccacgtggccaggctcaacattgatcattttaatagtgtctgctatatgctaggtatgggggctcgcagggggaccagacctagtccccagagcttagcatcagagtcagacacacatctaaatccttgctgtatctcaggcagcgagagggtgtgaggagaaccccagggagagtgaggaagaggcactgaggcctgccacaggttggtgtccccagcaggatgagtaggagttttccagggagtggctttgcaagaaggggaagggaatgggtgaagtttggcagggctggggcaggattccttggggtgtgtggggagataaagtaatggtcttgggtgtgaccttgaggcactgtggagtcacttcagggttttggggagtgcagcaacatgttctgccctctgggatggaaggaaggaagtgggccacgcccagtggaggtaaatgctttttttttttttttttttttccctgagacggagttttgctcttgttgcctaggctggagtgcaatggcgcaatcttggctcactgcaacctccgcctcctgggttcaagtgattctcctgcctcagcctcccaagtagctgggattacaggcatgcgctaccatgcctggctaattttgtatttttagtagagacagggtttctccatattggtcaggctggtcttgaactcctgacctcgggtgatccgcctgcctcgatctcccaaagtgctgggattacaggcgtgagccaccgcgcctggctgtgaatgctcttttctattccactccccatgtccacaggcagtgcatgaagatgagcgtgagcatgtggtcccaatggggagttggcccacaggagaaagccataccttggctcagcagatgagcccaggggggtggcaggggagtgtggtggttgcacaggcctcctggtggccatgtgactgctgtaaatggggtcagtatctgcctctaagaggggctgtgaagactatgtgagttagggtgcaaacagtgctaagcacagtgcctggtgtgtggctagcattccagaagagtagctgggtggtggttgttgatttccttatattatctttgggctctgttctttctttctccttttaccattagcatttattgcatgcctaacttccctgtgccaggcccttttctccataataaacttatgagggtggtctcattgtctccattttgcagacaaagaatcagagtctcagagagagaaggtcacacagcttagcagaggtgggattgagacctgagtctccctgatttcactcttcctgttaggccacaaaggaggggccgcatcaaagtgcacagagctgctgccaggagcatggtgggaacgtttctctgtggctggctcaggccttctaggaaagctgttgtcccctgacttagggaacagtgcttcaataacccattcaagggccttggggtgtgtgggatatgggcaggctacactgaaacagataccactctgttttacccagggcagctttgccaatgcgtgagctgcctattggacttttctggaagagttctgctgcttggagggaaagggatgagaaaaagagttcatccttctattttacagatggggtgaaaagttctgagagggagcaaatgtctttcctgaggtcacttggccagtaacacaagtcagggcttctgactctgctgccttcactggtggcttctagggtggtacatgggaggtgttcaagcagaatacagtctttggttccagtggcgaagggattcgatgggatgggaggccacctctggcctttcctgaacggccttaaagggaaacagggtctgtcgcctgctgatcaggaaatatcccagaggcctcatccccgccaggttcctggcatttacttactaccagctgtggaggcattttcattccagcaacaccctcaagtccattaatctctttggatccagtgagcccagagccgtaatggtgtttaatcagaggcaacgttgattttccaaacaaatgcaaacacagaaaggtgcgctctgggtagttgtttgcttatggctgagtgctgtgcctggccggagggggcagctaggctggagctgggcagtaggagctgggcagggcgtaccctctgaggactggtctcatctgcttctgcctccccgctcttttgataccttgtagataaagccagtggtctgtgcagagcagatccttggtagacattcttaaattagtgaatgggtaaacaaaccagcctcacaccctagattggcctctaccaggcaggcctaggggagagtgttggttgttttcttgtggacatgcagaatggggcaagctgatatcagagttatttggggaaaaacaataactaataataattataagcaactaatatgtgccaggcatatgacacacataatctctactcattacagctctcctatacagtatatattattaaccctatttacagatgagaaagcaaatgctcagagaggttaaacaacttgccccgtatcacacagctagcaggggtagaaccagggtttgaactcaggtctgcatgactccaaagtccttgcccctctaccttctccatttccctgccagggatctataggttggtgcaaaggtaaatgtgtgttttgttttttattttgggccattgcaaaaaccacaattctttttgcaccaacccaataccttgggctgctggaacctggagccacttggtaactaactactcagaggagctggagcaccatctgagaagcattgctctgcaccaaggcagtgtctgaatgtaacacctctctctctggcttacatcaaggatcacttcatagaaacatttttctgttttatcgtacccatctctaagtaagtgattttgtgaggactgtgtgagttaatgcacaaacaatgctttgcacagtgcctggcgtgtgctaagtaagttccccaaaatgatagtgagatgaatgttgttgttgttgtcattgggctatttttttctcttctacctccccagctttctttttttttttttttaaaccattaatgtttactgactgcctggctctgtgtaccaggagctttctgcattatcaacttatgagggaggtcttattgtctcagatttgcagatgaagaatcagagactcagagagggaagataacttacctgaggtcacaaattttaattgtatacctcagtaagtttccatgtgaatataatatgtaatcactgtccagataaagttgcaagtcatttctagctccctggcgagctctctcacgtccctcccggagctaatgctcttttgagttctgccaccatagatgacctgcacccattattgaacttcacataaatggaatcatacagttttgggatctgacgtctttgtcatcaatgtggggctcttctggaatctattttgtttcattggtctatccttgtaatgccacactatgttaatttcttaatccccagtccctggcttttaggctttgcatgacttggtagctctttggcagtctgagatgatgttattaaatacttccgcagaaacccccacagtgggctatgggccactatggtgctctaagtactgtcacttaccatcagtagtgttgggagtagattagggacaggccttactctgaataaattaatctatcatgtctcttaccaactaacatcaaagccacggccttgaagactacggaggagcgtgtgtgtgtgtgtgtgtgtgtgtgtgtgtgtgtgtgtgtgtgtaatgaaagagtccacaatcctgaaagtttcagatagactcctgaggttctaaagtctccttaggactgtggtactcagcgagccagccctggagtgactccctcctgagggcagcctggctgtgagcattccttggggagggaggtacaagggctagataggagtgacaggggcgaaagtcttactctgaatcctagggtgtagtgtgattagtggcatcttagctgctataagcagatgtctatcctggaagatggctgtagaagggacccctcttgaggtgggtggggatggctccagagcccccaaccacttgttgtatcagcctcactccgctttgaagaggcctcctcaccctacagcatcccagtcccactcggcccaatagacttggatagggaaacaacagtttagcaggcaagagggataggttcaatctctgtcctgctggtagcttgctgtataaccttaggcaaatcacatcctctctctggtcctcagtatgcttattgaaggtgtggaactagctaggctctaaccaagaacattgattcttcagcttggtgggagctaagacttgttcaccaaccatctcttttagaatcactataggggaaaaaaaggaatcaccaggggagcttatttaacaatgcagattcctgggccctactccaaactcactaatccaaatccggggtggaaaggattgtagaagtttgcaagaatctgcatttcaacagactgtccaggcggttcagacactcactgaagttcaggactccccatactgaaacatgaagccaggggctcaggccttgccagaagtgccatctgcgctcaccctgctgatctgcacctccaggcccgagacagccctgcccaggggtgcccacctgccagcaagcacgggcctcgggagccagcagcctgcaggggccctcatttgtttgtgtctgtgagcccagaagcagatattaccaagggcctgacctggtgatcatatttgccagtcactttaagagctggcgacaatgactgtcattgatctcattaaaagtaaaggtcgtgcaggagtcctctttcccgggctgggtggcgcctccccaagccacagaacaactattgattgctggacctttatcgaaggttaattggatttcagtgagtctgtgtttaagatcctgccgaggctgaggttcaatgtaatttgtgtgaaattagccaagaaagaggtgacagagacaggagtgtaggggcagcagggacagatgactggaggtctggtgggcagacactgctgtccgtgaagattgggggtagtcctgggatggggttttagaagggacaccagcctggctgtcccagagacgtgggatccaggaggcgagagtgccagagctcctcagtggtcattatgtggacttaggttcagtcccctgtccttggggtggtgctgctggtgtgtggtgcagcctgcagagcctgtctgttcccagagcatcagtctccatcttctgtcagggtcgggtggggatctaggggtttagctggtacttttaaagtctttcagttaatctttctttttcagaacccccaaatctcattttcagaggtgctggagtccctcagtttctgagcctgcttgaggctcagcagtaataattataaagctctcctgttgccagcttaggggtccatgttttctagcctgctgagtcacttctcagtagctccctgcagcaaacacaattttgcttatctcactttgccttctgttgttgcctctctattcttttcttgttgtggtggggtctttgccttctttactacttttagagtcactttagtggggttcgtgaaggagtagagtccgtggcctgggttccacctgccatgcttagccagaagcccttgctatgcttcttctagtagttcttaattccattctgtgtcattgcaggagcagcgaaaaggtctcacatttgctttcagcaaatgatttctcgagcagctaccatgtgcaagcactgagtgcacttgctacaatagaggtgtgagcagagtgtgggagagggtggggctgggtgaggctttatagaggttgggtcctgggtgggaagagcagagggtttcaaagttagggcccctgagattgtgtattggctggtgcccttgggtaagcaacatcctctgagtgtgagttttctcatctatgcagttggagagataacatcacttactgcatagggtcattgtgtgaattttgcaaactgtgaagttttgtaaaaacaatgttactgttacttataattcatgcgttcatggttcacagaggcatgtcttcctccatagaatcttcgagaatcctctttgctccccttcctgcccacttacctctattttctgagtataaagacttggagttgggtaatagtcatctattaagcatatggtacccccttacccccactgtaaaagccatgctgaagtttctacctttccccttgtcaccacctccagttgaataggacatttgcattttggctcagtgtcatttttcccctgctgggcctgtctggctgtctggtagaagatgcccagaccaacatagagcagctgcggaggcatgaagaccttctaccaaaatcaccagaagaaaacatcttcttccattgtccatcccttcattgcttcttggaccaaatcttttttttttttttaatactttaagttttagggtacatgtgcacaacgtgcaggttagttacatatgtatacatgtgccatgttggtgtgctgcacccattgactcgttatttaacattaggtatatctcctaatgctatccctcccccctcccccctacccccagcctacaacaggccccagagtgtgatgttccccttcctgtgttcatgtgttctcattgttcaattcccaactatgagtgataaattatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaatgatgagttcacgtcctttgtagggacatggatgaaactggaaaccaacattctcagcaaactatcacaaggacaaaaggaccaaatctttaaaagagctcagggatgttagaggggtccaggtgtatgagatgagttcctggaaatttatttcctccacagcaaaggtgtcaggagtgagtaactgtgttgttgtggagttggccttcctggattcaggtgttggctctgctgcttataagctgtgccaccttggtgaagctactcacccttttgaagccccagttaccttttgtaaagtgggatacaagagagtaacccactggatcgtttgatgactgaaacagaacgcttggtacggtgccaggcccagcatatgtcctcatcacatgttgaattatgctgaattccaccccttggaattttgtggtgtcatgtggtgctcgtagtacattatgtgccaaaagatggggggaaacatgtagggaagaaaccctttccccatttttcatattgacccaggtaaggtggaaagataggaaagtatttctttggactgagttgttgtccaaggccagagatgccagatgtctctgcttttcctccctttctctgtgtcttcccatagccaaggtccctaggacccctcccacctgctctggtatctgggtaactttaatgaatgtctctggccagagacttgaggaggctctctggccagagagactcattaaataccccatgccatgcctctctgtgatgttccttttcaatcctaacctagagaagctttcactaggtacctagaagctccaaaattagagtaacttcccagtttcctgtgattttactcagcatctcttctttctatttatttatttattttaatataggttttcactctcacccaggctgtggtgcagtggcacgatctcagctcaccacagcctggatctccccaggctcaggtgatcttcccaccccagcctctggagtagctgggactacaggggcacgccaccgtgcctagataatttttgtatttcttatagaggtttcaccatgttgcccaggctggtctcaaactcctgggctcaagccatctgactgcctcggcctcacaaagcccctcttctttcttcctcactatctctcccgacaccatgtgtggtcgaagaggttcccagcacctttgcgcttacagactccacctcagcatttgttagtccaagattgctccacccatggacaagtttggactccatgctgggcagctgtttttaatcgaggcttacaaatcccaaaggtggttcctggggacaggggtggagattatggtaaaatgctctagggccagcactagtggctcatacctgtaatcccagtgctttggacagggctgaagtgggaggatcacttgaggccaggagtttgagaccatcccatcctgggcaacatagtgagaccctgtctctacaaaaaaataaattagctgggcatggtggcacatgcatgtaatcccagtttttctggaggatgaggtgggaggatcatttgaacccaggtgttcgaggctgcagtgagccatgatggtgccactgcacttgagcctgggctacagagtgagaccccgtattttttttttcaaaaagctctaggtctggtctagtctttcaagctgttatgcctcaaaaagcctgggcagaaactggaggaaaggcagagagagtttgaatgattaacctccttatagttaatatcaggctactcatgtgattatcaatatcctgtaacaccaaccccgtttccttcagagatcttggcctttcttttaagacaccccccaggaacatgaatagattttctcttgagggtgggaataaattaatccatgtaattatagaataattaaagtacttttagccaattcaagttttgagaaaagtccaaaaataactcattgatttaaatattatttactaaattaattctctactcagtctttttatagattcctggtttttttcccctccctactgttagagaataaaggcattgcataataactgaaatcacttatcgtgaaaggcacattttttttatgtggaacaattaaaagatttctcattgacttttttttcctaaatggcactgtactgtagctttagttaacagtgtggttttggttagctgacagtcctggatttcccactgagactctttttttcaaaatggaacattttgccggcttctggggttggagtggggtggtgttcagatgtctttggtgcagtctctgtctccaggaggagcttccctgtgagtggagaggcagtataacggagcgattgaggcctgttctctggagccagtgctcctaggtttagactaactgccgaccaagtgaccgaactttctattttgtgtcctgattccttcacctgtttaatgcagaggatggcagtgagtgctgaatctgttagtgtaaagtgcctggcatggtgcctggtatagtgtgttagccatcattatttgtcatgctggacccctgtcaacttcagtagggatggcaccaggttcaagaggccaaagaagagacggtgagtgaaacatagatttaaacaaatggtttatatgggggaacttacaagacagttcagtggcagcaggctggacaggaaaaccaccaccacttgtaaaaagcatgcagttcatatcgtattttcacttagtaccctgtcctcagcaaccttcacctagcaacccatatttctgaagttaagtcaggtgtgtctgccttaatcgtctgcttaagttattactgtcagatgtgtctatcatgccccattctaaaaagatggtgcatcctgtcattatgcagatgccaccgttcacagggcatggggcagtgttagggacacaatgatctgttcttaagcaagacacataatgtattatagaagggagagagggtcgtgtgcccagtaatggccttaggttgctcctcaatgcctctgagtaggagggggctggcttccctcttctgggaaattcagttcctagaaagactaacacaattctaagagctgttatccaacacttagaaataaggccaggagagtgtggtgtgacattcttgggcattgttcaaccagctccctagaggatttattttaatatctagggaaatgtacttttgtttgactttgctattgacaattaattaaaggcacagagtggtcatacatcaacttgaagatcttatccagtagagatgcaaataatttctgtctagtataaaagataacctcaaaggttgtgacttctttttatgcctcatagaacagtaacctgtttttcagctaatccagaaaccttagtctcttattcctgtttaaacgcccataaacacctgcttcctcaaaattctctttgaaccagctctaccatcttacttgcccccttatttatttatttatttttgagatggagtttcactcttgttgcccaggctggagtgcaatggtgtgatcttggctcactgcaacctccatctcctcggttcaagcaattctcctctgcctcccaaagtgctgggattacaggcgtgagccaccacgccaggccccaatgtgtagtcttttatccctcacccttctccccaagtccccatagttcattgtatcattcttatgcctttgcctttgtgtcctcatagattagctaccacttataagtggaaacatacgatacttgtttttccagtcctgagttacttcacttagaataatggtctccaattccatctacgttgctgcaaatgtcattatttcattcctttttatggctgagtggtactccatggtctatgtataccacattttctttatctacctgttggttgatgggcatttaggctggttccatatttttgcaattgtgaattgtgttgctataaacatgcatgtgtgtctttttcatataatgacttcttttcctctggatagacacccagtagtggattgctggatcaaatggtagttctacctttagttctttaaggaatctccacactgtttcccatagttgttgtactagtttacattcccaccagcagtgtaaaagtgttcccttttcaccacatccatgccaatatctattatttttgattttttgattatggccattctttcaggagtaaggtggtattgcattgtggttttgatttgcatttccctgatcattagtgacgttgagcattttttcatatgtttgttggccatttgtatatcttcttttgagaattgtctattcatgtccttagcccactttttgatgggattgtttgttcttttcttgctgatttgtttgagttccttgtagattctggatattagtcttttgttcgatgcatagctgtgaatattttctcctactctatggattccttccactctgtggattgtctgtttaccctgctgattatttcttttgctgtgcagaagctttttagtttaattaagtcctgtctacttatctttgtttttgttgcatttgcttttgggttcttggtaatgaaatctttgcttaagccaatgtctagaagagtttttctgatgttatcttctagattttttatggtttcaggtcttagatttaagtctttgatccattttcagttgattttttataaagtgagaggtgaggatccagtttcattcttctacatgtggctagccaattatcccagcaccatttgttgaagagggtgtcgttttccactttgtttttgtttgctttgttgaagatcagttggctgtaagaatttggctttatttcttggttctctattctgttccatcggtctacgtgcttatttttataccagtaccatgctgttttggtaactatagctctgtagtatagttagaagttgggtaatgtgatgcctccagatttattctttttgcttagtcttactttggctatgtggacttgcccccttattaacgagttaaaaaaactttgacacatgttcattctgtatttatttagttttacttttaatttatgtatttagagagaaggtctcgctgtatcacccaggctggagtacagtggtgccatcatagctcactgcagcctgaaactcctgggctcaagtgatccttctgccttagccacccaaagtagatagaaccatatgcatgctccaccacacctggctgaatttttaattttctgtagagatggggtcttggtatgttgcccaggctggtctgaaacgcctgtcctcaagcaattatccctcctgagcctcccaaagtgctgggattataggtgtgggccactgtgcctggcacacattctatatttatatgagccgtgctttaaactttgaaaattaggctttgagggtgatagtgggtatgtattttttctaagttaaaaatgataggccaggcgcggtggctcacgcctgtaatcccagcactttgggaggccgaggagggcagatcaagaggtcagggagatcgagaccatcctggctaacacggtgaaaccctgtctctactaaaaatacaaaaaattagccaggcgtggtggcaggcacctgtagtcccagctactcgggaggctgaggcaggagaatggcatgaacctgggaggcggagcttgcagtgagccgagatcgggccactgcattccagcctgggcgacagagtgagactctgtctcaaaaaaaaaaaaaaaaaaaaaagaaaaaaaagttaagctactgcatgaaaaacaaactgtggtgtgcgtcttatagtgtgtaaagtgctttctcatatgtgatcctattttgacattgaatctcaaggttgctctgtgagcaagtagagcaggtggggttagtcccacgtagccgctaagggaacttggacccagactgagaagagaggtgccttatccccagatctcccatgcccagagtgacagaaccatgccattggcagggactccccctcctgtctctgtctatgctggtgaaatctggttaaaacaaacattaggaacagtcccaaatggaaagatagagttggaggcaggtggattgggggtgttgagatggagcgggccactctggtggctcttctcatgtggatatgagcagcaattggcagcccccacccttcccaaccccaccagcagcagctcactcctcagaggcaagggctcccaatcctgagcccccagacccttaggggccatctttcaatgtagtaatagggggcccagagcgattagcaatatttcagaaagcttaagggagatcatacatctccccatgacaggcctgcccagactaaatgaaatgtcatttctctcattttttggctggaattctgtcagctcagtctggctgcactgcttatcttgggctgatcaggagccctgattggaccttatatgtgtccttgacaaataaaaatgaatgattacttaataaatgcaattggtttggcagatacagcctttcaaagcatggctccatgaagctccaaagagcctcacagaagaggttattggtggcatcgagatggggactgacttgctggcccacccaggaccagccctggctgggggccccctctccagggaagcagacagtggtggccctggggcatctggcatctcagcctgagtctgagaacttgacctggggcaaagtcctgctcctaaggccaacagacactgagtgcagggatgtctgtttcaccccaggaaaatggcaggagctggagggctggcgtggtagcgggcatagtgtcttacatctcttcacctcttataaacatacaatgaaagctagtctgctcaccttccaggggtgttatgaggaatcgggggcgcttatgagagtcaccagggcacagcaccgtggcattctcgtttaccttcccagtgacccctgagagtgggactattattatttccattttactgaagctgatggcataaggaacttgtttaaggtcacagcgctcaattgaaaagtgcagaagtgggtgcaagccagcgtagaatagcagttactagaaggctgcggggtcagctggtgtgaatcttggctcgacccttttctagccatgagttagttaaaccttgatgaatcagtttcacatctgcaaatgaggatcataattgtccctacctttgggaggctaataaggatgtcagctggttgttactaaattagggtcattcttgatgatttaatttggggcaaattataattgattgggattcagaggagatgaatggggttagaataaacatcgaggcaggaaccacagcatcttaggaaaacagagagatgagggtctcacgttgaacgcagagtcgtagtcacgtgtttgccactgttacaagcaagtggatacataatagagccagtctgtggtccataaattatacctcaacaaagctgtttaataaagcagagcgagtccctcctatcttgggagtttatgatagtgggatagatggtcattaatcaaataatcacacaaatagtgagctagtgccctgaaagaaaaggcctttgagaacgtatggcaagggaacctcattttgcctgggaggccagggagggcttcttcagagaggtgatgctgatctgggatgggaaggaagagagagggtaagccaggtgaaggggagatggcaagaatgctcctggcagcaggaatagcatgtgcaaaggccctgaggccagaaagcacacggattgctggggaagagaaagagtgaatatggctggaatgtcagtgtggtgtgagatgagaccaggcaggaggcagggcctggtcaggtaggactttgtaggctgggggaaagaggagaatttttaagatcccaatcctgtgttccccacccgtgggccccagctcctctcccctctgaccaggttaggtttgttaatgaccatggggtctagccgaggccgagagggttgcctagggcagcttgtgtcctggcgtgtcagctttctgggtcgagcatctctttgttccctggaaacctgtcaacagaccctctatgggcccaggtctggctttattcagcagctgttccttagcggggaagaggcttttagctttaataaaaaagggactagagataagaagactgcctcgtcagggagagcagcagtgacaggatgatttaaacggcttctctagtgtcatttcttctgtgcagacatcataaatcagattagcattgggctctggcagggaggggagcagggagaggggaggggagcagggagaggggaggcgggcctgtgactctgggtccacctagcacaggcctggagcaggtggggcagccccagaggaggcggtggggtcacctgctcctgatcctcagccccctcaccctgttctttggagaaggggtgagtggaatgactccctcagcccagctgttcagcccattctcagctttggggggaaatggagaaggactgataaaagggtatggaggagagaaatgggggacaagtcggggggcgggtgtgggaggtggagagtgcagttctcctacctaatcccatgttcacgtcacctcgaactttaaaaaatactggtgccttgtaccgcccacatggtttcatgattctaaggtgcagctaaagttaagaaatcttaaactcaaagagtatgtcatctcaaacaatcactcccaccacaaccgctccggcccaccgattttctctggcctccccttaaaagtgaccacattgagagaccagacagaggtccctcggatagatgtgagtggagaggagctcccacctgcccctcttctctttcagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccaggtagaagaggcctttgttacccagccctggggcctctggggttagagtctgctgaccactctaattagctgcagaaccgggagggagatagcgagggtagctggaaaggacccttccctctcccttggagctgtcattttgtgcaagtcactgtcacagagctctcagagcttcagctgcctcctcatgaaggtgagggtgacggtaccccctttacaggctattgtgaagagtagatggaaataggcttgtatgttagattatactttcccatggagccccaggccagcaaggatcctcagaagtgagctgtcctctgcatgagctgggactttacggggaaggagtaactacatgtttaggcctactgaggatatactacctagtgggaaagggggcaggcagccagtgggggctggagggcctcagactgtgtcctcaggatgcagatctggttcaaaggagccaggagctcctacttggaagatgggaagttcactgccaatctgggccccaggggattctgctccttctctcagtgacctgatcccacatcccagaatcttggcctcttctgaaaggcttaacgaagtagaatgcattagtttagggtaggctagctgttttcacatgtggccccaaaatgatggcccagatacagcaggagcttaattgcttgctcacatgccagtcctggatgggtggaggagactgccaggctctgcctcccaagcctcaccagaggtgatggtgctggcagctggcggcagggtgagggcttggaggagcctgcaggggaaagtttctgtgggccaggcctggaagtggagcttctgccacattccgtcagttgggctcatgctgaggaccacatctaactttgagggaggctgagaaaggaggctgtacctgggaagaggaggagaatgtagacttggttgggcagttaatagtcactaccactcagggtcgaggcttgccaaagagtcgctttgaacttgaagcttcagggatggcagagctctgggggagaaacagatgtcgtgggaaggcacagtcctcaccgtcgtcttttgcaatggttggcatcagccagggacttgggcctttggtggggagacgaggcttaggtcccaccgctgccgcctccaccctagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggtagggggcccctccaggccctgcctcttcctaaatgcagaaggcagggctagaggtggcctgtggaccccttccaagtaaggtctaagagtctagactggtgggctgtgtgttgggggaggggaagaattggagctatattggacaagaagagaaagacaaggagaaataatgccctggatggaaggagggaaagggggtgatacctcccgagctcccctccaagtcttatcagtctggaggaaacaggtgcacattaaccataataactcagacttctgtagctttagctctgacctgctcacactagattccaggccttccccaagttctcccacaagacctctgggaatccttagggactatctcttaaataaatctggcagtacttctgctgtgtcctgcctggcactgtctcccatcacatggctcctctaaggcaacaagctgagagagcccttcacttctcaggtggcactcaagcaggggtgctcatctcattgtctgcagacttttttgtttgtttgtttgtttaatgagacggagtctcgctctgtcgcccaggctggagtgtagtggcatgatatcggctcactgcaacctctgcctccggggttcaagcgattctcctgtctcagcctcctgagtagctgggactacaggtgcacatcaccatgcctggctaatttttgtgtttttagtagaggtggggttttgccatgttggccaggctaaagcagcttttttgtggtcattatttgtagctcatttctctatttcacctagacaagagtctcatggagtctgggctgggagacacatcgggagcacctccacccagtactcagacccacctctgcttgcacgacagaagcttatgggggcgagctcattcctcctggctcagggtgggctcccttccagggggcttttccagcctccagaattggctgctgtcttcacagcctattaatttgccagacccacttagacttgcctgaatccacgtgggggatggccttgggctccagctgaggcccctgctcaccatcagggacagggttctgcctgtgcagtcagaaagccctgggctccagcgcctcgtcttccttacagtgtgaccttgggtggtcctcatcacctctttgagcctcagggtaagctgcttaccctgtaagctgctttgtgataggcagctttgggaatggctagatccagattctcaaatgatgtcatcaaagagaccatccgtccccatctctcggctccgctttcctccaagttgacatccttctccagcaagcttggtggcaaagatgacgaccaactctcggcttctacagccttgaagcccgtcatctcaaaggaagacagacaattttcctcttttgtaaaatagggatagggatgataaggataatttccactttattgacagtgcatgtaaagtgcttacccatagttcctgaagttcgttcttttgacaaacatttgtttttgttgggctgtgggtatgagctgaggatcccatgatgaacaggcagacaggccttctgtgtaatttacactttggttgagggagacagacagtaaacaagtgaacaaacaggtgaatggaataactgcaggttgtcagtgccctggacgaaacaagtagggtgctgtgagtaagggggcggagcagcactcagagaagacctggcttgaggaggtgacatttcagctgaggcccaaaggacaagaaaggcaccagttccaggaagaacttgaaggacacattccaggcacactcaagccaaggggaaagaaagcgtttggtatggcccagagcgtggtgaggaggacggtgggatgagaagacggaggagccgtgggcaggaagatcatcacgcagggtcttaaaagccacgggaagatgttccaactaattctcagcacaaaacaaagcccttcgtaggctctgagcaggagagggagatgcccaggcttgctctttttaagtatctctctcgagtggggtgagatgagtggtggcgatcatttaggagcctaggccgggactccaggttgagagatgacaggggctcaggctgcactggtggcaacagagatggagagaggcagtggagccaaggtgtgttttggaagtaagattgagtttctgtaggattggatgtggagagaagggaaagggcagggccaaggctgcatcatagctttttgggatgagttttatggtgggggatggtgctacttcctgtcgtagggaagactgggaaggacatatttggggtggggtagtcaacggttctcttgtgaaggtagagatgtcatgggcagctaagactggagttcacagaagaggtctagacttaaaatacaaatttaagagtcttcagggtaaggtgatatttaaaacctcaggcctggatgaggtcacgtggcatgtactaggttctcagtatatttgtttttattaactaagatagaattttgtttttgcattttttttttttttgagacagagtctctctctcttgtccaggctggagtgcagtggcacaatcttggctcactgcaacctctgcctcccaggttcaagccattctcctgcctcagccttctgagtagctgggattacaggcatgtgccaccacacctggctaatttttgtatatttagtagagatggggtttcgccatgttggccaagatggtctcgatctcctgaccttgtgatacacccatctcggcctcccaaagtgctgggattacagtcatgagccaccgtgcccagcctgtttttgcattcttatttattgataaagactcagtttaaatgccagtcctttgaaaaagtcttgtctcttccagaaagcctgttcttatcacctttgccaaaagtcaccccttaatacttgtattactaacaaggcaagtacaccatgccccttgtagttatttgtctgcacgccttaactctccaactatgtggtgagtacttggaaggcaaagaccccgtcttgtatatctttttataaggtccctgccatcctgggactgggtctggtagaggggcatttgtgaatgttctggagacacttcctccatttgctcactttagacaacccagatagatcataaagttagctactccaggtcagcctggtctcagggatccacaggctcagtctttctgagccctgctctcattgaggattaggggaacctccaacattgtatgaaggagaatgttttccccaactaaccgtggcttaaacataaggaatttgttctctctcctacaagaagcctggagatgggtgggttagctcagtggatcaacaaattcaggtccctgggctaacttgtgattctctgggctttccaccacaatttcaagatgactgtgtggttccaagctttacatcttcattcagtgtggctagaggcaggaataaggcgctatgtctccttatatcatttaagagcaagaaaaccttttttagaagtgccggcctccctccaacagcttcctcttgcctcattggctgacgcaggtcacgtgtccatgcctaaaccagtcatgtggcaaggggctgagagctcagagctagccctggctgaactcaatccagattccctgctggggccagggaggggctgcacctccctatggagcatgaccccaagggatcaagtgaacaaaattttttttttttttgagacagagtctcgctctgttgtctaggctggagtgcagtggtgtgatctcagctcaccaaaacctctgcctcctgggttcaagtggttctcctgcctcagcctcctgagtagctgggactacaggtgtatgccaccatgcctggctaacttttgtatttttagtagagatggggtttcgctatgttggccaggctggtctcgaactcctgacctcgtgatctgcccatcttggcctcccaaagtgctaggattacaggtgtgagcctgggttcttttaataaaggagattggggtgaagacttaggtagatacccaacagggtctactgcagacacccaccatcaggatgtgtcttagctggagactgctgctctgagagctgtcccccggtagtagcctgggtgactgaagttgctgagaggctgttgccaggccagtccgaccgtgctgagaggggggtccctgtggtgagcaggggacttgtagctgtggccataggtgcctcttaaggtctggctttgtgttgagatgttccagtctgatagttcctgcctgagaggcagttcaagacatttcaagttttgcagtgactctgttctcagcagcgcacacgtgcttctgaaaggactgagagccctgctgcttcggagaggagtggggtggtaaagactttcagcagcaccccgggtctcctcattatgacttggcactgattgcttcctcagaccttatctctggtgaccttcccagtgctgctgggaggcgggcacagagggtattggcattcccaatttttgggtgaggacactaagttgaaagagattagaggacttacccagagtcgtcgagtcctgtggtgaggtgaggaggtgtggtattgccagatggtgagggcacaggctcgggagctggactgcctgggttcacgtcccatctcaccacttactagcacttaacttctcaatgcctgtgtttcctcatcttaaatggggataatacaccgatagggttgttgtgaggattaaatcaattaatacgtgccaacattgtcaaagtgcctggcttctttagtaaatgctcaatatatggtgcttatcgtcaccatcatcatcatatctatggagactgaaaaggggtcagaaccacacttatatttaggattttgctgggggcatttatctgcttagagctgtgaagagtgtagggacagggatcgtggggaggccagaccccaaacttaaagaccaggtaggtcaagggctgtggcgatgaccagcatgaagggctaatcctggatcctaggccagggcatcagaccttgggccacaggtgggatgagactggctctcatgcgaggacagtggtaagcaatggagcgtgagcagcagcatggtctggcagggtgcaggctatggggcaggactttggagttgggttgaagtcaggtcagcctgagctaggcttggaggggtaggagaccagactcagctggtactggcttctgggggtccttccagacctgatctaaaattgcggccagtgaaaaagccatggagaataacctggtctctcgcaatgtatactgtgtcacatccaacgctttcctagaagtttggctgagatatccccttccgggtttgtcaggctatacagtgccttgtgctagacttctctatggggagtgctcctagcagtgccaagacagcggtgcctgaagctccctcctggggcttctttgcagccctctggtcacagcctgccagacccctgccacccctggccccactgcccataccaaccatctgtttctgttgccccattgctgcttcaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagtgagtgtgggctcctccctctcctcccctcctagccccctggcctgccccaggggtcctgcttttgctgccacctttccccaccagtctacagggccctgcctgagcttcccaatctccagatatccctgcaggcaaagttaaagtttgaaatgttttctgagagtctcagccccatctaagtatcccaagtttgaagtcaggaagccgtgatgtgtatctctccactaattggtcctgggacttgtcagccaggccagtgctctttgtcctatagatgagactgtgactcaggttctcttgatctcagatctttttatttatttatttatttaatttatttattttcttttttgagacacagtctgactctgtcccccaggctggagtacagtggtgtgatctcggctcactgcaaccttcatctcccgaattcaagcgattctcctgcctcagtctcccgagtagctagaattacaggcacccaccaccatatccagctaatttttatatttttagtagagacggggtttcaccgtgttggccaggctggtcttgaactcctgacctcgagtgatccaccttccttggcctcccaaagtcctgggattacaggcatgagccaccatgtccaacctcagatctttttagatgcctcagcacctttgggcattaatgaggaagagaagtgtgcttcctcagggagctagttccagaggaaagagggtttcaggctgtattactgagtgtgacaaatacgtcggaagggccccgctctggatgattgttctcactcaagagagaaagcctaggtaatgctcaatttccagcccttccgtgctgggaatggaccattctgggaacctatctggtgaaaggagatttgaccacgtatatcacgtacccactatcaaatattaaattagtttacagcataatatactgcatactgaaagggccaactttgatttattcttcctctgagggttcaggaaatgaagtcttgaataggtcatcatcataaacaccagttttcatcatgtccttttgttggtgcagaagggattgagctgggctgaattcataatggcctcagcctcccaggaccacctgaccaggtttccaagtgattcttatccttagaaagtttggaaaggctttgactatttttgagtttgggagattcttggttggcatagatttactatgcttttggagaaagaaacattggaatgttctacccaatgggtttattagaccattgatgccctgtgaaacaactgcttttgtttattccacttatttgaaaaactcctttgaaatatttgatttcctctggctcccgattgggtagtggtatagtatgatcctgtatccaagagtagtccctaggggcagggagctggtgagttggccaaagccaccatctttagtttttctaaatgatacagagctagtgtttcttgcctctttatctcttttctccttttttctttccctttttccaggcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtccatcataactcactggcctcccacctgaccccaggcacgtgcccttccagaatgtgctcatggtcctcgccaagggcttatggttcctcttggttgctgcttcctcagggtttcccagggagatctagggaacagaaggccaggggctgtttggtgggattttccttataggttgggagttcacctacaatgcccattaggtcagagtggacctgaatcgagtattggtgtgatcttctgcttggcttcttgctcctgtaatccttccaacctgtggggccacttccactatggggccacttcctgcttcttgggggtttctcttaccttccaagactcagactctggttggaggagttaagaagcccaaggccaggaactcagaggctcagctgaaaccttggaccttgtttttctgtgacctgggtaccaaccttgttctactgtttcctgacttatccctttggttctcattcagtggccccagttttaggcctggaattctacttgtctccccccagtccttctggagaccttagtcctcttgctgaaacctccgtcactgtggctgggttttcactgggaaacttctgtgtttctaccccattgcttgctgccagcactgcctctccccccagcctggttgtctgcttctgtttcttggacatccctaagctcctgctctaattcccatgtctttgtctttggcaggtcctactgtctgctttcacggacagtaattgtatttgagcctctctgatcttacttcacccaattcacaagggcagaaaaaatcctgaatttgagcctaattttctgtactctttattcatagtacagcaagcagatttttcagtgatcagtgacaattcacaatccttttatttcccaaaagaattaattgttcttagtgaccagttggatgcacccagggacctgagagtataatttgcaatatctgattattaatcttgaggatgtgtgctgcatagtatattttatggtgtcttttatagccactgaagtaaatataaatgtcctttctgttc

SEQ ID NO: 377 - DNA, 49551 bp, Homo sapiens
ggttggaattttggcgggttcagctgtgaacgaagaaggcgtcccggcatcgggtgaggagcgcgggccccgggcgtgcgtgtgaccctcgggcggcggggccggggccgcctcgcacgtctctgcgcgggttgcaaggggtccgaggctagaggcgcggggtcccgggagctcgggtgggcgcgatctggatttggcggcagcttgggaccgctcggagctggcatggccgggccgggggctgggagttgctggccgtctactaaggaatcgggttcttccttttaaacgcagccttttaagtgcttgccaagtgcctgccgcctgggctttcttttattcattcattcattcattcattcattggtttctcgtattcatgatttgccaatgattattgaatgcggacggtgtgcatggctcggatcacatttccgctgccttcacagcgcttacagtttaaaggcacgagcaggtagtaaacaaatgcacgacagtggacgactcagggtggtccagaaagtctcagaaagatgagtaagtggagaccgaagggcgagaaggacctggggggagctttcttcgacagagcctgagacctcaaagcagcttagtgtgttccagaaggtggaagcgggctggcccggctggagcatcgttatgggtgtcggggtgggtagaattggacgtggtggattgtggaaaatgtgagggagtagaaagcttggaaagagagagagaatatgaatcattgcctcgcaggctttgtagattttttctaagggcaatggaaaatcattaaagaatttcaatgaagggacccccatgatctgatttatgttcctaaaggttactaaggaaagggaagattaccgtggctgtcgtatgcagaacagattgcacggggacaaagagaccaacatagaaagctaacacagtcattgggttaaaggttgacggtggcttggcctagggttctggcagtgaagttggagagaagtggcagatttgagcagtgttttggagatgggaccacagtacttgtcagtggccgtggatttgagggcgagggagggtgcacagtttcattttgggggaaggcaaggccggttacagacttgaacgagacagtttgctcctaacgctcaggaagcttactgtccaataggttccccagtagatagcacagtgtgtggcacatgagggatccgtggaaatgttggttgaatgaatttttaaaaagcggccaggcgcggtggctcacgcctgtaatcccagcgctttgggaggccaaggcggacggatcaccaggtcaggagatcgagaccatcctggctaatacggtgaaaccccatctctactaaaaatacaaaaaattagccgggcgtggtggcgggcgcctgtagtcccagctactcgggaggctgaggcaggagaatggcgtgaacccgggaggcggagcttgcagtgagccaagatcgccccattgcactccagcctgggtgacagagactccgtctcaaaaaaaaaaaaaagcacctttgggagtccaaggctgatggatcacttgacatcaggagttcaagaccagcctgggcaacatggcgaaaccctgtctctacaaaaaacacaaaaattagccgggtgtggtagtgcacgtttgtaatcccagctacttgggaggctggggcaggagaatcactggagcctgggaggcggaggttgtagtgagccaatagcaccactgcactccagccccagcgacagagcgagatcctgtctaaaaaaagaaaagaaagtaccataatcactgtaattagttccttgacattgaacttgccaaagagcacatgtaagttaaataagagcctagaaaaatgtatactttcttacttgcagtttaaaaaataaccttaaatgaaaagagaagtgcacaaagtgatacaactttgtcttaattagctacgctgtttctctgtgctttgctgactagtattgaatcaaaatcctgattgtcactaaggctccacctaagtagaatcatacagtaagctgtcgtggataacgcagatgtcaggtgtattacagtgaataaaatgaaagaatagcctaatgtagatcgaccccaataatttgtgtgtgtgtgtgtgtaatttttaaaaaagacaaggtcttgctatgtgaccaggctggtctcaaacttctggcctcaagtgatgcgcccaccttagcttcccaaagtgctggtattacaggcgttgagccactgtacctagccaaccccaatagttcttcctcataatttatctcatccacgtaatctagtgtgatttacaaactgctctgcagctcaataactttctgtaaccttaaacacaagtaaaagtgagctgctacatccaaggaaggagatggcattggcggtgtggagagaggaggtgagaaatggtcagattctggatgaattctgaggttagagcccataggagtggtaggattctgggtttgttggatgtgtgttgtgagagaaagagaagaattgaaagtgacatttctaatattgctttcacacagccaagattctacattgctcatctgggcatctgagcctccttcgaagtttcctgtcacaactgtcctcttgacagcatggatggtaagacctggcagttttctgttactctgtttcaaggaaaactaaccttttgtccatggacttgttatttattctacctgtaaaatggtgaaaatgctccccagccctcaggtattgtcttagtggttctgaagcaatctcacatctcacagaggtcactgaatgttacttgcttttatcaggggagatttcttctggcaacagagattgtctttcataattacaatagctggtaggtgtacagtgggccaggcactgctccaagatccttgtggaaattaactgattcagtcctcaggcaaacgtattttataggcagaaaaacagggatgtttagtaacttgtcacagttcaagctggcatagcagggctttgaaccaggcagtctgacttcagagtttacatttgataatgaaatctgctgaagcgatattagtctagctctgacttaagtttttattaatatcatcctttctaattttgttcattttgcaaggatgtgtacaaaatgtttacctagaaaagagatgttgcactaattagcgatcacctaaaatgattgtgctgggctggacgcagtggctcacgcctgtgatctcaacactttgggaggccggggtgggaggattgcttgagcccaagagttcaagaccagcctgggcaatagagtgagacctcatttctatttttaaaaaattaaaatgattgtgctggttgtgaagagatctagttgcataattgaactcataatctgaaactgggtttttttaaaaaattcaaacatattacactttgccctttaaaacaaaacttgaaattcctcacactgtgatgcacagtggacccccgttgtccctgagagatgtgtttccacactcccagcagatgcctgaaacccaggatggtaccaaaccctaggcatgctgtgttttttcctgtacatacatacgtgtgataaagtataatttatgaattaggcacagtgagagatgaacaacaataataaaatggaacaattatgacaatatactgtaataaaagttatgtgaatgtggtctctctctaaagtatctattgcactctcaaaatatccattgtactgtcctcaaccacagtgaccatggaaaatcaaaaccacagaaaataaaccctcagataaggggttattccttatgtgaaactcattgcctgatgctatcatggtagtttcctgtttcttaaaattggcaaattgcctacagggcaggttatataatacaaagcatcactttttgctatcagattgacatgaaaataagaggtgaatggatacctgttctctaagaaatcatagtatctatctggaaacagtataggtcaagaaagaagaaatcataatgtttaggctgggtgcggtggctcatgcctgtaatcccagcactttgggaggccaaggtgggtggatcacctgaggtcaggagttcgaggccagcccggctaacatagtgaaaccccatttctactaaaactacaaaaattaacctggtgtggtggcatgtgactgtaatcccagctactcaggaggctgaggctggaggatcacttgaatctgggaggcagaggttgcattgcatcgagatcccactactgcacctccagcctgggtgacagagcaagactccatctgaaaaaaaaaaaaaaaaagaggaaaaagaaatcataatatttagtaagaaaatctcatttgattggcatgggttcacaatttggccggtgtagaggaaatcggagactgtatggtacttgggatatactgttgaacaatgttcctgcttatattttagtggagggagaaagataacaaaacaataaacgggtagttagtagatgggagacactgctatgtctttgtatgctgacaggagtgcttcagaggagagggagaaactggggattcaggagccagagaggtggtaattgtagaatgaagtctttgagaagctgagaagtgggacccaatgtaagaatgtaagtggaagaattggctgtgaatagcactagatacttagtcccaggagggaaagcagagaagatacgttcagagttgggagtgaaggatgaggaagtctgattacatctattttttctgtaaaatataagccaagggctgggcgctgtggctcacgcctgtaatcccagcacgttgaaaggccaaggcaggtggatcacctgaggtcaggagttcgagaccagcctgaccaacatggagaaaccccatctctactgaaaatacaaaattagctgggcgtggtggcacatgcctgtaatcccagctactcgggaggctgaggcaggagaatcacttgaacctgggaggtgaaggttgcagtgagccgagatcgtgccattgcactccagcctgggcaacaagagcaaaactctgtctcaaaaaaaaaaaaaaatacatacatacatatatatatatatatatatatatatatcatcagctaagagtaaagagtggggagtgggcataggaggtttgaggagagacagtgtgaagtggtcagagcctgggaaagcgaatgaattgaggaagtgtgggaatctttaagcagtgctgaatgcttgtttgttatgggtgtgcaaaaatttaaagttagactgaggcagggtcttgttgatcatacctgtagtcccagcactttaggaagccaaggcaggagcatcgcttgaggccaggagttcaagacgagactgggcaacatggcaagaccccatttctacaaaaaaatatttaataagctgggcatggtggtgtgcacctctagtccctgctgcttgggaggctaaggcaagaggatcgcttgagcccaggagtttgaggctatagtgagctaagattgcaacactgcactccagcctgtgtgaccctgtcttgaaaaataaataaataaataaacaaacaaaaaagaccagtcagcatggtagcgagtctttctccaggaccattcaccagccagggagctgagtctttagaaggcagtgagtgatgatggtgttgaacatggatccacagggagggcattaggggcagggggtgatggacaggaaacacattgtaggtaggctgatgggttagacatgtggatgaagctgaagagctgctggatgtgaatactagagtgagcgggctgaaaggatgggaggttggatcacagagggacgttcagaggtcagttgtgctttgctgtgatgagttggagttactatgggagtgggtagctaagatggggagtggatgagaaacccagcgaccaagatgttggctggatcatccttgcggaggttgaagtgccccaggagggtgataacagtagagatggaggggaggaccggggggggcatgcatgatacacatatgatgatcagcacatgacagtgccatgaggggttcttgatgccagcgtctggtgtcttgaacttcagagagctgtgatctggaaaaagactgaatcattccaaagtgacagtgataaagaagacatcaggaacctgaagttgatcaacaagtatttgttgcatgcctaatacgtgccgaacactattctagacattgccatgtgaggtgtgaacaattaaatgctttccattcaagaggcttccaggggtagccagatttctgttgtaagagccactggggatccgagaaacgtgctgatagtagatttcacatcccaggggtttgagaacaaagaggctgggagattgagtcagcgtaatacagagaagacatgatttttggtggtgactgaggtaaacggggttgtgaggcaccatgggattagccctcgttctcttgtgaagggttcaaagtgaatagtatggggtccccaggcagcattttccacctgtggcccccagtggtgtgagccagagcctcttcccggggtgtgccctctttggcagacgggaacaagagatggtggaggcctctttgcttccttgcaggcatgtgacattctcagagcacagggggctgcctggcctcttctctcttgcactgtgcagccttggagtctttgtggactaagcaactcaagctaatccttatacaacctctgactgagcattaggccccatcatcagattctaggcctgaagtttggctactggctttttccttctggtaagggagtgtagagtggtggaaaggatattggtttgctgatctagagattccttattaacccagctcctgaactgatctgtttctccatgtgatcctgaacaagcccctcaccctctcatactctagcccctgaatttcagacaaggagagtaggtcagatatccttaatatttttccattgaatacctctgattttataaacaaatagtgcccaaataggggggaaaaaagagcaaagaaaatagataaatcaagaaagaagaaatccgattggcaaataaacaaacaattcttaacctcaccagtaatccaagaaatgcaaatcaaaacagtgagatgcctttttaaatcgtccatcagattgacaaaaaaatatttaagtgacacatcagatattgatgaggtggtggggagaagtggcccttgtgtacagctctagtgagagtgatacagatgatagcaattatttagggagatagtaagggcaacagagtcctcagcagaatttcccttttagcaaaaagcagcccccaagtaatttctaacaaggccagccagaaaaatcaagcggacatagaaaagcaagctagtaatttgcacggatgaatacctgcagctgtgccaataggaaaaggctccctgggggccaggcgtgttcaacatggcggccctttttctgtgtcaaccacgtgtacagtaaagaaacagacaatatggcgctggccaggtagagaaccacctgcataataaaagattagggtggggcagccaggttttccaccctatgcaaatggcatacctagtccagccaatcttttatgtcctgtgtaaatcagacattgcgtcctcaagctcgtctatgaaaccccatgcattttgccatggacgcggcaacccatttctctgggacctctctgctgccgagagctcttctctttcttttgcctattaaatctctgcacttaacctcactccttgtgtgtcagcatccttgatttcctttgcatgagacaacgaacctcaggtattaccccagacgaactatgccatttcaagagtgcatccactttgagaacaatttggcagcatctagcaaaattggaaaacgtggatacccagcaatccagcaattccatttctgatagatattcccaagaaacacatgtgcgagaagacggatacacgattacagcgtatttagtagtggggaaaaattagaaatagcccatattgtcctttattggaaaatggattaatgaggtgtgatacagtcttattataggatacaatatagcaacgaaaagaaagaaactagaactatatggggttttttgtttgtttttgagatggagtctcgccctgtcacccaggctggagtgcagtggtgcgatctcggctcactgcaacctccacctcccaggttccatcaattcttctgcctcagcctcctgaatagctgggattacaggcacgggccaccacgcccagctaatttttgtattattagtagagacggggtttcactttcttggccaggctggtcttgagctcctgatgtcaggtgatcctcctgccttggcctccccaagtgctgggattacaggcgtgagccaccacgcctggctagaactatatgttttgatttgggttaatcttacaagcaatgttgaatgaacctggaatgcagagtaatgcagtgtggaatatttatgtaaatatttttaaaaccatctaatatagattgactatgactgcctatatatttatgtaaaagcataagaatggactggaatgatgcctcaaaattatgaaagtgattacaatgggaagtgggggcagtggtcaggagttgggataagatttggcatgacagacttcatctggaaggtgttatttaatgttaaaggcaagaagcaaacaacaaaatgttaatgatggctaattctgggtgatgggatcttagtattttttatatagtttgtatctttttttttttaaatctcaaataatttgaaggtcaggaattatatacatctaaagcctaaatctatgtttggtgttttaaaattattcccttgttggttgaatttcatggaagtcggtgtgcgggaagctgtctcattgattggagtagaatgcttgaggacatttggccccgtggctggcccactctactcactaagcagtattggctccttcttagcccagtgtcccctaagaagcacctggggacaagaaagatggagacaaggagaacaaagaccaggcaaaatggtgcatctgtaggtttttgttttttttgtttgtttgtttgtttgtttttttagtttcagctttcattttagattcaggcttgttacagagatgtatatatagtgtgatgctgaggtttggagtatggttgaacccatcacccaggtaatgagcattgtacccattaggtagtttctcttacccccatggggtcatttaaattgcctaaagttgaatgtttggaattagccgtgcttattctctgtcctttctcttcttttcccctagaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaaggtgccctaactacttgccttccttatttctttcggataagttggatgaagaccaccaatctgatagttgtcatcaaaatagctgctgattcaagggtagagataaatgactttgtaaaaaaagaaaaaaagaaagaaaattatatgagttggtagatgaaatgtttgggccagcatttcagcacaaactatagactctatcagtgtcagccagctgcacttgatcctgtacggaatggctctgaaacttttcatatttcttatggaatagtagcactttgggatgtatgtggatgtggagccagagacaaggttgcaaagctgccacatatctatttgagcagagcattcctgaacagaagctttgacacatgttcttttctcattcctggcatctcatacatgtttaagctatagtaaaattcaatggttagctgtttcttctaatacagaagccagcatttattatattagttatgatatccaatttatgaagtaaatataatttttttttttttccgagacagattcttgctgtgtcacccaggctggagtacagtggtgcaatcttggctcactgtagcctccacctcccaggctcaagtgatcttcctgccacagcctccctagtagctggaaccataggcatgcaccaccatgcccagctaattttttttattttttttattttttgtagatacaggatctccctatgttgcccatgctggtctcgaactgctgggctcttgcgtcctcctgcctcagcctcccaaaatgctgtgattacaggcacgagccaccatgcctggcctataattatttctcaactcctaaaaacttgttaactgtggattttatttgatatctcttaatagtaaagatttataactagtttgattattgggtgcttcgtttactttaaataaaatatgtatttctctaagagacctctttgaagtaccaaagttaatcatgagctttgggtatgtgattatattgtgggtctcaaggtattggggcagggagtggacaacaaaaatattgcccgcatttttgtcatgtagaacgttttctcctgcctggttcttaaattaacatattttcatttcctagaggaattaaggaatttgcaagagcaaatgaaggccttacaagagcagctaaaagtaacaacaattaaacagacagcaagcccagcccgtctgcaaaaatcccctggtaagaagactgtcattctggcaatcgtgtgcatttattttattagaaattatcacatcatttctgcatccaactcctgtccaaacagccctttgaacctctttctgaatgggtttttactcacttattttacttttgattaagtagagaagtctccccggccacctcttaaggagaggagagttcagagaattcaggagtcaacatgcttttctgcggagcttgatgtccctgcgctaccaagaaccaagagggtggctcgaacaccaaaggcttcacctccaggtgtagtacttgcggtctcagtatcttggcactattgtatgtgtttatgtgtgtgggggtgttcatgtgtgtgtgggtgtctgtgtcttttggtctgtcttatgtccccattgagaaagaaagtttcttgggaatggaagccacatgatatattttgtgttcttcgtctacatctcaaagtgcctagaaaatccttagggccaaggcacgcggcaggaagattgcttgatcctaggagtttgaggccaggctgggtagtatagcaagaccctatctctacagtaataaaattagccaggtgtgttgcttgcctgtagtctcagctacctgagaggctgaggtgggaggatcatttgagctcaggaggttgaggctagagtgagctgtcatcacaccactgcactccatcctgttccagagtaagaccctgtctgagaaaaggaaaatccttaggtacagagtagctatttactaagtacttaacaggttgaatttttttttttagctctgtagtctcatagttttacctggactgtagtaagtaaagccactggttaggttctcatgctttagacttgtgaggttattcccttagaaaatggtcaagttttatttgaagccaggtcgtatcaaatcaaaagggctgttttctggaaaagacttctttgccactagtagaggatggtattcaaatacagtcctagttcagcacacacatgtatatgcacaaaacagcagtgaaaaggctttctgccctatgtattgcttttcttttattgccgggagacctaagacaagatgggcctgataaaacatgggttggaggacacagcattttattggctgcacgtgtttggaaaagcccctttgaatagcatgggtctgtgccacagtcgtagagaactacttccgcctgagtgttcacattaatctgacagcaagttatatattcagatatccattcaggagtagcatccatcccctcaggacctttggcattactagggtgttgcattaggtaatgtccaaagtttggttttaaggggtggggaatgggcctggcctctaggttctaaagttctagggtcaccctggcccccagtgtgagagcagtgatccaaagtccctttgagggcaaacaacaatcttatgaaagagagagtgatattttattaaggaaaatacccaagcatctgactttcaggagaattatcaaacacttctaaaatatgaaaagtaactccatcagggatatttaatgaagcaatagtaaatagaataccagacccctaactttccttggtcccacaaataaaatggaatggaatgaaatgaaacaagaaagaagaaaaggggagctagttttggattttttttttttttttttttttttttgagacagagtctcactctgtcacccaggttggagtgcagtgggatgatctgggctcactgcaacctccaccttctgggttcaagtgattctcctgcctcagcctctggagtagcatgccccaccatgcccagctaatgttgtatttttagtagagacagggtttcatcatgatgggccaggctgatcttgaactcttgacctgaagtgatctgcccacttcagccacccaaagtgctgggattacagattcttaaagtagaatttgaactgtacataaatctccactaattactcattctgaaggaggtcttgtcctccctttgataatctgcgccagtgctctgtatcttgatgaatattcagtaaacatcattgcatagagaatcagtattatagagtggaactatctagtacagtagccactagccacctgtggatatttaagttaaaattagattaaatttagttagaaatgtatttccttaaaagcacagggtcacatttaagtgactgatggtcacatgtgtctggtagctagcaccctattggacagcaccaatgtacaacattattatcatcagagaaagttctattggactgtaagtccaagaaatggtcttgtggggcatgctttgttcccaagatttgattattgcatgtgttgctttaaaaaagggacaatcctggccgggggcggtggttcatgcctgtaatcccagcactttaggaggctgaggcaggcggatcacctgaggtcgggagttcgagaccagcctgaccaacatggagaaaccccatccctactaaaaatacaaaattagccggacgtggtggcgcatgcctgtaatcccagctacttgggaggctgaggcaggagaattgcttgaaccctggaggcggaggttgtggtgagctgagatcgcaccactgcactctgggcaacaagagtgaaactccatctcaaaaaaaaaaaggaacagttcggactgtgtgcgtgtgcaatgtctcacgcctgtaatcccagcactttgggaggcctaggtgggtggattgcttgggctcaggggtttgagaccagcctgggcaacatggcaaaacccgtctctacaaaaaatacaaaaattagccgagcatggtggcacatacctgtgttcccagctactcagaaatcgcttaaacccaggagatggaggttgcagtgatcccagatcacgccaccattgcactcctgcctgggtgacacagtgagtccctatctcaaaggaacaaatccgtaaaaacaaatttccaaattccgttcgtgattatcagtgtggttgccttttcattaattgtgttaattttctagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggtcagtagctaaaccatctattcatgtgcgccacggcatagctttttgtgcctctcggagtcctttagaagtagtgtgtttatacatcaggatccacaaaacaccagcagctcttgaactggacaaaacaccactggaagactagcagtagccctaggtttgactaagtacagttgcatataaaatgtttaagaaagactttttcttgtgtatgtaatcaacaaagaatctgtatctataaaaagaaatggacaaatgatagtatatttaatcagaaattgacagatggaaatagtagatttttaaaatttttctccatctctattgaggtataatttagactttttaaatacacagacagtttaaccaggataatatttatgcaattaagcaattactggattgctttggctcttctgggtcttttgcggttctgtataaattttaggatcattttttctatttctattgattcttgtagttgatgttaagaaaaatagctatgctgtttttctttctaatagtctttttaaggcaaatttatattctttgcatctgttatagggatacatttaagatagcctgttataataggaatatattccaagctcaatccaattaaaagctatattcaaatcttggacttttttctaactttattttaatttttttaattatctatactctgtatcactactccattgcatctccatcattacatctggataatcccagggcagaacagtactccttactgtgagactggattgcttttagcacagtccatttgaggaaccaagtgaaaccctctaaaactctgaaaccttgtcagtgtaaatatcagccaacaactaaaactgctaagctcttaaagtatatattattagcagaggagaacaagtgttgccaacatacaataaaagtgtattataaggctgggcgtggtagctcacacctgctatcccaacactttgggaggccaaggcaggaggattgcttgaagtcaggagctcgagactagctggggtaacatagtgagacctcatctctacaaaaagtaaattagctggacacagtggtgtgcacctgtagtcctagctacctgggggtgctgaggcaggaagttcgcttgagcccaggagttcaagactgcagtgagctatgatcataccactgcactccagcctgggcaacagaacaagaccttgtttccacaaacaagaagtgtcttgtaaagagttggtattctccaaaactgaagaatgtatttatatcttaattacatctgagacagactctaagaaacagaatacagcagtagaagctgtggttctcattgagggggctgcaggcttccttctcaaggtagagaattgcccccacctgagatgctactgcctgccccagccatggcccacttgaagctccctatgggtaatgaaccatgttgctgctggtgggcatttattgcacatgtgaatcagaattgagatagaagagacttaaactactcagcaaaagcttctgagtggcttttaaatttaagggatcacagaattgtttgggtctctttgtcattgttaaatgtgaacctcaggccttaaaaatactctaaaggacatattaatagaaattccccgacacaggtcgagggtcccttatccaaaatgcttgggaccagaactgttttggattttggattctggaatatttacatttaatagacttgctagttaagcatcccaaatctgaaaatcccaaatctgaaatgctgcagtatttcctttgagtgtcatgtttgtgctcaaaagttttagattttggagctttttttttttttttttttttttaatctattaactcattgttacagaaaaaaccctgggctgtatagaagaacctttccctagctgggcatggtggcttacacctgtaatcccagcacttagggaggctgagggtggcagattgcttgagctcaggagtttgagaccagcctgggcaacaggacaaaaccccatctctacagaaacaaaatttagcccggtgtggtgacatgcgcctctagttccagctgcttggtaggctgagtggggaagtcaaggctgcagcgggccaagattgtgccactgcgctccatcctggacaacagagcaagaccctatctcaaaaaaaaaaaaaagtttcctcagaactgagaaggatccaaaagccaaagaatgactcggacttatatgtaaggcacccctggatggcagcaagattgtttgggagatctgcttatttgtctatttttgctttggttacctgtgctttcgtgttactactcaacaaatcttagccaagaccaatgtcctagagagtttccccaatgttttcttttagtaatctcatagctttgggtcttagatttaagtctttaatcttttttttgagacagtcttgctctgttccctggctgtagtacagtatcgtgatctcagctcactgcaacctctgcctcccgagttcaagtgattctcttgcctctcagcctcccgagtagctcagactacaagcacgcaccacagtgcctggctaatttttgtatttttagtagaaaccgccatgctggccaggctggtctcaaactcctgacctcaggtgatccacctgcctcggcctcccaaagtgctgggattacaggcgtgagccacggtgcccagcctcttgaatacattttgagttgatttttgtatatggcgagagatagggatctagtttcattctcctgcatatggatatccagttttccctgcaccatttgttgaagagactgtcctttccccaatgtatgttctttgcacctttgttgaaaatgagttcattgcagatttatggattcgtttctggtttctctatgccagtaccatgctgttttggttactatagctttcgtataatttgaagtcaggtaatctgattcctccagttttgttctttttgctcgggattgctttggctattttgggtcttttgtgattccatatacctttagggttgttttttctgtttctgtgaagactgtcattggtactttgatggagattgcattgacgctctagattgctttggattgtatggacagttgaacaacattgattctttaaatccatcaacataggctatttttccatatttggtatcctctttaatttcttgcatcaatgtcttttagtttttattgtagagatctttcacttctttggttaagtgtattcctaggtgttttatttggagcagttgtaaatgggattactttcttgatttctttttcagattgttcgttgttggcatctagaaatgctactgatttttgaatattgattttgtatcctgcaactttattgaatttatttatcagtgctaatagttttttggtggagtcttcaggtttttccaaatataagatcattatcatctgcaaacagggataatttgactttttcttttccaatttggatgccctttatttctttctcatctgattgctctagctaggactcccctaagctgtttgcctactgtgtatgtgtgatgaggctcttttcttggtgtgttcccagatatgctccagaatggttgggttcttagggacatctgctccttggctggacaccatggctgtggccccctacctggccttcagggttcaggcagctgacatacacccttaagtaacttggggtcggggggagcctatcacactacaatcacagaaatcagccaaaggaaagaattttcccactgaagtcagtgttttgcttcctgaatattcttcattgttcaaacttagctctgggactttctgttccagaagactcatgaaatagtgaagaaccatgtttttctcttagtgtcttttctcgtctgcaaatatataacgctatcaaagatgaaacaaatgttaataaccctaagagttttttgactcagtcattaggaataagaatatattaattgaagctacattcaaaagcctttattgtatgtcaaaatgttgtctttaaaaaaaattcaattagaatagtagaacctgtgaaattcttgcataatcgatgaaatttaagtgtcttatttatgaatattaattcatggttttgtaataaagtaaaaaagattgtttgcagaagaatattaaaatttgcataatttaagagcttaaaggatttgcgatctttcttgtattctatataagccctagatctatatccaaagaaaggcaaacctagctttaaaaattatcttagaggccaggcgcagtggttcacacctgtaatccccgcactttgggaggccgaggcgagcagatcgcttgaggccaggagtttgagaccagcctggccaacatggcaaaaccccatctctactaaaaatacaaacattagcacatgatggcacatgcctgtagtcccagctactcaggaggctgaggcaggagaatcacttgaacctgggaggcggaggccgcagtgagccaaaattgcgccactgcactccagcctgggcaacagagtgagactccatctttaaaaaaaaaaaaaagaattatttatttatttgctataaaaatggatgccttggtcatactatataactaagcttcccaagaacaggtactgtagaggtttctgaccatcacactcccttaccacctgctaaggtgccaggtaatttctttattagaatcataattactaatcgctggtttcttaacccaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtgtaagccattgtattggtttcttagctgttttactacaaactgacagtgggaattcgatgtcctgaatttgttaactggaacctgttggtgtttcatttagaaataagtatagtaagttccagaatcaccacacatcattgagttggtatccagcgggtataagcaaaggatgccctatttaaataagacctggtggtacaggtttcttgggctttccattgtccaaatcatccttactgcatttcacttgtcattgttttgggtgacacatgtggttgtccctgtgacactgtgatctctcccatggaggagaggcgcaagtaaccaaagaggctgagctcaccgattctttggaggtccctttagatgtaaagtaccaaccacaaaagtgctgaaattgctggcctgtgtcagtgccgtgtgatatatttaatttgatggttattaccaaagatctaacaagtttcaaaatcacttttgactgagtcataaatgggaaagttattctgtgacctggcaagtcagatagcctgtcttctaagccttgtgcctttaactagcgatgttaccttaggttggctgttaatctttctttaccggcttccatttccttatttataaaatgaaggaactgactttgattagattgaaaatctctcctatctctaaaatgctatgattgatcatgctcaatcatgatgttattctctaatttagatcttggcccacctttggtttttcgttagagctgacatggggttgaattttaagagtacctggtcctaagccattatcctccacaaactaatgcaggaacagaaaaccaaacgctgcatgttctcacttataagtgggagctaaataaatgagatcacatggacacaaggaggggaacaacacacactggggcctgttggtggagggcagggagggggagagcattagggaaaagagctaatgcatggcaggctttatacctatgtgatgggttagtaggtgcagcaaaccatcatgacacacgtttacctatgtaacaaacctgcacatcctgcacatgtaccccagaacttaaaaaaattttaaaaaattaaagattacccggtcttacactagccctgtcactgttgaggtaaatgtggacaggtctggttttcctttgatcaaattcttagttacttcataagtggctgtaatgacataataataatagacacgagaatttatctgaactcttccaagacaggcactgcacaaatccctggaagatggattccagctcagcgtccgggcagtagattccatgctgtaacccataaccatccccagcccgggatgcctctgtgagatagtgcaagtcaagattattcacagtattctggttttaaaaacaaccgtaaaagtggaggtttttcacattataatcggtcagcattttgagctgtatttcttcagatacttaatcatacttctgaaatgttaaggttaaactcaaccagttttcttgaaatgatgcttttgtaagctaagcagagatgtaatagcctagaaaggaaacttcttttttcatattaataatagacttaggctaggcttggtggctcacgtctgtaaccctaacgctttgagaggatggggtgggaggatcacttgagcccaggaattcatgaccagtctgggcaacatagtgagacctcatctctatgaaaagaaaaaaaaaattagctggggctggtagcacatgcctgtagtcccagctgcttgggaggctgaggatggaggattctttgagcccaggagttggagtgagcaacgggacatgattgcaccactgcactccaacctggatgacagagcaagactctgtctctaaaaataataatcatcatataattaaccaatgatatggaatagatttactcatttacctaatattgattcatatcagtaagttattaaatggtactgtcataccttccactgtccttttaatgatgtgtgtgtgtgtctctgtgtcattagaaaggcagtgctatcccactccctctgcttagacccgagataactagagactctgctaacaagtttgccactggcttgctttatttcactttcatctctaaaatgagaagggtaatagaatgcaaaagcctagagaatgggttaaagttatcacacatgctgatgatacatatttgaataacaacaaaaaaacttggattttatggattataggcatatagttttccatagtaaaactcttgaatcataaatgaggacggcataacctacagttcaaaattataaaaaataactatttgttccagggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtaagagcctgtttctgggatttgattgatgattgtctttacaagttaactgagttttatcaaagatgtttgatgcagcacacagtggctcacacctgtaatcctaacactttggggaggccaaagcgggaggatcacttgagcccaggagttcaagaccagcctgggcaacatagtgagaaccccatctctacaaaaaatgtaaaaactggctgtgagtgggggcacacaactgtagttccatctattcaggaggctgcggtgggaggttgaggctgtagtgagccctgattgtgccactgcactccaacctaggtaacaaagtaagaccccatctcaaaaaaaaagacaagaaaagaaaaaagtttgtattagtctacctccagaaaataagtcatgcttttatgtgattgtgtctccgtgaatctggcttttcattttttgttcattcattacccatcagtattctgaatttccacctattctaaagtgttttgtaacaactacttttattccatcttttcaaattagttacaaagttcctggagtttttgaactattgtactcaggtttccttggattcataccttctttttttttttgaaagtgagtcttgctctgttgcccgggctggagtacagtcatgtgttcttgactcattgcaaactccgtctcctgggcgtaagtgatacttccacttctgcctcctgagtagctggaactacaggtgcatgccaccatgctctgctaatttttgtggtttttttgtgtgtatgtgatggagtttcgctcttgttgcctaggctggagtgcaatggcgtgatcttgactcacttcaacctatacctcccaggttcaagtggttctcctgcctcaccctcagcagctgggattacaggcatgtgccaccatgcctagctaattttttttgcatttttattagagacgagttttaccatgttggccaggctggttttgaactcctgacctcaggtgatccacctgcctcagcctcttaaagtgctgggattacagccatgagccaccacgcccagcctatttttgtgttttttgtagagacagggtttcactatgttgcccaggtttgtctcgaacccctgggctcaagtgatctacccgcctcggcctcccaaagtactaggattacaagtgtgagccaccgtgcccagcatgattccttatataaatttttatggtggcatcaagaaagcagtgttttatagttgaggggattttgctccgttgactgtgacaaccatagctgcagtttaaaatcaaagtgaattttcatcttctcaaatactagagttttggcactacctactgcttctctaggaaattgcaaatctagacacagtgtgaatagcaactggcagtttctctactctgacccagcatggagctttactctgttgtagtcagattattattttcaagagaagtgagaaaaatgttatctcattccttgctttcaccagagaatggcaacaaatcttcctctattggttaggaatgtgtttggctgcaagtaacaaacaaacttaagtatagtttcttttcaacaataaacagtggggcttatttttcttacatattaaaaaaattcagatttaaacactatagtgatttaagagtgacatctctgtgagtctcagcctttctctcctggtcacaagatgcctttgaaactctagccatcactgtgaattggcataccgtggaagggtgccagtttcttggagaggaataccatgcactgtttaccagtcctgtgggagggctctaaacaccttgccaatttctactatttccagatctggtaggttcccagatctggctggaagctttgtacaaacccagctgccagtggttcagcataaaccaagctaccagcagctttgcacaagcctgcctacaggagtatgcatccgggagacaaagcacacacaaattgggcaaagcaccttaggcagcgagactccacagaagcctaggatctgggttgagccagtccaccaagactcagtcaaggcactccaggcaggcagagtcctgtctgctcatggctctcttcaccctgcagcggagggattatgaaagcaccctgatctgggttttataacctggaggctacttggcttattgagctcaagtgttgtaagagatcttgtcctaggaggggtgaggacaaagcccgagctattcaggacagtccctcttggtacagtctgtccaagaagagaattgcaaacaagaagggagagagctgagttcagcaaggcccttgagggacttgtctccctccagtcatctccattcaaggcaagaagtgaagaggaagggggagccagcctcctaactcattttgtcaggaaagcagaagcttccctaccaactcctgtttatgtctgagcatctagaacttatcacataaccaatgctagctctaaggagtgctgggagaacagggaacaggatctatgacctgaggctgagaagtcagccagcctagagaaaatcaggattccaatcgcaaagatgaaggaaaggatggaaaatgggaaaagaactgaaggtgccttctgcatccctgttcctaaaacggttatagagccctggcttcaaattcctttagaccactaaaacctctctcctttttgagacggcctcactctgttgcccaggctggagtgcagtggtgtgatcacagctcatttcagcctggacttcccaagctctagtgatcctcccacttcagccccccaagtaactgggactacatgcacgcactaccatgcctggctaatttttgtggttttttgtagagacagggttttgccacattgcctaggctagtctcaaactcttggcctcaagcgatccacctgcctcggcctcccagagtgctaggattataggtgtgagccactgcgcctggcaataaccttcttaaatcagcaccaaccattcttttttctattcctgctaataaaaggccataattttgtccgcctttaactcctgccccaccttttcttacaggtgtgtttatctatcgatcatcctcagaaggtcttaattatgggtgaagctcttgacctgggaacctgtaaagccaagaagaagaatggagagccgtgcacgcagactgtgaatttggttggtttcagccttgttaggatggtttctgctaaagaaaagaacagttaggaataaactgttggtgctttagctgtgatgaccagtttggaactgagtttcccacttaaaggaagagtcaaaatgagaaaatttaatgtgtggttaataactgccagtttaaaaaagtgagggcaggggaaaggtgaggggatttaacctcttaggaaagtgatcttttatctgaccaagaagtttaagacagaatttttgtttgcctttaattcttgtaattccacagagcaaacatgatgaaatacaatgaaaattgtattttagcctatattttaactccattataccttttcttagggctttttaaaaaataatagcttcatttaggtataattcacataccatgcaattcacccttttaaagtaagcaattcaggccaggtgtggtggctcactcttgtaatctcagcacttcgggaggtcgaggcggacagatcatctgagatcaggagtttgagactagcctggccaccatggtgaaaccccatctctactaaaaatacaaaaattaggcggtcatggtggtgggcgcctgtagttccagctactcaggaggctgaggccagagaatcacttgaacctggaaggcagaggtttcagtgagctgagatcgcactattatactccagcctgggcgatagagtgagattctgtctccaaaaaagaatataaataaataaagtcaacaattcagtaatttctagtacattcacagagctgtgcaaccatcaccactgtgtaatttcagaaccctttcattgccccagaaagaaacccagtacccactagcaatcactccccagtctcctctcccccagcccctggtaagcactaacctactttctgtctctatggatttgcctcttctagacatttcatataatggaatcacaatatgtggccttttctgtctggcttcttttgcttagcataatttttctcacaattgatccgtgctgtagcatttatcaacactttattcctttttgtgggtaaataatattccattgtatggatataccatacgttgtttattctttcatcagttgatacacgcttgggttgttgccacatttagctattatgaataatgctgctaaaacactcacatacaagtttttatgtggatgtatgttttccactcccttgggcatatacctgggagtgggattgctgggtcaacatggtaactgtccagagtttggaggaactgccagactggtttcccaagtggcccaccagcaatggatgaactttccagtttctccctgtcctcatcagcacctgttactctatttcttttttgttatagccattgtagtaggtgtgaagaggtacttcttagagttctttgaaaggattaaatgacaggttttggtttaatctttttttattcccttattccttcctattagattaattggtggacaggaaagaataaggtgggagacggttggaaaatgaggtttcagagtgaagtacccaacagatctccccgtgagaattagattcttaaaaatccattgtctggatggggcggtggctcacacttgtaatccctgcactttgggtggccgaagtgggccgatcacttgaggccaggagttcaagaccagcctggccaacatggtaaaaccccgtctccagtaaaaatacaaaaattagctgggcgtggttgtgcacacctgtaatcccagctacttgggaggctgaggcagaagaatcacttgaacctaggagttggaggttgcagtgggccaggatcacgccactgcactccagcctgggtgacagagcgagactctgtctccaaaaaaaaatccattgtcgccgtaactactgttcacccagcagaacaatgctgcaccatctctctttgtttctttcactgaaaggatagcacttgtccgaggatcaaccagagaaacagctagaaaaacctcgctgggagctgattttgtttttaaattattttttattgggtcaaaattcacaatatacagttaatcattttaaaatacatatataattcagtgatatttagttgtgtaaccaccagctccctggtttcagaattccatcaccctgtaaaaacaatggcaccataaagtcatcactcccatccccactccctccgtctcctggtgacgtctaatctgctttctgtctctatggatttgcctcttctataaaaacttccttttatattaaataacataggtcctatattaaataacataggaccttgtgtgtctgacttctttcacctaacttgttttcaaggttcatcctaaaagctgatttcctttgtagaaagagggcaaggggtatttcaccagaacagtgctttcaggggactcgaagggaagaacttcttcccctcagggactgagcagcccttccacattgggaacggtcgtggaggtcagcagggaggactctgcatgcgtcatgttccgggaagtggggagaaggaactgtgtctgctcactgctgtttcccagcctgttgccctcatcctgatgccactgctctgccttttgcagcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaatgtaagacgttctcgggcttcttttgggcagaggattttgcttatcaaagactaaacctactggttgtaccttcctgtaaccgtcataggatacttgtacaggttttatctttcataactcactacttgaaacaagttggttaaagaccgcttttattcccaggtagagagaaaaactttcaggagagagagagattgacttatgttgtgttggactttaagagagcccactcttcctcttcaacttttttttttttttttgagacggagtcttactctatcacccaggctggagtgcagtggtgcagtctcagctcactgcaacctccaagtcctgggtttaggtgattcttctgcctcagcctcctgagtagctgggactacaggcgcgtgccaccacgcccagctaatttttgcatttttggtacagacagggtttcaccatgatggccaggctggtctcgaaatcctgacctcaggtgatctgcctgcctcggcctcccaaagtgctgggattacaggcatgagccactgctcccagcccctctttgacttctaatgtgaatagtgcaccttcatcagggccattaaaaatgtgttaattacagtgttaacacccttttaattatttctcgtatgactatatgagtgaggctacagacctcatggaacccaaatttcattcagtgagtgaatatactatgaagcttcacatggggagtggggcgatgctgggcaggcatccatggccccttgcctgggggttcagagtcactacagcccctgacgctgtaatccaggggtgtccaatcttttggcttccctgggcccctttggaagaattgtcttggactacacataaaatatattaatgatagcctataagcttaaaaaaagaaagaaaagaaaagaaaaatctcttaatgttttaagaaagtttatgaatttgtgttgggccgcattcaaagccatcctgggctgcatgtggcccgcaggctatggtttggataagcttgtaatcagtggcctcgtcactacattatataaagcatatctgaggacttggcacgaggcagctacagttggtccaagaataaaacatagatttttgttcccaatccagcaggaatggggcaagaggactcatttcctgtttcttttttaacagtaagcatgtttttgagatttaaaattatttctgaatttttccaatctgctaaaacaatacatgtatattagtcttttaaaagaacatacaatccaaccaatggagaaaataaaaaccaactataatcctatcacctgaaaaactgttagttctaggccaggcacagtggcttacacctgtaatcccagcacttcgggaggccaaggcaggaggattgcttaagcccaggaatttgagacccgcctgagcgacatggcaaaaccccatctctacaaaatgcaaaaaaaattagctgggcatggtggcacatgcctgtagtcccagctgtttgggaggctgagatgggagaattgcttgagcctggggaagttgaggctgcagtgagtcaggattgctccactgtactccaggctggacaacagagtgagatcttgtctcaaaaaaaaaaccccaaactgttagttccttggtatatatactcctaggtgttgtgtttcttcatatgtgtacatttttagtaatataaaatgagatcatattgttcctattctttgtatccactttttttccagtgtaaaataattaatgtttttctcatgtattttcagtggctacatagtgttcttttgcatactctgccttaattcatttaaacaattccctgtgggtgaacgttaatggtgtttccaatgtatgacattataaacaaagctgccattaatatcctaaatttttgcataatccttaattattttaagataaatatccagactgctggatcaaagcattggctttttttttatttcttttgccaaatttccttccagaatggcctcaagtggatttgtaggctgcctctagcttttcctctgtgacacagtgcataaaccagttatgctattgggccgtaacattaagaaagcctacttagatggtgttttgagaaactttgacggtgtgtgtaataaatgatgatatctatgccttctttacctcatcagagcattgaggctttagtgattctccttttgggggtgacttgtcatttcagtgcagcagctgtggctcctaagaagaagattcaaaccactctgagtaatctggttgttaagggcacaaacttgatcatccaggaaacacggcaaaaactcggtaactttgtttttccataagaaatttctttctccagtttaattatgcagccttagggataaaagactacacattgggtacagggtacactgctccggtgatgggtacaccaaaatctcagaaatcaccactaagaacttattcatgcacaaaaataaataaataagcaagcaagcaagcaagcaagcaagcagtctttagggttgaaaatggatacagctcatactcttaagtaataagaatccagtcatcacctgtacttagtgagtggcgcggtctaacctaaaggaatcaagccaggtttgcaggaccttaaggaaaaaaacagcatattgattttagctatgtcttaccttagtatgctttttaaaatttcttggtgtatctgggtccaactctttacatccagcattagaatcagcagtattatcttcctggccaagcttattggttatcttttgttaaaatgggtcttggtcataaaaacaaaaaaatttttaataaaataaaaacaaataaaaacaagtcttgatcagagaatgcagcccccatcctgggcttgtggtcagggacccttatccttagcggatattccagaaacagggtatggaatgacccccagatttaagggcttaatattctaatcattactagaaataaaatatagtcgagataccctgccatcctatgagtctgatgatagaggttaaggattcttttctttcctcttgggattccgtcttcttcgtttacgtatgactaaaattacaagtgcagagtttagaaagtggtatgtcatatgacctcaaaccatctgaatgtgaatcctctaaagctggtgttgacctggcacaggaataccccagaagagcctgtcttgctctgaggagttcaaggaactgatggacctgccgacgtgtggagccaggaacttaaaacaacatttagccaaagccacagcttcaggtaccatcagctgcatggccacacgtgtgtccctgtgttccctcagcctcccagggcaccccctcagtctgggcttctgtttcagggattatggggagcccaaaaccagccatcaagtccatctcggcctcagcactcttgaagcaacagaagcagcggatgttggagatgaggagaaggaaatcagaagaaatacagaagcggtaagaggagcagatttaatattccccgcttgggtcatccatctcaggcgtcctcagaacgtcttcatcgatttccagaatgtgacttcaggtttcggttggctgcgttttaactctgaaagtttaaaatagttttcccataacctgaatagcatttaaggctgtattatttcttacactggtgactcccaacaccaaatggtacaggttagagtcgttatcaccatggaaaagggaaaggagtgaagtgtatgtaaagagggtttttgtgaagggggagagcgtaggttcacatgctggctgtcattttctctctctctctcttttttttttctgagacgggttttcactctgtcaccccagctgaagtgcaatgctgcagtgtcggctcactgcaacctccatgtcccaggctcaaatgatcctcctgccttggcctcccaagtagttgggactacaggcatgtgccactatgcttggctaatttttgtatttttttatagagactgggttttgccatattgcccaagctggtctcaaattcctggacgcaagcctggatttgcctggctgccatttctgggttttgccgcaattcagttttttatgacaggcagagccagtgagtagaatacagttctttggataaaggacaaaactgaagcactaaaaatggagagtcattttagaggcaaaagcaagtggaaatgtgttacttggcttcagccaataattaaaaaaaaaaaaaatcaagtggaaatgcatagggtaggtggacaaatgaatgattcctgaactcaggtcacctgaatactaatgagagctgcggttcacaggcacttcatacgtactccataaacacagtatctgagcctccggaggcttctcagccttgttttactaatagtgtgcctggagatcagagagctagtttatggtggggccgagttttgggctcacacatgttgtgctctggtgctgaaccttttgccatcccgaatctgggctgctgaaaggcaaccacatccatgaaagggagtcaatgataagacaagaggaaattctttgggaaagtaagagaatgggtttggtctcaggcagattagtttgaagtgccggtgggatatctatagagctattcatcttgagcctacagatgacataaattatatacgtggacacagaaatatgtatggagttgggggcctcgtgggaaatagagaatgcccatcagcttgaaggcattgcgtaatgaaaattttcagaattttgttggccaaggaaaccttatctttgcgtaggatttgataggcagtttgcaaacacagcctagagcttgcaagagtggctgtgcggttgggaagagtactgctctgggatggcctggctctaatcctgagtctggcccttgtgagtaatgtgatcctaggcctcagtttcttcatcgatcaaatgagaagtttggactagatgatttctggggtttgttatttgtttttaaatatctcttatgaggctggcttggtggcttatgtctgtaatcctagcactttgggaggccgaggcaggcagatcgcctgagcccaggagtttgagaccaacctgagcaaaatggcgaaatcctgtctctacaaacagtacaaagattagctgggcatggtggtgcacactgtggacccagctactcgggaggctgaggtgggaggatcacctgagcctgggaggcagaggtggcagcgagccgcaatcgtgccaacgcactctagtctgggtgacaaagcaagaccctgtctccaaaaacaaaagtaaaatagctcttaaaactattttttgccaggcatgatagctcacgcctataatcccaacacttgggaggctgaggcacgagaatcacttgaacctgggaggcagaggttgcagtgagccaagatcatgccactgcactccagcctgggtgacacagcgagactctgtctcaaaaaaatcaaaaaaaagaaaggggatgtaaaataatcgctgcaagttacagtgtttttcattaatgacttccaaatgtctcacatgtattgtctcttcccagtagcataaacaaagatgcagggaggtgcaatgagttcctacaggccctagagctgacggtaggggtgggaatacagttcacaccgcgtcttcagctgtgttccttgtggatgacatccactggacagccaattgataaaaacagttatcagttctaaagtgttaggacaattacagcttattcaaagaaaactcaattaaggaggagttagtaaagctagtattgttcttatcgtgtgcaaatttgaattaccagcctagaaggggacattattttgctaacaactagctcccaactggtggcctgcctgccgcctcccagtccactttgagttctagagtttttattttcgtaaaccctgtttgcgtattttgactgtatgttctttaaagatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaaggtaactggcatctcttctctttagcacttgagtttgcattctgtagagcagagctggaggaaagacagacacctaatagctctttattgatcgtgatcattagagtcagtgtaatttgaaaacatggtagtgtcaacataatactaaaagaaagttagatctgttatctcaacactttttcttgtcaggctacaagaggtagcctagaggaagatagtgttttataaccagaggcattgacagtaggaaaacaatgcttggaattgttgaggtgagactgtaaaatggtggtttaaggaatcctttttttacgtttatttatttatttatttatttatttatttatttatttattttttgagaaggagtctcactctgtcacccagactggagtgcagtggcgcaatctcggctcactgcaacctcctcctcccagattcaagcgattgtcctgcttcagcctcccgagtacctgggactacaggcgcctaccaccacgcccggctaatttttagtagagacatggtttcaccatgttggccaggctggtctcgaactcctgacctcaaatgatctgtccacctcggcctcccaaagtactaggattataggtgtgagccaccatgcctggcggttttattttttatttgttgagacagactatccccctgtcacccatgctagagtgcagtggtgcaattatggttcactgcagcctcaacctcccaggatcgattcatccacctgcctcagcctcccaagtagtagctgggactgcaggcacatgccaccacgccttggctaatttttgtattttttgtagagatgggggcctccctttgctgcccaagctggtcttgcactcctggactcaagcagtcccacctcagcctcccaaagtgctgggactacaggcatgagccactgtgcctaaccaagaatcctttaaaagaaatcttacacaaaagtccagtcccatgacaggtgaaagctgagttgctgcggctgaagtaggggtagggcacccagagccccacctgcccacttcctgagtgccccaatcgagcctctctcttcccttaagttagcagctgcagccaaatgaagggcaaagcttgctgtatgccaaaaccttacctataataataacaacaggaatacctacaataaccatggcacatgtccatattactcagtacttgtgatatgtgtgtgccatgtatttactatgtttatttatttatttatatatatattttttgagatggagtctcgctctgtcacccaggctggaatacagtagtccgatctcgcctcactgcatcctctgcctcctgggttcaatcaattctcttgcctcagcctcccgaattgctgggattacaggtgcccaccaccatgcctgactaatttttgtatttttagaagagacagggtttcaccatgttggccaggctggtttcgaactcctgacctcaagtgatccacctgcctcagcctcccaaagtgctgggattacaggcatgagccactgcgcccggccaggaatgtatttgctatgtaaagattcatactttgcagatattatcttatttcatccatacaaccatgaccttcaaaggtaggtcaatgctatatcatcatttccttctctttttttgtgtgtttgttttgagacagggtctcactctgtctcccaggctggtgtacagtggtgcaatcacagctcactgaaacctccatctccctgggctcaggtgatcctcccatctcagtcccctgagtagctgggactacaggcatgcactaccatgcccagctaattttgtaccatgcccagatgaagtctcactgtgttgctcaggctggttttaaactcccgagctcaagaaatccacctgcttcagcctcccaaagtgctgggtttacaatgagctaccatgccaagccccatttccattttatacttgaaaaattaagtaattttccttgggttacaagctagtccgtggcagagctggctggaactttatcttaattctctctgattctaaaacttccaaaatggtgatgtggctcctttatggatctggaagcctgcagtcttgctgatgtcaaacttgttatatttaaataaactaagattttattcatcaacatatagacctgtctcccatgctattatattctagtaattgtgttaataatactaagtaaaattaagatatgttctgccaatttctgtcagagaacagccagaattcactggttactaataaaaaagggatccaggtctataagtgcctctgtcatcttttagatctttacctccctctcattcccttttttctagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaaggtactgcagtttcacagttaacagtgggaaagagaaactgtttctaagggaaatatgttctaaacccaaaccagcacccagatatcaagcaattacttccatttcctcctatatagaatacctaaatagaatttctatgggtggaactgattttttttttttttttcatggagtcttgctctgttgccaggctagagtgcagtggcgcagtcttggctcgctacagcctctgcctcctgggttcaagcgatcctcctgcctcagcctcacgagtaagtgggactacaagcgcgcgccaccacgcccagctaattttttgtatttttagtatagatggggtttcaccatgttggccaggatggcctcgatctcttgacctcatgatccgcccgccttgacctcccaaagtgctgggattacagacgtgagctggaactgatttttttataattacattaaattggaatgaaattgggcacaatttgaatacttgggaataggattgctcattggatctttgtacatatatatattagcataaagatttactttgacagaactagaattcctttgttttaaattgccatatctttatttttaaaactctgaagttggcaatatcattttaacataattgtcaacattatttacactgttgttatctgttactatcgtcagctgcctatttgaaggtgaaaaagagattctatttagtggtaaaatctgccaccaccccacattctaggctcagcttcttggctcacctctgagagcttttccctgctgggaccagcgggggtaggtcaagtttgaagggctggtaggcagaggaggagggagtgggagggagtagagttgatgaggcgcactggctttctgaaatttcttggtcgctgctaatgtttgttccttgtgccctagctgaggatgaattggagcctgccaggaaaaaaaggagagaacaacttgcctatctggaatctgaggaatttcagaaaatcctaaaagcaaaatcaaaacacacaggcatcctgaaagaggtaagagcccaaaagctcaaggatggtgttgatgtccgatgtccttcaaagccaaggtgctagctgtaggaccaagaatgtgttgtttgttttattttgtttttctgagacagagtctcagtctgtggcccaggctgaagtgcagtggcgccatctcggctcaatgcaagctccgcctcccaggttcaagcgattctcctgcctcagcctcccaagtagctgggattacaggtgcctgccaccacacgaagcaaatttttgtgtttttagtagggacagagtttcaccgtgttggccaggctgatctctaactcctgacctcaagtgatcctccagccttggcctcccaaagtgctgggattacaggcgtgagccaccatgcccgtacccagccaagaatctgttttttacataaatctaaaagtaggtatatgtcagtttgtttgagtttgctttgaagaacaggagaatttctaataaattttagctttgtccttgtctctttactgaagaatatcatttgatttaacatgacttaaatagatatcaatattataaaaatgtttgcatttggttatggctgtgaaattatgtttaaatggctctacactgctgctattttctgccttgcaatatgcaaaaagagttttcccattccagtatttttatattggcatttcaaatgctctaaatcagtagttaaccccatcacacccaaggaccctttttaataacaagtattttgtattgcttccttatcttgaaataaaattcatagataatatgaattacctatactagtcatttcgaaaaaaatcaataaatatcctaatgcaaataagaaaaaatgaaaagatttgtgataaagatacagatttcattatggattcataaatgcagaggcagaactagcttaggggaaataatcaagtcatcagaggcttggacttatcagtgtaaatgagccagaaatggaggctcacataggtttgtgtcttggtaaatagcatggacctatttctttgataatgtaggggttttgtcaggggttggaggggtgttcagacagggtctccgtatgttccccaagctggtcttgaactcctgggctcaagcaattctcatacctcagcctcctgagtagctagggctagataatgtacttttggtgggggttggggaggttttgttttttttgagacaaggtctttttctgtcccccatcagggctcactgcagcctcgaactcctgggctcaagtgatgttcccacctcagcctcccaagtagctgggactacaggcgcatcaccatgactggctaatttttttttttagagacagggtttatctagttttactcttggaatggtcaacataggttaaaaccatgcacaaatattgtagggttgtgtagaaagcagttagattctagggtttaatcaggttccccatccacacagatgtctcatagagcacacagaagccaggcaggatgagaagcaatccttggttgtgtcggtgactgtcacatgcattgcagacagtgcagcaccccggtccctgccagccacagaggtagcaatcattgcaatgaaaaggaaagtgctcccaccaattttcaaaatatccccattcagtatcactactctgaatgatctgttcttcctttgattaacaaataactaatgagacagttctgcatcatatcttttcactggacttgaaactcaggagagatgccagagctgactgcaggctgcagagctgagctcctcgcctctgtggaacccttggccccaggccctcctgtctgtggagcagcactaatcccatcgctgcacccacattctgccacaagcatctctgccctcagggctgttccctgatgtcccgtgcacccaggaaactcaccagtgggggcctggaataccttgtgtatgtggagtctgtattagaacagtagaaataactgcctttgggcacacacttgacatactgatactgtcatgttaggagtgtttatttgtatttggtgctttaaaagtcaccaaatgggccaggtgcggtggctcatgcctgtaatcctagcactttgggaggccaaggcaggcagatcacctgaggtcaggtgtttgagaccagcctagccaacagggtgaaaccccatctctactgaaaatccaaaaatttagctgggcatgtggcgggcacctgtagtccctactactcaggaggctggtgcaggagaatcacttgaacccaggaggtagaggttgcagtaaggtagagattgcaccactgcactctagcctaggttacagcgagactccatctcaaaaataaaataaaataaaaataaaaatcaccaaatgctctcatgtccctttgtttttgcatattaagagctcgtttctatgcatcatcatcttttgctttgcagctcatgaggtgctgtccagggccctctcacacttagcctgcctcttccattctgttctgttttgattattatcagctgagtcatttgaataatcatcgagttactcttactgtgctgcctgagtgcatactggatttagtaccaggtctttcattatgccctgtcattccaggccgaggctgagatgcaggagcgctactttgagccactggtgaaaaaagaacaaatggaagaaaagatgagaaacatcagagaagtgaagtgccgtgtcgtgacatgcaagacggtgggtgaaggtgggggctgcagcaacccatgggccctgtgtggtgcttttgtgactcggcagcatgtggagaacctgtgggatctggggccctatctcgtgatgtgtcagttaattaggctggaaagcaaagggcgcaggtggcccaggacccggcttcctgcctgacctggctgctgtgctctgctgatggagtgtttgtcgaggggattcttctctcatttgaccacagcccccagtttggatgggtcctaacatctcttgccctggaccactgggtccgcgtggctctgactgctctttctcaggttttggcgtatcctcgctcagcgttctcaggccttgggaccgtggttgaaccccctggcctctcctgttatgatccaccactgctttcctactcctggctcaatctgctctgttgagtctcaagccagagtgtggattagatcatcatctgtgtttgcagaatttttatcataaatctgttagaaaattctaagtcctctattcttcaacactgattaaaaatgggaagaaagggctgggtgtgatggctcatgcctggaatcccagcacttttggatgtcaaggcaggaggatcacttaaggccaggaatttgagaccaacccgggcaacatcgtgagaccccatctcaacaaaaaataaaaaattagccggtgtggtggtgcacacctgtggctccagctacttgggaggctgaggcaggaggatcacttgagcccaggaatccaaagctgcagtgagctatgatcacgccactgcaccctagcctgggcaacacagcgagatcctatctcaaaaagaaaaaagacaagaaagaagaaagctcttgctgaacactgttccttccattaccatttgttcccactatccctgtgtggcaaatcagcctacttaataaacatgcagaagaggtggaagtggcatagcttaccaagtgcacttttctctgtcttattccttttaacactttagctctcctatgcatttgggggtcagctccaaatcagctaccaccaaaagtagggcttccttgagaaagtttctgtcttggggcataagtaaagatgattcttttaaacgtaatctttggaagattatgtgtctttggaagacaggaaacacaaacccaccattgcatttcaccctagatgacagctcttactctgacacagcggtggacctgcaggcggacttagtgggtttgtctcctgttgccaccgtaacaatgatcacagatgaggtggcctaacacaatgcacatttattgttattttattatgtatttatttatttatttttggagacagagtctcactctgtcgcccaggttggagtgcagtggcacagtctcggctcactgcaacctctgcctccctggttcaagcgattctcgtgtctcagcctcccgagtagctgggattacaggcacgcaccacactgcctggcaaatttttgtatttttaatagagatggggtttcactatgttggacatgctggtctggaactcctgacttcagatgatctgcctgccttggcctcccaaagcgctgggattacaggcatgagccaccatgcctggcctcacagtgtacatttattatctcttatgtaggtcagaagtctgtagggctacaatcagggtgtagccagggccaggtttcctgcagacggggctgcagtaggggagaatcatctcctggcccagcttctgagtcacagtattcttgcctgccctcacttcctccatgcagccagcggcagcaggttgagctctcaccttgcagccctgagctcctcttccacgtttaagggtccttgtgattccattgggcccacccagatcatctaggacaatctccctatccattagcaacctgaatttcacctgcagcctcgattccccttccctctggaccatcacacactcacagtttcggggagtagggtgtgcacgttttttagagggccatcgtcatgccagccttgggctcaccactctgctctgcactttctgaggttgtccaagtgtcgagttattgatcaagctcagtgtaattcccggaagttacatcgctctctactgcacatgttttgctactcacccaccccttctcattctcctcggtccttctgaggatcggaattaaaagtgaattcctcaatctctctgtcttggctttgctgctaatagggagtaagaataagcctatatcctttttatagatcatagaagagaatgaaagagctgctgatcagtctaaatagatcccaagcctcagcatcctatataagcaaggggccgtaatgactctagcacagactgaccgaagctatttaggggtttacagtacgtttcctctcctgcccttgctgttgtcatcatggaacgtgttacacaataacagaaagttattgtgtactttgtgcctgatcagaaattgggacaaacgtgagaaacggtggtatcagtgtgagggagtcgggcaatcacacgggtcactgtagcaagaggcgaaggtggcccagtcccctagcaagggcccaggtagtgatgagagaccaggtggtcatggagcagattgcccttactgcagctgagcatttgtcctcaaaggctcttcaccggcggtgtgggttttttgttgctctgtgcagtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcaggtatgagaatcacctggagctctttgtcccacgtggggattttcatctctttttccagagtctgtgattctgttcccttggaacgttggatgatcattccatgccttcctatagctccaggctacccttgggactcaagctgttaactgaaatccctggaaggaagggaccctgccctttcactgctgtccccaacacctaatatagtgcctggcccataaggggtcctcagaagtgtttgttgaataaataagtgaagaatcatagggtgaggtggtaaacatgtgtgtgtttgttgggggctaggatgcacataatatttttttcctctctccaaagagttatttgatcattttaaatgtctttagcttgtgaggactctgctgttcttcagtatccaaggggcattggtcccaggacagcactcttccccacaggataccaaaatctgtggatgctcaagtctctgatataaaatagtgtcatatttgcatataacatgcacacatccttccatatactttaaatcatctctagattacttataatacctaatacaatgtaagtgctgcaaatagttgttatattgttttttattgtattttttattgtgcttctcatgtatgtatgtatgtatgtatatatatatatatatatatatatatatatatatatatatatatatatattaatttgtataaatttaaggggcacaagtgcaattttgttacctggatagtttgtgtaatagtaaagtcggggcttttagtgtagccatcacctgaaataatgtacattgtacccattaagtaatttctcctccctcgccccctcccacccttcggtgtctattattccgccttctgtgtccttgcatacacatgttagcttccatttgtaagtgggtacatgcagtatttggctttctgtttctgagttttttcacttaggataatggcctccagttccatccatgttgctgtaaaagacatgacttcattctttgatatggctgagcagtattccattgtgtttatgtaccacattttctttatccagtcatctcttgatgggcatttaggttgattccacgtctttgctattttgactattactgtgataaacatacatgtgcagaaatcagtgtactgatttcttgttctttgggtagatacccagtagtgggattgctggattgaatggtagttttatttttagttctttgagaaatcttcatatgttttctatatgaggttgtgctaatttgcattcccaccagtgtgagcattcccttttcaccacatccacgccagcatctggttattttttgcctttttaataatagccattcttactggtataagatgataactctgatgatgagtgtttttccgaatactttggacccacggatgggatgcttgaacccacaggtgtggtaggctgactgtgtgtgttgtaagtgtcttttgtttctctttttacttttgggggcaacatcagatacggaggcagagctgccgtgtttgacagtcaaggaacatccttcacatagaatacgacgatggcacctctggagctgggttaaggaaccctccctggtgcagcatgttgccgtcgcaggtccatccagtgccctccctgtttcattcacgtgctcttcttacccattctccctccatcctatcccttcgcaccatcctctgccattctccaatggttgctgtgatcctcttgttaattttcttgtgaacgtgtactgcttgctctgcagccgtttttatttcacataggtggtacagaattctgtctcatttgattttgtttctcactcggctctgtgtttgtaggatgcgtctgtgctcgctatgttcctcggcttcctaactgatgacagtgcccaaggcagcacccatcacatttcgcccacgggcaccctataccctccccacacaggtcccctggcctcagcccctcagtgctttcaccacaatgagttcttattcttgtcaagagctctcactgggatagtatcactgccttttggtgtgcttgcttattttcatttgttgttcacttcctggagttcatacttcactctcacttcagattctccagggtcgatccagagatctgagggagggagccaggaagccgggctagttcatcactttaccaggagctggcttgccaatttttcacaatctagattataatttttaagtagttatttatatattgatacttgacttttttccaaactagatgactaaaaatgtcattatagcaagagcttatggaaaacgttagaaaaattaaaaaaaattctgtttattaagtacagggcacaaatggaagggcatgatgcctttcagcctccagatggcactgtgattgtaagaaccatgttttttctggactttttgtcagttgcttttttttttttccttctttttttgagacagggtctcactctgtcatccaggcaggagtgcagtgccatgatcatagcccattgcagccttgaactcatgggctcaagcgatccttctgcttctgcctcctgagtagctgggactacaggtgtgcaccactacacccagctaatttttttaatttacttttttttatagagacaaggtctcactatgttgtccaggctggtttcaaactcctgggctcaagtgggctcagctgcccaaagtgctgggattgcaggcctgagccaccatgcttggctagttcttgatctagaacagaaggcagcacacattgcctgtaaaatgtcagtggtgaatatattaggctttgtgggccagatgatctgtcacaaccacacggctctgctggtgcagcctgaaagcaaccatagataatacacaggcaactgggcacggctgtgttcaaataaaactttatttataaaaactggtgatgtgctggattggggttgtagtttgctgactcctaactagaatagtgattttttttttctcacaattttatcattgatcgacatataggctaccagagttctcttcattgatactgaaccagtctctagaggtggaaggtgatggttgggaggttgtaagggctaaggccactggcgtgccacctttcagggcagaaattgtgatatggtttggctgtgtccccacccagatctcatcttgaatggtagctcccataattcccacaagttgagagagggactcagtgggaggtaattgaatcatggggcaggtctttcccgggctgttctcatgaaaacaaataagtctcatgagatctgatggttttataaaggagagttccctgcacacactgtcttgcctgccgccatgtaagacatgcctttgctcttccttcgtcttccaccatgattgtgaggcctccccagccatgtggaactgagtccattaaacttctttcctttataaattacccagtcttgggtatgtctttactagcagcatgagaacagactaatgagaacgagtagactctaagctaggtaaggggaaggggagacaggcagagcatccccaccccaccccaaccctctgaaatccaagtaagcaggcagacatacttccttagctttattatatgtcttctctctttctctctctttttcccagagtaaacttcataggaaataagttttcaccatagtgttcacatcccttctcagggtggaagtcacccaccattttaaaaactagagcaagaagggctggacttggtggctcatgcctgtaattccagcagtttgggaggctgaggcagatggaacacttgagcccaggagttcaagaccagcctgggcaacatagtgagactccccatctctacagaaatttaaaaatgagctgggcatggtggtgtacacctttggtcccagctactcaagaggctgaggcaggaggatcacttgatccctgaagatcaaggctgctgcagtgagctgtgatcgcactactgcactccagcctgggccacagagtgaaccctgtctctaaaaaaaaataaaaacaaaacaagagtccctgggccctttgaataaaaagagagtaaagaggctgggcacagtggctcacgcccgtaatcccagcactttgggaggctgaggcaggcagatcacttgtgcccaggagtttgaggccagcgtgggcaacatagcaaaatcccatctctccaaaaaaaaaaaaaaaaggaaaagaaaagaaagtgagtaaaggcttttgggttataaagagaaagggagaaggatgatccagactagaaagaagattattcctttcttagctcaacctttttgctccaaaaaaaagaggaggaaggggccaaacatagattatcctgcaccagagggccagctccttaaatctgagtctcatcccaaccaccatcatttgtaaaaaccaagggtgcattcattacctgcagtgcgtggatccctgtggtgccatcattatcatttgaagctccatctctgaagcctctagctttgtaaggacctacagaccacttcccaagtcattgcaggtttatttttgtcgcatttgagcataacctcagatttggcatacaatacgaatgtcaccttgaacagcttctccttgaatgggggcctactctccccaggtgcagtgagcaccgtcgtctttacatgagtgggcctacaccaccctgctgagtaaatccatctgttctgtttcagtaactgtggcctctacaaatgggaacgggacggaatgctaaaggtatgccatttgcgtactaatttttgactccttttagtgacccatgctaataatgtggaaccatctcctattaaaatattttcatttttctaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataa

SEQ ID NO: 378 - DNA, 25509 bp, Homo sapiens
agactgctgcctcaggcaacgggctttccgactccttggcttcttatgtgaggaaaccacagcgcggccggcatccagagagtcggttagccgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtaacgtgcgcgcggccactgggccgcggggcgtgtggggatggcgaagggctggctccggcgtccctgccgaggtcctgcgtcctcgtcccgggctggccgggtccacggggcagccagggagccgcaccctgcaggccgggggtggggttcagcgcggctcgcagtgctgggcgaccccaccacggacgcgctgccctctcctcggcctcgagtgcagtccccgcgctagattttctttccggtggaacttgctcgtaacttccttcccgttagccgatacagatttgatatgacccaaccgcaaaagtaggacgtgggccaccttccagctctgagcgcacggatcaggaaagccagccagagggtagccctagggagggcaggcactttttcaccattctgccgcccacggcgtgtccggtggtacagcggggggcagccttcccacccaccacaggcacagaccagggacaacggggacgccgtctccagcgagctcgtcagtgacacaacatgtccaggggcctttggcccaccagcaagggaggcagatagaaaggctcacacccaccttccaaaataactgtcctacttagggtctccaccttgcagtgtccctaccatgcagatgtgaaggaagcggtcaggacaggttcccgtttcccggtggtgtggtgggagttccttcttgctggatttctgagcttgccattcgcgccaatagtttcgtgtgttctgggctttctttacatgcctatatttgtctttggaggggttcctctcctacttagtaataaaccaatacatttcttaaacatcttaaaagattgacttggagactggtgcagataggcttttccatccatccctccctctgcacctccttccaatcatttaacagacttgtattgaagacctgctgttggctagacccagcagaggatactgcagtgaccagaaaaagccagacaaagcatctaccatcctgggctttggttggcgttgactttgacttcagagacagccaggaccttagggtctaggatgtcatctcatgtgagagtgagagacggaatgatgcgtgttccgtgggaaaaagaggaccaacagctacttcccagtataaagagagttcctggggaataaacactggctttgtcggctgcacaggtctcctttttttttgagacggagtttcgctcttgttgcccagggtggagtgcagtggcgtgatctcggcccactgcagcctccgcctcgggggttcaagcgatgctctggcctcagcctccctagtagctgggattacaggtgctggcatcatgcccggctaatttttgtattttagtagagacggggcttcaccatattggcatattggccaggctgatagcgaactctagacctcaggtgatctgcccgcctctgcctcccaaagtgctgggattacaggcggcagccaccacactcagctgagggctcctttttatatcctcatgcactgctgttttgttattcagtgtgtttcggcctcgggtagaggggcaacagattttcagttgaagcttaagtgctatcctggggcagttgtgttgtcattggagtagttgatcagcgaaacacaaacttgaagttgcttttgaatctggagctggggaaagattctgagtctactttgagcagggccaggaatggatagcacagaggccagcagagggggcccagaagagggctcagcaaaagtcctgtggccgccatttacctgttggttattgccctacacctgaatctttcccactccgactttgaactttttcactctgtagtaaccgcaactgtggagtaattacaggggaggatagttactgaaggaagactggggtggtggcttaaagagctgttcatgccggcttgttgatctgcggcgagtctggttgtgggatcagcatgagcaactcagtggactgtcaaaccctgcagagccgggacacttactcatcacccccgtttcacctgtggttgagtctcatgtacagtagtactgaaaagagattaattttaatataaaaaacaatgtcagcatctggaaagagcccccttatggagggggtgctttatacctgcctgtctggtctcacactaggacagcatggcagagcagggacttgaatccaagtggtctgagtttttgctctttacttacacacgaatctgtgtaactatttttacaaaactcttaaatcttcaggagtttattttgggttatgatgtgaggtgaataactcaattatttcctaataagtatctgattgtacaaatgctgtttgttgaatactcttttccattctcgctgattgtgatgccggtttatcacattcaggcataccttggggatagtgtgtgttcagttccagaacactgtaataaagtgaatactgcagtaaaccaagtcacatgaaatttttggtttcccagtgcatatataagttatgtttacatgatactatgatctattaagagtgtaataggccaggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttctttaaaaattggaatcagtcctctctaaccctgctgctgcttaatcaactaagtgtatgtggccttctaaatcctttgttgtcattatgacagtgtccacagcatcttcaccaggagtggatttcatctcaagaaactgctttctttgctcatccattcaagtttgatcatgcgattgcagcagttcagtcacatcttcaggctgtaattctagttctcttgtgatttccactgcatctgcagttacttcctccatttaagtcttgagcccctcaaagtcatccatgtgggttggaattaacttctttcaaactccttttgatattttgacctcccatgaatcacaaatgttctaaatgacatctagattggtgaatcctttccagaaggctttcagttcatttttgcgcagatccatgagaggaaccactacctatggcagcgatagcctgacaaaatgtattaaatgatgataacacgtgaaagtcagaatgactccttgatccattggctgcggaatggctgtgttcgcaggcatgaaaacagcatgaatcttgtacatctccatgagagctcttcggtgactaggcatattgtcagcgagcagtagtattttgaaaggaatcttgtgagcagtaagtctcaacattgggctgaaaatattcactaaccatgctgtgaacagatgtgctgccacctgggctttgttgatccatttatagtgcgcaggcaggagttttggaatggtgaatgaacactgacttccacttaaagtcaccagctgcgttagcccctaacgagagtcagcttgtcctttaaagctttgacgctaggcattgccttctcctctctagctatgaaagtcctagatggcatctttttttccaatagaaggctgtttcttctacattgaaaatctgttgtttagtatagccaccttcatcaattatcttagccgtgtcttctggataacttgctgcagcatccacagcagcacttgctgcttcactttgtacttttgtgtgatggagatggcttctttaaacctcgtgaaccaacctctgctaccttcactctttgcttctgcaccttcctcagctctctcaggcttcatagaattggagagagttagggccttgctctggattaggctttggcctaagggaatgttgtggctggtttgatcgtatctccagactactcagatttcctctatatcagcaataaggctgttttgctttcttatcaattgtgtgtttacaggggtagcacttttaatttccctcaagctctttttcctttgcattcacaacttggctgtttggcacaagaggcctatctttgaaccttcccagctttccacatgcctttctcattaaaattaatcatttccagcttttaatttaaagtgagagatgtgtgactgtttctttaacttgaacactcagaagctgttgtagggttattaattagcctaatttcaatattgtgtctggggaacagggaggcctgaggagagagtgggagcagctggttggtggagcagtcagaacacagaccacgttgatggattaagttcattgtctcatatggcacagtttgtggcaccccaaaacaattacaatagtaacatcacaaatcattcatcaccataacagataaaataataatgaaaaagtttgaaatattgcaagaattaccagattgtgacccagaagacacaaaatggacacatcctgttggacaaatagctccaaaagacttgctcagcacagggttgccacaaaccttcagtttgtaaaaaaacacaattacgtgtgaagcttgataaagtgaaatgcagtgaaatgaaggctgccggtattaggttgtttatactgagatctttctgggcagctgatggtttgattttcttttttattctgatgagtgttctgttacctagtagggtaggtcttttctctgtacacttactaaaaaccaaaaaagttcttctcccttatattttaaaataaactttagaatattttttgtgacatctgataacaaaatcccaaagaaatgggtcacgctttatttaaaattccttgattattgaatcttttaatccaagtacttggtgttttttctgcttattctgttcttttgtgttgtttttgagttttatagtcttcattaaatgggctggatttatatttatgtacatgtgtttttaaccttcgtttttattgaggtgggacttctctatggtcaagtgcacctgtctgaggagtttcttaggcaggcctccctgtggccgttgcccagggcagcgtgggagggagtcacccgtgtagcagatagcagcatttgctcagccgttggattttgccgtatgtcttttttgtagtgaaggagatgactatgttctccttcatagttgcccagtattaagatattcccaaataccagtactaagatatttgctagattctttgatacaatattgattcaatctgctgatattttcttttttctttttctttttttttttgagaccgagtctcactcagtcgccaggctctggagtgcagtggcgcgatcttggcttactgcaacatctgcctctgggtccaagcaattctcctgcctcagcctcctgagtagctgggactacaggtgcgcggcaccacgcccagctaattttttgtattttcagtagagatggggtttcaccatgttggccaggatggttttgatctcttgacctcgtgatctgcccgcctcggcctctcaaagttctgggattacaggcgtgagccacctcacctggctcaatctgctaattttttctttaggatcttgcatccgtattcttcaggtttgccttatcagtggattctttgacacaatattgattcaatctgctgatattttctttaggatcttgtttctttattcttcagtaggtttggcttatagttcctgggccccatcaacttttaaaaaattattcttgtcagcgttggtgtcaggagtgtgctaatttaataagggaaggtttctactattttctgtgatttatttcttttgtttttacagacagggtattgctgtgttgcccaggctgatcttgaactcctggcctcaagtgatcctgcctcagcctcctgagtagctgggattacaggcgtgccaccatgcccagcttgtgatttatttcttgagcatttgaaggtgccccgtagctgggagagggaaggctcgctgcagatggcacccccttttggttagtcttggcagggcctccatgagctaacaggagcccctctcttcagtgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggaggtgagcggcgctgcccagggctggtccgggtactagggccctgaaggtctgtgtgaagctgagccccacagtcgctgtgcagatgaagaccttgatgttgggaggaatgtgttccagttttagaggacggggataaaggagactgaggcagcatggtcagagttgtaggagacagccagacagtgtgggcagggagacctgagttcaggtcctgctctgccattaaccttagtgttttctggcaacttctggccttctgtgggcctcagcctcctgatgtcactcctgaaggtaccactgtttccctcttcagtggcggccctgccccatcttgggtttctcgtggctcttaattgcaggcgcttctgtacattcaccctgcttcaccaccttccctagtgccctttcctctagcttctcaggccctcagtcatctgcccccgggacctgggcctcagccttaggcccttttacctcatcagccttctcctttctgttcccctcatcagtggtcccctgtcctggccttgccaaactctgcctgtccccacaaaatggctccagcccttccttcgcagcaagtgatgcttgcccttccctctccctgctcaggacacctgggggagcagagtctgcttgctctctggactgttctctgattgttctgcgggtctaaggttgcagtcccagctagagcttaaactcagtagcagccaggaactatccatgctgctgttgtgtttccgcgttcccttcaggacccaaatgccagtgcggtggtagaagcaatgcctacatgttggcgccgaaactaatgccacaacttttctttgcatagttcccaagaaaaggatttctaacagtacaggaatgtatttcttcatttccttctagtgtcttagcagtatttcatcaaaacagatatcagtatttaaaagaaaaataccagaaaggactgtcataggaagacagatggattacgcacagatatttaaagtgggtgactcaagcccaaagaaaaccttaattcaacttgcagatgtaacagaatgaaatagagttcggtgaggtctcagcccaagtctttctatattgcatttcccagcactgtttctcctccttcttttactcaggctcagggcatctctggttctttacattttcccattgctatttgcttctttggtgatgagttcctggagtgttcctcgactttcctgggcagtcagagcctaggcgcagctggcggaggagccccgagggctggcttgggagctgcttcccctgcatgttcctgggccctggtttggtgctctgggcctctgagctttgttctcagtgacactgggagctcgctgtgaacccgttgcggtcgctgccttgctgggtcggtgggtggggcaggcagttgcagtctgattgtgacatctgccgagagctgagtctggacaggttcctctgccgctcttggccaggggtgtagcccccgtgccaccttagtgattccttcaggccatcatttgtgcagtgttagaggttgggggcctacatagtcacctagtcctggtgaggatgctgaggcctagagaggcccagcctcaagccttcacagatggtaactggggaagagcagcctaggggctcttacccagactcccgggcgagtgcgctgttcatttggcactgcctcccaggcagacccttcccacctttgtagaggaaggcacttcagatggcagtcaggaaatctaagaactagagatcttagttttggtgctgatcattctgcaggtgccttgagtttcctgtctctggaatggggctcgtaatgcctgccctgccatgccccggtcccgcaggggaaaggtgtgagagcatttcagaaggcagagcccaggtggaggcgttattaaccagagggggaccgtgtccatgctgccagggtgaggggggcagtgcagcccgtccctgtcctgcggctgcctctcatgagcccccttgtgttcctcctgcagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggccagtactgtggagctcgcctggctcctgcagccactttatttttcttctctgtattttgcagtttttctgtctttagaattcggctctttagatgactcgcctgttttgctggcctttgtaaagagctgcctcttggctttatcaggtctctttgttttttggcttacctgttcctttatatttacttttatctttttctaatttttagttttttttcccttttgagttgactgcttattcattttttcttaagaatgcaaacttgcaacgttaatttaccttttactatagttttgaccatcctctctaggctttttccttattatttaaatagctctaattgaagttgatttcctctttgttcttagagttatggaagataaggttttaataatgctttttgttgtattatgctcagataatatggaccagatagttttcattttggggattctttgacgtaaaaaaattattattattattatttttgtttagtttttgaggtggggtcttactttgttgcccaggcttgagtgctgtggcgtgatcatagctcactgcagcctcaaactcctgggctcaagtgaccctcctgccttagcctccttagtagctgacactacaggtgtgcaccacaatgctggcttcttcttattttttaatgtcagactacattgttgtgaatgcttgaaacaagtacatgaccatgggtgttttgtttacatattatactttgttaggttagcactctctctctcttttttttttttacatttttgtcattggatctgccagaaatttaaagaattctgttagtctctgatcacatttttgattttgccattttttccccttgtactttgaataggttttgctttgaaaattttgatgctaattgaactcataaaagttcctgcttacatattatgctctatcaaaacaagagtactattagttttatttaaggcccatttacatggcattatgtaatatttagttttaaccctagggagtttcagtagttctgtttgtgcttgtgtagaaccatttgtctaggagtttttgctttttaatacagtgaacattattgctatagctgatgttggggtctgtttctgttatctttctgttttgtaactgtttccatttgatatcttttcttcttatatgttgtttttttctttcctcttccattatactaggtttacagtcttattttattttattttttttgagacagagtcttgcagtgttgcccaggctggagtgcagtggcgcgatcttggctcactgcaacctccgcctcctgggttcaagcagttctccttccttagcctcctgagtagctgggactacaggtgcccaccaccatggccagctaatttttgtatttttggtagagatggggtttcaccatgtcagccaggatggtctcgatcttctgacctcgtgatccgcccgcctcggcctcccaaagtgctggtattacaggcgtgagccacagtgcctggcctacagtcttattttaatcatactaacggttgcctttttttttttctttttcaaccagattgtttttatttttcatgtttctagtgacttctttccagcaaagatgcttttttccctcttttactctggagaccaaattgctctgcatttggacagggtgcagtttaggtagctggttctcagggaaatttttctgtattgaaaaggattaggtaagggttctgttgttataggctgcagccagggtggctctgatgagcagggacctgggattccctttacccagcacagaatatggtctttaaattaggtactgagaatatgtttttcctgttgaagggttttataaattaaatagctacacaattggcttttgggaggctaaagaaatgagagtggtaaggttgttatgttagagggtgataaagctgcaaggctttttccctctttttaaggatttctaacctgattatctaagctacttcagtcccttgtctttgcaccttggagaatgtaagctattaatttggaaatgcttttgagtaggatcaatcagtgaaattccatgttggttccagaaagccctttgggtatttcagtcaattcatgatgcacaactgctttgagttacctgcaggctgcccgagaagtacatatacagatgcccttcattttttttttttttttttgagacggagtctcaccctgtcgtccaggctggagtgcagtggcgctatctcggttcactgcaatctccgcctccagggttcacaccattctcctgcctcagcctcccaagtagctgggactacaggcacccaccaccatgcccggctattttttttgtatttttagttgagacagggtttcaccatgttagccaggatggtcttgatctcctgaccttgtgatccgcccgcctcggcctcccaaagtgctgggattacgggcgtgagccaccgcgcccggccacagatgcccttcttgcgaaaacgttactaagacatcttactccctcactggagcacgggacattactttcacaaggtggtaccaagaacatatattattctattaaaaagttttctatattctaaattctaagataattgacacttggatagtagagtgatacggttaagttactgaacagtgatgttttctggaaataacttagcttctgccttccctgtgccagttcccccttagggctctcatctttcactgttgcaattttctgtccctctgtaagtcacctccattttgttatttgtaaattcacttgatatgtattgcccatattttagaaaaaaggtacagagtggtatttctgtatgtgcaaaagttatattgatttattgagttctcccagtgcttccttgccagtgatattaaaagcaatagaggaatttggaaaatattcaggattaaaattaactggatctcatccagtatatttttatgagtggatgaagggctatctttcccacagctcagctaataccagattgtcatattgcccaaaattacaaacgttttggaagattttccctaagaataagcagaaaaaaaccatcactgcttgagatctagttttcctttgcttaattggttgggtgtatgaaatgaaatatcaatttcttgttggctctgtgtgttttagaatacttcccctgtcactcctagaatgtctttgagagtgggtggtgtttgtgtttgtagtggaagcttcattgtcatgtgagtgtgttggttggagagtgggtggtgtttgtgtttgtagtggaagcctcgttgtcatgtgagcgtgttggtccgtgtgctggtcctcaggcctgtgcttcctgaaagcagcagttttggttccaggggagcgtttctctggacactcaggatggtgctgaggagacggttagaaagcgtggctgctggccttacctgttggcgagcgctgtgattgcggcatggaaggtgacgcagttctgtcctccctgcaccctgcgtgttctggtcccgtcatcgctgctccccacatattgtcctttcctattacaaatgaaatactttggtggtgacgaatcttgtgagacattgtgggactgtgtgggctgatgaaagctcaagaaaacaggtgccaactctaatgttgactcagattagagtcatgtcatgcgttttgggcaggaatcgcaaagggaggttgtgttcgcattcccctcttatcaggctgcgtgtgatcgcagtgtgtccattactgccgatactcacttccgttatttgattaaggtggtgcctgccatgtttcgctcccgtaaagctattccttttctctctgtaagtagtattttgaggagaggtgctttacaaccatgtatatgtcctgttcatctcagatttttaatttgttcatttattaatttgttagtatagactcatggtttctgatattatccaatgagttataattcattattattgttacttattttgatattcgtattgtctcagtttgtctactgagagctgcttcaagccatctctgtccttttaacatgaccttagtcattctgtgagcagctcctcactttctcctgtaacaagatattctcggctcatcttgcactttgactgcctcagtcctggaataagtcatttctcctaggagtcctggtttcttttagtgaagaatggtgtgcagaaccctatatttggacactaggagtgcctattgcttttggggtatcactgttttcatgccctcctattggaccaagctaaggttgtatgtacattccacatttctgtttatatttctttatatacatggacaggagttcacctggctacctttaatccaggctcatgccacaaggttcatcctagttttctgcctttcgcgtttactattctcctttcaccagtgagaaacccagttcccctgccctccacatactgcctgtgttgtcctgttgtcccctgtgtggcaccagccagccccccttttgctgcctcttcccatacatggctcctgacctgtttgggctctcacctctcatgccaggtggccttctcaccttgtcaggactctgactctgagccagggccccctcattgactgatccctgttcagagtgaaaatgattggtagtttgcacttgccctggaagaaccctaaacgtctgatagagagccgtatatttggtcatctctgagtacagtgacaaggacaagtaaagtaaatggagtcatttagagattggctttggtggagaatgaggcttctaagtcaggtggctcctacacctgccctatgtgagatttgtttcctcccatcgggctgtcactggggattaggaggggcggcctaggggttacctcactcatggctgtgtacatgcccacgtggagagctgtgtgacgctgccctgccgacaagctgtgcgtcctggcctggggccttccaggtgaacgtgacgctgggagtggtctgtgctaatcatgggagtctggatgtttagtgtgcctgaaaagaaagatgtcctagtgggcagcgcatcatggcgccagctggatacctgattgagttcatgcgtttctttttgctttcaatttttttttttttttttgagatggagtctcgctctgttgcccaggctagagaagtggcatgatctcagcttactgcaacctctgccccctgggttcaagcaattctcctgcttcagtctcctgagtagctgagattacaggtgcccgccaccacacttagttaatttttgtatttttagtagagacggggttttgccacgttggtcaggctggtctcgaactcctggcctcaagtgatctgcctgccttggcctcctgaagcgctgggattacaggcatgagccaccgcgcttggccaaggtataaatttttggaaatctagcttgtatccttgtctccttgatcctgttctctccctccccagtagataaccatttaaaaagttccatggtttaccataagcacactgcaacctcctcccccacagaaacagtagtggactgtacactttcactgtgctgctttccctccctcttcctgtgctcggaggctgctccggagcagtgtacagcgaccccctcactccttttcagagctgcacagcgtggcgttgtgcagatgagctgcagttcattcagccagtcccgttagtggacacgtgggtggtttactgtctccagctgttagggatggtgctttaatgaattgccttgtgcatacatctttccatagttttgcagatgtattttggaaatagatcccgagcagtgtgattgatgggtcaaagggtaaatgcatatgtaattttgctagcgattgacagattgcccactccacagggggaaagttcacttttcattgctcaaacaatgaatgagatttcctgtttcctaaaagcctggtcaataaatttttggatttttcccaatctgataggtgagaagtgatatctcagaatagttttaatttgcatttctgttccgagtgaggctgagtgtgttttcatgtggctaagagccatttgtagctgtccatctctctaaattttttttttttttttttgagatgaagtctcgctctgttgcccaggctggagtgcagtaccatctcagctcactgcaacctccgcctcccgggttgaagcaattctgcctcagcctcccgagtagctgggatgacaggcacacccacacccggctaatttttgtgtttttagtagagatggggtttcgtcatgttggccaggctggtcttgaactcctgacctcagatgatccacctgccttggcctcctaaagtgctgggattacaggcatgagccaccacgccccgccccatctctctaatttttctgtagggctattgatctttttcttctagaagctctttatacgttaagggtattaaccctttgtaaccttttcccccaatttttcattgcttgttttacttttacttacgttgttttgtcatgcttatgctatgcaagagtttttcttttaaaaattttcatgttaaaaacattttatttgtggattttgtgtcagaattaggcaaattttacttagaggtttttttctagtttttgcatggtttcatattttacgttttaagttatggtcagtttggaatttattccagtatatgctatggtgaatggatatacttttacctttttccatatggatgtccagttaccccaaaaaacacttagtaaaacatctacaccctcccttgtttgagatactgcctttatcatatatgaaatttctatgtgcaatttggcccatttcaagattttctgtaaagttccatcattctgtcaattttgttcacataccagtgccacagttttatttttagcctttataataaacttcacttatggtgtggctacctcccaccacccccttcttgcttgtctttttcatattctttcatcttacagatgaactttatatatcaactaatgtagctccggggatgctatttttatttatttatgtttgtaatcaacttatttagttctagtaatgacattttcatttataaaataaatttagggagaattatcttcttgatgttgagtcttaatcagtactgtgctatgtctttccattctcttaggtctacttttgttgactttaagtagtagtttatcatttttgttatgcaaattttggacatttattattaagtttatgcttagatatgtcatagtaaaatttattttgctatcataaatggaattttcccttctactttttatatgaagcctattggtttgacaacctgctacttcaataagttctctcattgcttgttagttgttttcccatattatttagggcttttcagacacattgtatcctctgaaaataggaaatttttacctcttattttccaactttatgcatttaatttcttcctcttgcctgattgcacagggtacctttaacaccagtgttcaacaggaggctggaaagcaggagtctgtcttgctccagctttggccggagtgcttctagcctttccctgttaaatgagatgctgacttctggcctgagggagtatgttttatcatgttaaagaaaagccatcactttctgttttcttgagcatttttaaacatgcatagctcttgagttttgtcatatgcccacctttttttttttttctgcatctgcagagataatcagaggatttccccctcagcctcattttacaatggattatattaatagagtttctaatattggagttacctgtgcattcttgggataactcccatgaggtcatggtatattgctttcttaatatacttaaggattctctttggctaaaattttattgaagatttaaaagttggtattcctaaatgaaattagctggtagtttttcttatgctttggcccttgttgggctttggggttattgtgccagtttcatcagatgaatttgtaagtttctcttctttttctttgctctgaaatagtttaaatagccttgggattattggacctttaatggtttgaaggacttcccttaggaatttttctgtgtgcggggattccaagttctttcctgctaccttatcttgctgaacgtagtgaagctatctgatctgtggagtctcctacagcgcctggtgtcactgaatcaaggccttctgctcagggtggctgtgggatttgttggatctgtgggatctgtgggctgtggtcagtcccctgcacagtctgactttccctttcttccctgcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtaagtggcttgagttcagctctgacttgtgggctgggttgattgaatgaatcaagatgtagcaataaacaaaaaacaaaaacctccacctgagcacttggccaaaatcttcagttagaactcgcagttttccagatggttgttcagattgatcttctctttttaaattcctgaataccaagaactgatatcagggaatctctaaaagtacatgtgtgttgtcagaactcctagaattatgctcgcgctctcttttttttttttttttttttgaggcagggtctggttctgtcacccagactggagtacagtggtgcagtcatggctccctgtagccatgacctcctgggctcatgcaatcctcccacctcagcctcccaagtagctgggactgtaggtgcacaccatgcccagctaatttttgggttttttgtagagatgaggttttgctgtgttgcccaggcttgtgttgaactcctgggctcaagtgatctgcccgcctcagcctcccaaagtgctgggattacaggcacgagccactgctttggcctagagttatattctctttatccttttgctctgacctgtggccccagattcttatagacagtgacttcttttatgcctggtttttaaatgagcccttaaaacaaattgcaagcggggctttctagggttccttactctcctttcttcaattccactcaagtatcgctactttggattgtgtgataagcctaaattttgtaacaataaagttcctggtctgcttatttatgaagaaagattttgttaacgattaatgcatcaatagcaccagagattggaattgatccatagcttggtcttgttatccgaggctctctgggattcagacattgacctcatgtgttgtctttaacctcctgcccacatgtcaccccctcccaccgctcccagtctgggtcttgagacatccaagttgataacctcttccttctccctgcctctcaaaggactttaaattcattgtgtttttgttactggatttccctaaaccagttcattaaagcatgctcctgtgtagccttcccacaaatagttaatgaatggtcagctgggagctgtactgatagaagcagcagcttgcgttcaggactgttccactcctcagcttcctcgctaatcgagacagaacttggctgcgctcttttcattgggggcaaagtcgtcagcctgtgcccctcaagcagtgctcagcctgtgttccccaggcactggtggagcttcagggattgactaagggaaggggctgacagaggctgggcgtccgcggcccgcacctgctggggccttcagtggtccactctgatttctttctctagtgcattaaacatggtcgagttgtgatccagggagcagatgccctgggttaacgaggctggaaaggtttcgctctttcctgcgacagaaggagcagataagaagaccttcctccctggggcctgctctcctcatccatcaggaaaagccatcactttgtgtttcactgagcgttttgaagttggtagtgagcattggtgcacttctggctggcagtcccagctgccttttctctctataactggaatagaatgaaccttcctctatccctctctttcttcccacggccttcaggtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatacggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgaggctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaatgcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggttttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcaggagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 379 - DNA, 24248 bp, Homo sapiens
gagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcaggtgaggcgtggtggcccggcccaacgggagggggtcgctcccgcggaccgtgttaaggtcggctcgagaggcgcgggagaggaaggggttatatgccgggcgcggaggagagagggatgcctgcgcgccccccatccttgcaggttgtgattgatgggcgctgggcctggggctgggtggcgatgctgcggagcggggagggggcgggtgggctgcctgtcaccctcgcctccttatctcccccgcgtcaaggttcctgccgcttgggcaccagcttcagtgggctgagcgtgggggtgctggtggagggggatctgggccttgagaaggggaggttgaaagaggctagaaagcgagccaggcaaggggggcgacgcagagcacgctcgggggcgccaggcgggtgtgggtggggcgggggtggcacgaggaggtggccgaggcgatggtcagagggcggtgccaaatgccaacaggccttcaaagccgcagacactggttctcgagggtggggaaagagccaaccccggtcgaggtcccctcccagccacctgggctccatctctatgtcggacctgctcccctccccccacacccacgttgacttaccccacccccacccccgccccaaaaacgcctccaaagtttggaaagttggatggatgccaactcataggagggggggaagctgttttacctgggggaggggtctacttctccatccccacccgcacacttttcctacacccctggttactcccaggaagtggcattcttgggcgcggtgggttctcatggggtgaccagcaggctctgggatggtcgcgccaggggatttctttgggagtgtccttctccaaggatagcattaactcttctgttactgtggccaccagctgtaaccaccatgataatgtgactgatgggtatgtagaggggtcaagtcagacctaaaaataccttcctccaccccaggcccctttgagcctgggaggcagctgactggggccttcctttcagctgtcccctgtccctctgagtgccactccctttgcccagcctggcagtggtgggggagggtggtgtctgggattcactgggtgatcctcctaggtttgtagggagcatcacaacttgagttggggtatatgtctggtttgagagaagggcggggaggggaggatcttggaaaggtccccaggggccctcctctcccattttccatcctctttcttgtaccctgatcccagcagccaaagcccccagtctggtcatggcccctccaggttctttggccaaagaaagtctaggatggagaccaagggcggggacttggaagtctgagccctcactcactctccccattctgaactgggctgaggccaagtgtgtgtgggtacaagctggggagggccagaagcagctcttcttacaagaggactggaaatacctgacgcccttaacctgaacgtgtggcttcctgaatggtcaggcggtatttcctccacccggtctctgagactgagccagcttaccccctagagatctgtggggctgtgtcctaggctcatgtggtgcggggccgagggacatttagattgacgtagcctgatgggtaccatgggcatggggcatgggcagtggcagctgggggccacagggtagaagcttgatccctcttgcccccttggggaggattgtagctactgtgattgtgagagagggagctgagaaaaagtcctgtctgggcaagggatgagagtggggagcaaaatttgcccccatggtgccagggatcaggctggatgtttactctccaaatacagttccatgcccctactccctccccagaaatctggctctgagtctccaagagagctgtcatcccctccctactctgtgaatagcgaagggaagagttgggcacaggggagaagccaggctgggccctgggttggcagttcctcctctctgggggccaccaacacaaacagccctgctctgctcctgcggagggggagtgggggtgactttcccgctctccccacccaacacccagcactgccggctgcctctcccttcctcggaggcctctgcagcctgcccagcatcttaattagctctgctgcctaatgagcctccagcttctccgcgcctccccccttcccagcctctctggcttggtttggtggtttccgtgtgggtcttctggggctctcttgcactggtccccactcctggctgtgctctgggccctctccgtgaggatgggagaccctccctccccttgggtcgtaccacctcaggaggaatgtgcaggggggtggaggtggggctgggagtgctgttcccaagcttggctgtagctctggggctggcaagatgagggttgggaaagggcccttctgattctactcttgttcctttcctggcctcttcagggcaaatacagcaagaggaaagggcgattcaaacggtcagatgggagcacgtcctcggataccacatccaacagctttgtccgccaggtaatggggaggctgggcggagaggagggaggtggctggttggtggagaccagcattggtgagccaggtctgcggtattgtccaggcacccttccctgtgccatttgtcacctgcctggagccaccccatcaccctgacaccccatgacctcttctggatgtgctgtcagcggcacccactcgctcagcccccgcccctgcccggcccctcccccagcaccaggcaccctcccctgctgcctgctggcctgcgtcatctcattcagggacagcctggcctgcctccctccagcttgcttcgggctgtcacccactccccctgccggctgtctgcttccatgtcctcccccagaatctgtgacagggttgggtggaggcaggtcctaggaaaagcagagcaaggatgtttgggtccctgtagtcctggtgaggtcctggccagggaaacacgctcctcacctcgagacatgactgtctaagaagcacagagaaagggtgatggtgacgggggtgggggtggttgaggcatgaggctgttgattttataatagagaagatgatagcccagcacccctgcctgaaagggtgtaactgagaatagctttctggggtcttctgtgctcagtcagtaagcggctgctctcatctgtcaaccctgggccatcttaggctcagggtgagggactgagagaggcatgtggttgctatgactacttagcatctcaccaaagcctggtacccaaaaaaggcgagaggggcttgggattagacaaggaaaaggcgtgtattgaagaggaaatgggcagggcatttgagggcagaagacagcacagaggaggggtcctctggagatgagcccctcccttccaccttgggccaggagcgagggtgatgccaggcagatccaccactaattagagtgaggcccttctttccgtttcttctgtctctacagcacttggcacatgtgagcctcagtctgacttgggaggttcaggaaggggaggcttcattctagccttttctaagtataggaacagacaggaagtcctttcttcaatcaccccctcatccctcctgttgcaggacatggccagggctgggaagaatgacgctgtgcttttattgcccctcttggcagaaaaggaccttggctccttcagtgtttgccaacccagggagtcagaccccagcctccaattcttcctccttttagctccccagctctgatccccggtaggtggtggggagtggtggaggggggcagtccttgccacatctctgagctaaatataccctagcagtctgcacatgtagcaactctgcttgtaacccgagcccccaagggaacgggcagtttgggccaccccctaggccagcagggccaggcactgagggtgccgggatggaggcgcccagccggaccgtggtggtggtgagctggggatggagtggggtggcagcgggtagaacagcctctcaggaaagctgacggagggcagcctttactccagcgtgtctccatgcctcctcactgtttcctgtcttctgccatttctgatgtgtgcgtgtgtatgcgcgtacatgtgtctgcatatgtgtgtgtatgtgtgcgcatgcctacatgtgtgtctgtgtgcacctgtgtgtctgcatatgtgtgtgtgtctgcccgcacatgtgcgtctgcatgtgtgtctgtgtgtgtgcatgtaactgtgtgtgtatgtgtacacgtgcgcgtgcctgcatgtgtgttggggtcagtgagtgtgtgcgcgcgtatgcctgcatttgtgttggggttggtgagtgtgtgtgtgcacgcgcatgcccgcgtgtgtgttggggtcggtgagtgcctctctgctagtctgtctccctgtctgtttccctggctctttgactctgcgtgctcccatcaggggggagagggggagctacgctggttttctctccttctctccttcatgcctctttccccacttctgttagtgacccccgctccaccccaacccttcctccgcgggtctcccattttcattatttgtctgggaaagagatgggcagctgcaccagctaatgacctgaggcccctggggagaggtgggactttgtttctgtctttcccaggtcccctccatgccaaacttatggaccttcctggccaagtgacccttttctgccctcaggaaagaacccctacatccctgcagtcctcctcttttgccacataacctcctatgccttgtccaacaccacccctgcatagtcacacaaatccacacctcttgcctcctgccctcacatgtcccccaacctcagggtcacagatgtctgggagctcccccccagtacactcacatgtggctgtacacacacagtcatatgcagccaactatagagcacaccctcctccacacacttgtacttgcacatccacacacacacatgaagaagcacgtgcattcccactaccaggtctgtacgggcaacatgtgtcttacacatatgtgtgcatccctaaaggagtcccttgtgctctgggttggtcattgtggtcaaagccagctgtctggcacccagcagccctcatttcagggaaagccctgtcccatatcctgctcttaacttgcctcttcggtctgtaccagcctggaactcttgggttctcttgtgtcctaggagagcctgaggactggggctgtaagtagtgaagtttgattctggcagtaccagttaagaggagcaggggaggtaggagtctgtctccctctacccttgaacagaagctggcaaaatctgtggtggccccatcctgcggagcaggccgtccacggctgatagtgcagagagctcaggccgaagctggtggctgcagtccctggaatggatgccactggacctcagctgagtctatctcagcgggtgctgggggcaggggagggaaggagcagtgggagtagagactcgtccctggcattcctcccttgccttgtgcccctatcaggttcccacccctccctgggccccaagcagctgtccttgggcctgccttcatctcctgcttgctgctgtcaccctcactagggccacactttccccaggggcctgagaaatctcagctcctggtcccttccacctaataccaccttgtcttagcccttgtggtgtcatgctgggctggctggggctcgaggcatccatgatgggtggcacctccatgccttcccaggcccaggagctgggaggggcagcaatggccctgatctggctctctctattttcagggctcagcggagtcctacaccagccgtccatcagactctgatgtatctctggaggaggaccgggaagccttaaggaaggaagcagagcgccaggcattagcgcagctcgagaaggccaaggtgagaaagatgtggggaggggctgtgctggcatgatttcccccagtcctgggctgtagagagagcccagacagaaccagggccaagtcttgacccagccacttcctagtacccctgaaccttgctcctctgtccttcacctgcacaatgtgggctataatacctgcctgcttatacagtataataagtataataagtgcgtgttattatactgtttccacacataataagggcttgataagtgctaaaaatttcttttttttgttttttgagttgcagtcttgctctgtcacccaggctggagtgcagtggcatgatctcggctcactgcaagctccgcctcccgggttcacgccattctcctgcctcagcctcccaagtagccgggactataggctctggctgccacgcccggctaattttttgtatttttagtagagacggggtttcaccatgttagccaggatggtctcgatctcctgaccttgtgatccgcccccctcagcctcccaaagtgctgggattacaggcgtgagccaccgtgcctgacctggtcctgactcttaatagctgtgtgatcttaggaaagtcacattaaaaggaagataataataccacttaacttcagaggattttttatttttgtgatgaatataaatgagagaatatgtgttaagtgtgtaacatggtacctggaacactaaatggtcattactgtcattattgttttttttaatttaattttaggccaggtgctgtggctcacgcctgtaatcccagcactttgggaggcccggttgggcggatcacttgaggtcaggagttcgagaccagcttgggcaatgtggtgaaaccccgtctctactaaaaatacaaaacgtagctgggtgtggtggtgtacgcctgtaatcccaattactcgggaggctgaggcaccagaatcgcttgaactaaggaggcggaggctggagtgagctgagatcgcaccactgcactccggcctgggtgacagagcgagactctgtctcaaaaaacataataataaataaatttaaatatttattattttttatgagacagggtctctctctgtcactcaggctgagtgtagcggcgtgatcacagctcactggagccttgacctcccatctcagcctcccgagtacctggaactatagaggcataccaccacacctggctgattttttattttttgtagagatgggatcttgctatgttgcccaggctggtcttgaactcctgggtgcaagtgatcctcctgcctcggcctcccaaagtgctaggattacaggcatgggccactgtgcccagccccttttatttatttatttatttttgagatggagtcttgcactgccgcccaggctggggtacagtggtgcgatctcggctcactgcagcctccgccttccaggttcaagcgattctccttgcctcagcctcccaagtagctgggattataggcgcccgccaccatgcccggctaatttttttttgtatttttagtagagatggggtttcaccatgttggccaggctggtctcagaactcctgacctggtgatctgcctgcctcggcctcccaaagtgctaggattacaggcgtaagccactgtgcccagctgccccttttattttttaaaaaccgacagggctggctgggtgcggtggctcacgcctgtaatcccggcactttgggaggctgaggtgggtggatcacctgaggtcgggcatttgagaccagcctgaccaacatggtgaaaccccatctctactaaaaatacaaaactagccaggtgtgatggcgcatgcctgtaatcccagctacttgggaggctgaggcaggagaattgcttgaaccaaggaggcagaggttgcagtgagccaagattgcgccattgcactccaccatgggcaacaagagcgaaactccatctcaaaacaaaacaaaacaaaacagacaggatctccctatattgctcaggctggtctcagactccttccctcaagccagtattgggattacaggtgtgagccactgtgcctggctgctattattattattattattattttattttattttattttgagacggagtcttgctccatcacccaagctggagtgcaatggcacgatcttggcttgctgcaacctctgcctcctagattcaagtgattctcctgcctcagcctcctgagtagctgggattacaggtgcgtgccaccacgcccagctaatttttatatttttagtagagacggggtttcaccatgttagccaggctggtctcgaactcctgacttcatgatccacccaccttagcctttcaaagtgctgggattacaggcatgagccattgcgcccggcctataactattatttaattaatttattttgttttgtttttgagacggagtttcgctcttgttgcccgggctggagtgcagtggcaccatctcagctcactgcaacctccacctcccagattcaagtgtttctcctgcctcagcctcccaagtagccaagattacaggcatgtgccaccacaccatgctaattttgtatttttagtagagacagagtttcaccatgttagtcatggctggtctcgaacttttgacctcaagtgatccacctgccttgccctcccaaagtgctgggattacagcagtgagccaccgtgcccggcctgctattattattattttttctgggtatcattgtgggcttccccacccccaacccttttcattcctgagtgccccgcctctaccctgagagggctgaattccacattttgctttcttgttttttattgtaaaagttaatatacatggagaaaaccacacaagccaattcagtatacattttttttttttgacggagtctcactctgtcatccatgctggagtatagtggcatgatctcggctcactgcaactctgctgccctggttgaagtaattctcctgcctcagccttccaagtaactgggattacaggcatctgccactgcgcccagctaatttttgtatttttagtagcgacagggtttcaccatcttggctaggctggtcttgaactcctgacctcatgaatccacctgcctctgcctcccaaaatgctgggattacaggcgtgagccaccacgcccagacttttttttttttagacagagtcttgctccgtcatccaggctggagtgcagtggtgccatcttggctcactgcaacttctgcctcctgaattcaaatgattctcatgcctcagccccctgagtagctgggattacaggtgtgtgccaccatgcccagctaatttttttgtatttttagtagaggcagagtttcaccatgttggccaggctggtctcaaacgatccacctgccttggcctcccaaagtgtcagtatacattttgttgttgttgttgttgttttgaaatggagtcttgccctgttgcccaggcttgagtgcagtgacacaatcttggctcactgcaacctccaccttccaggttcaagcaactctcctgcctcagcctcctgagtagctgggattataggcacccaccaccacgcctggctaattttgtatttttagtagagacggggtttcaccatgttgttcaggctggtctcggactcctgacctcagatgatccacgtaccttggcctcccaacgtgctggaaatacaggtgtgagccaccacaccctgcccatgtccatacacatttcaaggaactattataaagtaaacatccaagtaaccaccactactgtcaggaagttgtacattacattgtggtttgccctctagttgccatcctcccctgtgtgcctcctctagaccaagccagtggcatttgctgtgcggacaaatgttggctacaatccgtctccaggggatgaggtgcctgtgcagggagtggccatcaccttcgagcccaaagacttcctgcacatcaaggaggtgggtatctggagggagggcagggaagtgggtgccaggagacaggcagccagagtgctagtggacaaaaggcttctgagccaagcagagccaggctgaatctgctgtgtgaccttagacaaatctctccacctctctgagcctcttaattttctactggaaaaatgaggtggtaatgcttaggtcagaaggttgttgggagggtttgttagggggcctgaactggcatggcggtgtgccagggacatgtaggtatccgcatttactccagcggcctttgtagagtagggtgggcacatggggagaaggactctcagaattgcattgggccggtggcagggtggtccatggccagaaagcatgctggtcctggagttgtcctgagaattggcagctccactcagaggctggagccagggctggggatttttgagggtgccacccctgggctgggaggtgagtctgggcgtttcccctagagagtgactgctagcttgcccctgcagtttccctcttgctctttccacccacctgccatattctttgcagaaatacaataatgactggtggatcgggcggctggtgaaggagggctgtgaggttggcttcattcccagccccgtcaaactggacagccttcgcctgctgcaggaacagaagctgcgccagaaccgcctcggctccaggtgtctgggtggggcaggggaaggggatgctgccaaccccaggagaggccatacagcctggactaggcctcaatggttgtccctggccctgagggcacagagctgcctgtggcatcaccagtggggctggagcacctccgggggtgccgcatgtgagaggatgagagccccccacgcccacctctttgctcacaagctcggtttgcctctgcccacacagcaaatcaggcgataactccagttccagtctgggagatgtggtgactggcacccgccgccccacaccccctgccagtggtaagagccatcgccatgcaggggtttgggaagaagctcctgggtggggtggtctccccactccctgaatcctcctttccctgcagtaggaaacaccccaatcctgagtcccccaagcacatgcagtggttccccctccatgaagagtaggctacccctcaagctgggcctgtcatgtctctcctctcccttttctttggtagctccatctctctgcctgattcccctgccctgcccccattcatttctcccagccctgttccattcacctcttcttctttcttttttccccatccccatccctgcgttctgtacttgtgtctccacgttcatctcactccttctccccacctcgcctccctcctccctctctcctgactctccggtccaggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaaggtaattctcgctgtgttcttgcaagaggtgggggagtcagggccagcactttggtggagggaagggggctgtaatggattcagatgtggtaccaacctgttctgtgggcatcagggcttcctgctgaggtggagggaagggtagcatgggcacatccccctccacacacaactccaccctggcccgatctccaggaaggagatcttgcccttggaaggttgcccccacacctggggcagcagggtttggtggtcatgaaccctgacctctcccctcactcccaggggcctgctctggtgttggtgtctaccttggcatgtgaagcaggacatgggatggcattccttctttgcccttttttgactctctgggtgggcacatagtgggggggggctgctggctgcaaagcaagacagttaagggaacccctaaaatgggcatgttggcatgcactgggggcaggagatgggcaacaagataggggctgtcaccctctccagctcttttccaagacccagaagagggtaggatatgtctgaatattcccacatccactggactgactgtcagtcctgctcccagccctgatccagggccacctctggctcccccttggcgtggggtcccgttccccgtctctggctctgtctgtcactaacacgcatgccctgttatctctcctcgtctgcccggctctccctccctctcttgtcctggctcctgccttgccctctgcccctgcctgggtccccttccctctctcctcccccttccctctcttggcaatctctggacccagccaaacagaagcagaagtcggtgagtatcacagctttctgtgtcctcctccccactccctgggatgagctagggggaccttctaacacccattcccacatctgtcccccatttcccccacccttcctggttctccctggccatccctccccacccccaccctgatccctacatctgggctctgggaccagggtgggggaaggctgcatgggggagcctggagtctgggggagaggatctaatgtcatctccactctggggtttcccctccctgcttccccccccagacagagcatgtgcccccctatgacgtggtgccttccatgaggcccatcatcctggtgggaccgtcgctcaagggctacgaggtaggacttcctagaggggagtggatgcagaggggccttagaaagatcttcagaccccagagagatcccctagaagggcccgatcccaaggcatcctcccaggagggctacagactttcagagacaacccccagggggcccaatccacagaaagacccactcagaggagccccgtcccccaaagaaaccctcagaagagccctcccagagatgccacttacagggaccttggaaccagagaccccagtggaggcccctcagactcagacccccgcccgccgtaaaggcctgtccagaagaaagtggaacgtgagggtacaaatacccagcgactcagagtctgagcggctttaaatgcctgccttctcctccctccctccccacaaacccccacccccaggttacagacatgatgcagaaagctttatttgacttcttgaagcatcggtttgatggcaggtaagatcctgggagctgctcctcgcacctgccgttgctctctgctgctggggatgggcaggatgcctcgaatcacaatcctgggactcggactgaggaacagaaggcgggcctggaactggggagtgggcagggcattccagcccaccctgacccctgactcccctcttgccccattccccaggatctccatcactcgtgtgacggcagatatttccctggctaagcgctcagttctcaacaaccccagcaaacacatcatcattgagcgctccaacacacgctccagcctgggtgagcctactcctgctgtcttcactccccctttctgggccggatgtgggaggggtgggaggtgtgggaggtagtgggcagggccatctccagaagtgttccctccacctgctgttcctgggaggccacctgacattcccccatccacatgactccatgcccccagctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtgggtgcaggagcctgaccctggccaggacagcgtggtttgaaagggctgcttgggtttaaatcccagctccactgcttactaattacgtgaattaatctgcctgagtcttagtttccttctctgtaaagctccatcgtattgtcaagtgtttcaacctcatatgaatgtatagcacttagcaaatggtctgatacaacatgttagctattatttactattattagggtcatgcagaccagtcccctgtctccactctgattgacttcccacccttggactgaaagaattctgtgctttttgttccagtgccacccagctacttggcagttgggaggtctttcctttcttcttcttcttcttcttcttcttcttttttttaagtcaggatctcgctctgtcacccaggctggaatgcagtgatgcaatcatagttcactgcagcctctacctcctgggctaaagcaatccacccacctcggcctcccacgtagctgggactacaggtgtccaccaccatgcctggctaatatttttattttttagagatgggattagctgtgttgcccaggctgctttcctctcttgatatcagccctttttgctgcagtgtcctcatttggactttgatagaggggaaatcggtaggaaggccgccttactttttccttgtattgcagcaccattaactttcccttctagatgccagtggggatctgagaaacacggaggaagagttgaggtggaggatttgaagttagaagacagcatgggcttgaaattcaagctctgattggtttacgtattgatttattcttattgttggttgttttttattgaacttggaatcttgggggaattatttagcctctgattctctatttcttcacctataaagtggggttgtaatccctctcgtgttattgttgagaggattgctgtaaggagcccagtatactctctgatttatttatttatttatttatttatttatttatttatttatttattttagacagagtcttgctctgtcaccaggctggagtgcagtggcgcgatcttagctcactgcaacctccacctcccaggttcaagcgattctcctgcctcagcctcctgagtggctgggactacaggagtgtaccaccacggcccggctaattttttgtattttttagtagagacagggtttcaccatgttggccaggatggtctcgatctcctgacctcgtgatctgcccacctcggcctcccaaagtgctgggattacaggagtgagctaccgcacccagcctactctctgatttatgagggcagccaatagtggtaaccattatcatcccatgagctgggctccctggaccagttacttaaccttttttttttttgagacagccttgccctgtcacccaggctggagtgcagtggtgcgatctcactcactacagcctccgcctcccaggttcaagtggttcttgtgcctcagtctcccgagtagctggggttaggattacgggcacacaccacacctggctttttttttttttctttttgagaaggagtctcactctgtcacccaggctggagtgtagtggtgcgatcttgctcactgcaacctccgcctcctgggttccagtgattcctctgcctcatcctcctgagtagctgggactacaggtgcatgccaccacacctggctaatttttatatttttagtagagacgggattttaccatgttggtcaggttggtcttgaactcctgacctcgtgatccaccggcctcggcctcccaaagttctaggattacaggtgtgagccactgtgcccggccacacctggctaatttttgtatttttagtagaaacaggttttcaccatgttggccaggctggtctcaaactcctgacctcaagtgatttctcctgcctcagcctccctaagtgctgggattacaggcgtgagccaccgcgcccagcctacttaacctttctgagtcctctgtttctaatgagataaaggggatgatgggatttaagtacttcctgaggggagttgaaaggaccaaatgagataatggatgcaaaaacactgaactagaaagtaaccaatgcttccatttcccccactgaggttaagaggagggactctggaaccaggcagcctggaccttctactccagggctgtcacttactggctctgtgttcctttggcaagcggccaaacatctctatgccttggtttcctcatctgcagcataggcatactgggtttgtgaagattaaataaatgggttaaccatgaaaaatgcttggtattgggccaggcacggtggctcacacctgtaatctcagcaccttgggagcccgaggccggcggattgcctgagctaaagagttcaagaccagcctgggcaacatgatgaaaccctgcctctactaaaattcaaaaaattagctgcgcatggtggtgggcacctgtaattccagctactcaggaggctgaggcacaagaattgcttgaacccaggaggcggaggttgcagtgagccgagattgcatcactgcactccagcctgggtgacagagcaagactctgtctcaaaaataaataaataaataaataaaaataaacgcttggtatcccagaactatatctgttccattttgtaagaagattttcattttcaaataatttcagatttacagaagtgtggcaagaatagtatcaaaaaaatcttattttttgaatattcttcaccaggattcactaactttttaacattttattgaggtagaattcccataccattaagttcagccatttaaagtctataagccaggcttggtggctcacacctgtaatcccagcactttgggaggctgaggcaggtggatcacttgagctcaggagttggagaccagactgggcaacatggcaagaccctgtctctattaaaaaataaaaaataaattaagtgtacagtctaatttttttcagattcacaaattttgaaacatttacttttatctttctttctctctttttttttttgaggggggacgaagtctcgctctgtcacccaggctggagtgcagtggtacaatattggctcactgcaatctctgcctcccaggttcaagtgattctcctgcctcagcctcccaagtagctggtattacaggcgcccaccaccacacctggctaatttttatatttttagtagagacagagtttcaccatgttggccaggctggtctcgaactcccgacctcaaaagatccacctgtctcagcctcccaaagtgctgggattataggcgtgagccaccatgcctggcctatattgtgtttcttaagaacaacatcattatcttacacaaccatgatgcaattgtaaaattcaagaattatttctaaaatatagtccatatttggttttttttttttttgagctagggtctcactctggctgcccaggctggagtgcagtgatgcgatcttggctgactgcagcctctgcctccctagttcaagcagttctgcctcagcctcctgagtatctgggattacaggcgcctgccaccatacccagttaatttttgtattttcagtagagacggggttttgccatgttggcctggctggtctcgaactcctgacctcaggtgatccaccaccacccctgcctcccaaagtgtagggattacaggcgtgagccactgtgccggtatagaatgcccttcatagcaacatttcccccaatccaggaaccaacccaggatcacttgttgcctgttgttttttagacagagtcttgttctgtcgcccaggctggagtgcagtggcatgatgtcagctcacctcaacctctgcctcccaagttcaagtgattttcatgcctcagcctcgtgagtagctgggactacaggcatgtgctaccacgccaagctaatttttgtattattattattttttaataaagacagggtttcaccatgatggccaggctggtcttgaactcctggcctcaggtgatccacccgcctcagcctcccaaagtactgggattacaggtgtgagccactgcgcccggcctagttttctttctttctttctttcttttttttttttttgagacagagtctcactctgtcgctcaggttggagtgcagtggcgatctcagctcactgcaagctccgcctcccaggttcacgccgttctcctgcctcagcctcccaagtagctgggtctacaggcacctgccaccatgcccggctaatttttttagtagagacggggtttcactatgttggccaggatggtcttgatctcctgacctcgtgatccacccaccttggcctcccaaagtgctgggattataggcatgagccactgcacccggccctctttttttttttttttttttttttgagacggagtcttgctctgttgtccaagctggagtgcagtggcaccatctcggcttactgcaagctctgcctccattcttctgccccagcctcctgagtagctgagactacaggcgcctaccaccacatccggctaatgttttgtatttttagtagagatggggtttcaccatgttagccaggatggtctcgatctcctgacttcaagatctgcccgccttggcctcccaaagtgctgggattacaggtgtgacccaccgcacccagccagtatagttttctttaatctggaaggcttcctcagcctttcttgaattttccagagactgacatttaggcagagtacaggacagctattctgtagactgtctgtccctcagtgtgcgtttgtgtgattgttcctcatgattagtttccggttttgcattattataattatggttcttgttgttgagatgagaatgataatagcagctatctaacaggattgttgtcaggactcaattgatcatgtgaaaagcacagaacaatgctggtatgtagcaagtgccccataaaggaagactgttgttgttgccgttgttaatatagagggtgtggctgggctcagtgactcacgcctataatcccagcactttgagaggctgaggcaagtggatcacttgaggccaggagtttcagaccagcctgggcaacataataagaccctgtttctacaaaaaaattaaaaaaaattagtggggtatgatggcacgtgcctgtagccctagttactgaggaggctaggctgggggctcgcttgagcccagggtagaggtgaactatgttcacaccactgcacttcagcctgggtgacagagcgagaaccagtctctaaaatttaaaaaaaaaaaaacaaaaaaaaaggagagtgggcgggcctacaaacaatgttagagaagttgagaaggagaatcactgcccttcatatagcccctaaggaaggctggcataacaccaggagagagcctgagctttgcatagggtagacacagggctgctgaggtcctttctgcagaggtgcccagggctgagagttatggagcattcaagggtcttgacactggctctccatgctgatccaaccaggacccgcctctctgactgggtgcattgcctgagtccctctagctcctcttccttttctctctccccaaaccaggtacttcaaaggctcatcaagtcccgaggaaagtctcagtccaaacacctcaatgtccaaatagcggcctcggaaaagctggcacagtgcccccctgtgagtgcctagatcccagggaagggaatggagggagaacatttgggttgtcctggtttcctctggcctacatgagagacagggtgaccaggaacacctgggtcaggcctgtgggtgcagactggtcttctgggaagagcgcaggtcccgtcagtcaaagactgggttcaagccccagaagcacccttctgcgtggagagtcaagccctgtctcccagccttggttgccttatctctagaatgagggagttggactgagtgccaaaacttcttgcagttctgccaatctgtagatctgagagctctccttcccttctacatccagaggcctctttttaaccttgtccttcaatcccttgactctacccactgcacccaggccacaccctcaacccccttggccatgccccactcatcccagccctgccccctaaccccgccttcacaggaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcagcttctggtgtctgtggtttttgatgggtctggggcttctggtgctgtcttcctgggcctggtgccataggagcgcatctgctgcccgctggatatgaggcctgatgggagcgcttttaagacaagggactaggaaggacatgcgaggaagactgataaactgattcgctggactccacaccctttttagacccaacagagcaggggccttcagagccagggaaacctacgttaaacctggactctccctccctggagccctgactccacaaggcccctcaagagggaccaagaatgtggcatcttctatgacttgatgctgaaccttccaccattctcccagttaaagtccaggaaaggacctcccatgggagacccatcctgccttgccctcctcccatgggagccacagcccacctcttgatggcacaccattaagtataaggtcttaagagccagaagaaacccatgaaatcattctagactgtagctttcaaatttgttttcagcaacagagcccatttgttcaatgaatcttacgtggaagctgaggatgttagataatgcatccttgctctgccctgagggagccaggggaatggcctcccctccacctccatggggacccctgaagcacttctgtgcccttcccacccaatgccaccccagatctctaggtaacagtttggaaactgctactcaggtctaacccccatcacattacaaccaagaaatgaggccacagagaggggaactgtttgcttagggtcacacagcttgacatggcaggggagggactggaacccctcttgtgccccacctccacgtgacatttgatgataaggacactgggccacctcttcatcttcagtaggagggggagacccagcagccttccccagcttgctgctttgagtgcttgttgggggcaagggaggaatcccatcagccttggagatggtgtcatccgactagggaatggtgggagaagcatggggttctggaagcctgagattggggtttggtgtgggtcgaagaagccagggtcagcaggtttgagctgaaatcccgttaatatatttggaaaaccaaaggcaatgactaaccgaatcaaccgctaatgagtggcaatactgagctgttaatgacagttagccccaagatagcattaatgacctgcactgaggaagcggtgactcatggctcacggctgttggccatagttgccctgagagttcatatgtcctcacatctgttgaaggtcgggtgccccctgtcccgagagaggagcaaatgccctgaggtctgtcctctggctgggctccagagccgtttgtccccggggcccctcctctagagccagcaccctcttcatccaggccggacctcttaatgctgtcactaacttgccttgctttgttgtgtttttctcacccctgcctgatctgcatggtgtgtgctgtccgtctgctaaccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgtgcccaagccaggagctgcttgggcagtcccagctccacactggccctgagccccttcacttacctgtctctccacaagtagagccaaaggcaatgggaagctcaatgttgctcagtgggtgagatccagacccactggtgcaatgtcttaaatacacatgactgtttttc

SEQ ID NO: 380 - DNA, 239302 bp, Homo sapiens
gccatgagtgccttggcaaggctttaaatactttgagggctctcaccagaggcctaattgctaccctttggagctccagagttagtttttcaaggttgtttggaacaataaaacccgtaataacaatgctaccttagatttgtctggaacctttttattttgtaaattaacttttgaaagaactcaacattcttgggtttattttaagctacttttctccttcgcaaggatgcttccaggcactaaaatagtctgcattggagagaacaaacaaatccctacaagtaaacagttgatattgatgactagcaacagtagctaacatgggctgtggactgaccctgtgctaggcagacccctgctccatgattcacaagaaaatggcttgtctgagcttcactagaacccctatgaggtgggtgctattatgtccccattttgcagttgaagaaacaggctcagggaggttattataacttcccaaggccacacagctagtgttgcacagccaaaatttaaacccaggtggtcagacatccagctcatattctgcctcccgacagccctgatgttgcacaaactcatcagccaaatgaccctgagaacaggttcaagccatacttcgatgaggtcacacttgatggctgccttcaggagcctggcccgctctccaagcttggagaacgaagctggggagatggcttcctgaaaggaggttaaccacaggtgaaccagagtctaagcccacgtgggccagccctgcttccctggagagaagactcagcaaagatcttcctacctgggcaccctctgagaaagcaatgctgctgagcttgcatgagagagcagagcaaaggcctgcagtccacggccagagccctggctcagagcctggctggggccctcattaggtgtgaggctactcctgttagtgttgctgcataaagtcccaaacttggtggcataacgccgccatttattgtattcacagatgctgtgcttcgggaattcggacaaggtgcaacagcgtctacttgcttcatggtgtctagggcttcatctggggacgcttgaaaacaagggttgggggatgtgacttgacagctgggggctggaacaatctggagacatttttgcccacgtgtctggtggttgatgctggctgtcagctgggaccacagctggagctgtcaccagaatacacagaagcgtcctccccatgtggcctgggcttcctcatgggcctcagggtagtcagacttcttgtgtaacaattatattcattttctaggggtgccataggaaagtaccacaaaccgggtggcttagaacaacagaaagttatcaccttacagttctggaggctggaaatccgagatcaagctgtcagcagggtgggttccttctgaggctgtcagggagggatctgctccaggccttcctccttggcttgtagatagccatcttctccccgtgtctgcacatcatcttccttctatgtgggtctctctactcaaatttcccccttttataagggggaaattcataatccaataagtcatattggatcagggcccaccttaatgacctcatcttaacttgattacctctatgaagatcctatgtccaaataatttcacattcttagacataaaaacttggggggataacacaatttaacttatgtgtcactccgggctccaaaggcaactgttccaagagaaccagcagaaaccacatggccttttctgagcagccttagaagttgagctccattctatttggttataagtaagtcactaaggtcagcccagattcaagggggagggacagagatcccacctcttggttggaagaaggtcaaataatttatgaactttttttttctttttgagataggtactatttttatttctcttttataggcagagaaagcaaatcctagcatggtcaggcaactcacccggggtctgacagttagtggatgacagggccagcgctggatctcaatatggatgtgctttcaaacttcctatgacctggtgcaagttatgtaacctcagtaagccttgattgcctcatctgtgaaatggtgataatgatacccaattcacagagttgttttaagtattgaatgaggtgagttatgtaaaatgcccagcacattagaggagctcaattaatgataattcctctcctcctcctcctttttcttcttctcctagcatcattattattattatcatcattaatcttaaaagtggaaacacgatgacaagagctttgcagggtagggtaatgaaaaagcaccagatgggaggttaaactccttggatcttcatttgagctgtggatgtttacagctgctaaccttattgtgaatgtatggtgtgtccagcacagagctgatcatttccacatttgatcctatttaacctgtacaccagctagcaaaggccagaactcatatttgaacccatgagccaatgcacttcatctctatgctatcccacttctgacaaacaatctgtaagctttttttccccagcaataacaatatattacccataataatggagcaggcacaaatgccatggcccatgctctcatgtgtgcaaagattcaactttatttgcctttccatgagaaactgcttcctatctttagtccccatttctccctaatgacaaaaaaacaaaaggtaacctagtcatttccatggaaaaccaattgaattcggtgatttctcaagttaggttaaagcttgttgaaatttaggatttttctccctgaaatgacatctcaatttcacagggaatgtacagatcattgtgtctaagacatgcctggtttgtggtggtgatagagatgatattaggttttcccaagccccgtttaatttccctcatcctgggcacatggacgactgcatttcccagcctcttttgcagttaggttggggtcatggtgttagttctggccaaggggctgtaaggggatatactgtatgtcatttccttgctaaggcagtgggaaaccccctgtgcagccttccagtcctccctttctgctgaggccatcctggaagtcaaaactaaaatggagcaaactggactcctgagtcatggcttggaagggagctacttaggagaccctcacgacatgcaatggattagaccacagtgaaagagaaacacatgttcatgtgtcaagctactaagttctggggtatgtttgttactacagcagagcctatcctatcctatgctgattataacgagtcatcctgtgctggctcctaacgtcaacattgatttccactggtatctgctgaagcgaccagcattcccacatgtcagtgtctacgggactgaacatatctccatctggcccctggcttgcccagccctctctgccactgatgactgtgtctgcttgtcacgtgagaattagccgccagcctgggcctctggcttccattctctgctcactaccacatccatctcaggagcataggcaatttgggctactctcccaatctacaggcccagtaagactgcaggagaccccattgtcactctgctgtccccacgcccatctcttctcaacagctctcctgcccagcaagctggtgtaaggttctcctaccctttgctttccccaaaattcatataggggttgctttgtcttcccctgagcctgagccatctggtaggacaggagggctcacagacttctcccttccagcagccccttctcccttggccttggcaacctggctctggtctgcacgtcacgttgctcatgtggtctcttctcctgtcctctttcctttccactctttgggaaatacactttatgctccaattttttaagagtttttagtttctctttgaaactcagtaaaccatttctctttcaaaaagcttccctcttgcatagccaaaagtcttgattcacaagattactttttcttctatacatttttaaagcccattttgaaactcccaagtcaagaactggattctttggtatttgtattctgctggttcttttctttcccagggaaaggagacctctggaagaatcagagcaacaaggacatgctgggaggggtgggagctggattctgaatatgcatctctgcatatgattgtgctgcaatcatgagggacatttgcatggtgccagtgcactttaaccacttacaattcacgacagccctgctgtgtagaattacctgtcttttacaggttgggaaaggggcttaggaagttcaagtgccttgcccaggatcaaatggcaatgcctaaacctggggagagtggtctttttctagggcacgtgtcaacacagctagaaaagaagcccccaccaggagaagccagagccaaatgcatggagccagtgaaagctcccagcgtgtgactgtgcccagcaaaaccacaagaatcctcaggaccagaatgttgacagtcatggactgccatacaattcaaaaaagaaatgtaagctccaagagagtagaagctgttctggtcagcgctgtatccttgggttctagaacagtgtctggcccacagcaagagctcaaatgatattagtcaaatgagtgaatgaagtaagaggaaaaggatcggctctcaggcacctcatcatttggctgagaaagccaatttccgaaagaaggaaaattagagagcagattaagtgctaaaccaggcgaaattaactataagcaaacgtagatgcaataaagaataaaaaatcagtctgtgggtgaggccacccacagatcacaatctgtcataaatgtgtcacacacagtgtcatatatgtcacacatgatataaatgtcacacctctgggtcacacatctgagatgctcgagggttgactctgaatggctttatataagtcacgatgtactgggagctccatttcctgttagtggttgatatgggaacttctctcaaggggagacttactttatcagggaaaatatgtttttaagcagattaggataaagaaggactctaaagggtgcactaaatccacagaagatggctgcttcagggagggacagggattggaaatttccaaaaggaaaccttcatggggtaagaacagtagggtcagatcctgaaaaagacatgtctttgtctattttgtactgttatagcagaatatcacagattgggtaatgtacagtgaacagaaatttattgacccacagctctgggggctgggaagtctaagattgaggagctggcatctgggaaggaccttcctgctgcaccttaacatggcagaagggcagagagagagcacaagagagagcataaaaggggaaaacccactctttataaaaaacccacttccataataatggcattagtccattcatgaaggtggagccctcatgacctaaatatctcttaaaggccctacctcccaataccatcacaatggcaattaaataccacatgagtttggagaggacaagcattcaaaccatagcaagatggggtacgcatgtcagagacagaagccccacagtgggatgataaagaaggcgatttgaagaagaggcttttccaagtaaaaataatgtgcattgtatcatgtcccttcaccaagcaccagtgaagtctcaatgagatcgcaatatgcctgataggttgattggctttcttatggcaagagggacttctagttcctgactggagaggagctgaaacaaaatcaaatgcatgcgcccacacttttctcacaagattcgtgtgagggttgctaatctaagtacttagtacctgggaagtattggacacggaaaccttattgactctacaggtgctctgggttggagtgggctggggtaaggtgggcggatttaaccaataagattctggaggaatggggactgaatgctagttcattctgtatagtatataaccagtcaggagagctcaagatatagatgctgtcattcttccaggctgtgcctgtggcagacatgaccaatggattgcagcactctttctcattgaggccagacttacactcagaatccctctccacattggtctccaggtagccactattaatgggatagagttgatgggagattaaaccaatctgccttccttagcctgagccagaggccataggccggcaacccatgagctggatgtagactgttttgttttttgtcttccttacgtaaggttttgaacaagttttttttgtttgcttgtttgttttgtttggctctttttttttttttttgagacagagtctcgctttgtcacccaggctggagtgcagtgagtgatctcggctcactgcaacctccaccctggttcaagcgattctcctacctcagcctcccgagtagctgggattacaggtgtgcaccaccacacctgggtaattttttcgtatttttagtagagactgggtttcaccatattagccaggatggtctcgatctcctgacatcatgatccacccgcctcagcctcccaaagtgctggaattacaggcatgagccattgtgcccaacctgattacatttttatactaagaatttcacataaatatccagatttccagctgctctttttttttgtcagggtcttgctctgtcacccaggctggagtactgtggcacaatctcggctcactgcaacttctgcctcccaggttcaagcgattctcctgcctcagcctcccaagtagctgggattacaggcatgcgccaccacgccccgctaatttttgtatttttagtagagatcgagtttcaccatgttggccaggctggtcctgaacttccagcttctcttgaaaagcaggagtgtctgacacactgagcctgctttcctgcaaggtaacaattgcctgttgttcaagagcagctgcccactgccccccggccccatgaaggctgagggctgtctagtccgggggtccctgcaggcattttggattggcttccatacctgcctctcagctgaggccagctgagcacacacaaaagtagactctgaagatggcccgagttccagcctcacctctgccacgtatgagtcatgtgacgttggacaaatccctcatcctcatggggccctaactttctcatttgtaatggggggtaatagcagtatttacctcaagaaataagagctgtgaagattaaattaattagaacagtgcctggcacacaagaatcactaaaataagcttagctctcattgcttgacgtttccataaacactcaagtgtctgtctagaatggcaccataattcctgcctcacgggccacagagtgtctctaggggcacagatgagcccagctacctggggggtccttgctgggtgagggagggtctctgtggtccaccctaggccttggaagtggatttccgtagctgcagcactggggcacacacgcaagggtatagatttgaactcaagaaatggaaagaggccaggcgcagtggctcatgcttgtaatccctgcactttgggaggccaaggctggtggatcatttgaggtcaggggtttgagaccaacctggccaaaatggtgaaaccccgtctctactaaaaataaaaataaaattaaaaaataaaaaaaaatttagccaggtgtggtgacaggcacctgtagtctcagctactggggaggctgaggcaggagaactacttaagcccaggaggcagaggttgcagtgagacaagatagcgccaccgcactccagcctaggtgacacagtgagactctgtctcaaaaaaaaaaaaagaaagaaaagaaaaagaaaaaagaaatggaatgaatatttattctttgtcctcacttttcaaagagttaaaagatgaagctaactaaagtagagatgttggctgacattcatactcaaagcctcgtaagaagggcccagggcttccctaatgacatactttaatggcgtgaggattttttaaatggaccccaaaataaggcaaaaataaacacaaaaaagcctccagcagggaggcacgaagcctgaaaggcaaatggcatcccttcctgccctcctcagctcacgaggcagcttcttcctgccttctgagtacaggcgactgacctgcacacagagcacctggagccttctgaccttcatgaaagactcttgtgtctgaccacccctcatcctgggaatatcccacagcctctaggggctgcctgcatccctggggactcagagtgtccatggtggacctgaggccacagctgagattgttggtggggacattcctagggaggggtctgtgcagtgtgggtggcacattaagcaggcagccagaggagcacaagggtcgtgaaaagaaaggggtgttttgggggcaggaacaaatctccccaccctagagagacggagcccagcctgcgtttgaactgcatgcactgtctcctctgtattttacaggaaaaggccatccgtcaagattcagctgaatgagttcttccgattcagcctcttgttcctccagctgtgccagcttctgctttgcaggtcttgccagggtgagagggtgtgagtgtagatctaccagcgccccaaagaccttggagcatgttctataggctccaaagccacctctgagcaggaatggaggggaaggctgggaccctgaggtgagaggaagcagttaagtcaacaagcaagataaaaggtggagcgggggcaggggtggaagaccagagaggaaggaagtgctgggaggagaggtgccgtttttgtccttgccatttcaaggatggcagggaagagaaggagaagagaagagaagaagttttgcagagactatgacgggtgccacgtctaagatctttaggggaaatgccagtgaagagtggaatccatttccgattgctgaactgtgctatgatattttgaatccagcactgccccaggcctgagctgcaggagcccacagcttctatgggactaccgagggctggggtggagtgaggggtgagggcagagacactccatgaaaaagggatctgtccagcaaggaccgatgagatggagagactcaaaataaccaagcctggtcctgccttcaaggagctcacgtctggcagaggcgagagaaatgttggagaaacagatgtgaatcccacagattccccgagcgtgcaaatccctggcaccacccagtcagccccttgcagtttccccaggcgggcagcagacacgcagcccacgtctctgagggctggctgcgtgagtgaactgccttgaggtcgcctgggctcccacggaccccgccttcgccctctgtcctctttgtgtgtttcgtgacaggagggacgtgcgacgtccacatatttttcctggagcaggagaggggtggagtcgggggaggaaggaggtgggggcgggagaagcagggggcggtacccagtggtctaagcagcctggggggcgggtggcttgccagggcgctgggcatggctgtcggcagggactgcaacatgtgcgtgtggcaccctgcccaggggagaaatccgaaacagctttctacacggagctgctgctcctgcgtgcgggccccacccagctcagagccaaacagcttagggagccaagggatgccttgaaccttgcaggggacaggaaggaatctctcgggccagggtatttgtagcaggtataaaatttataattaatattcagatgctcagaaatgttaactttattttctaccattgaactccatttgttggagagccccatttctgttcagtagtggaaaaatacaaacctcgtccatcctggagaacgcagtcacatcgagtttgccgtttagtccattccgggggtgaattcagtctctgggaagggctcagtcttcccaggaggcatgtgagagcttgggagctccatgtacaatcttaggagggggctgggccctctggctggcaggaagtaagcaccctccattctgggatcccctaacctgctggggtccccatccttcctcctccggtgacagaggagggcgctcactcaggcctcaattcttttactccaccctctctcttcatgctcttcttccagcccaggaaaatgggatgtactgcattcctgtgtggcaggaaattgcccacatattctatcctgctcctttcccattctagagctgaaaagcaaaactctccactcttctgcagaacatgaaatagtctaattcacagcagcagaaaggggaatgaatggcaggggccaggggcaggggagagggaaaaggggagtgagtgctgagtggggacagagtttcagtttgggagatgaagaagttctagagatggatggtggtgatggttgcacaacaatgtgaatatatgtaatgcccttgaattgtacacttacaaaatggcttgcgcctgtcgtctgggctacccaggtggctaaagtgggaggatctcttgaggcgtggagtcggaggctgcagtgagctatgatcagacctgtgaatagtcactagacgccagtggagttcagtgtctctgggagaaacatagcgagaccctgtctttaaaaaataaataaataaataaaataaacataaaaaataattaaaaaaaaattttttttaattaaaaaaaaaatgggggtggttgctcacgcctgtaatcccagcactttgggaggccgaggtggacggatcgcctgaggtcagtagttcaagaccagcctggctaacacagtgaaaccccatgtctactaaaaatacaaaaaattacccgggcgtggtggcgggcgcctgtaatcccagctacttgggaagctgagccaggagaattgcttgaaccagggaggaggaggttgcagtgagcaagagtcaaaaaaaaaggttgaaatgatacattttatgttatgtgtattttactacaaaaaaacaaagctcatgtccagtctcttcggctttggtgcctgataggttaaagaatgcttctggaatttacaagacttcttcctctcaagtacttggctcttagaattgaaagactcactcttgtttctgaaatgggtttcaggagcttatccgggatgtcaagaaggaatgttgtcactttctctttgtaatccagctataataatctcaatcctcccctagcaaaactggggggaaggtcactgacaaggaagcatgaaaaaaagaaaaataattaattagtcttaagtgttatctcctattttcaacaaccatgcattagaagtgctggatttgtcaagagattggagtttcatctgtttctaggactgcttgaggtatcgaagtttacatttaagggtctcattgtgattagttttaagaatacagagagacagccataaaaaaggaatgaaataatggccttcacagcaacctggatggaattggagaccattatcctaagtgaagtaactcaggacgttctcactcctaagtgggagctaagctatgaggatgcaaaggtataagaatggcacaatggactttggggactcgggtgaaagggtgggagggggtgagggataaaaggctacatattgggtacagtgtgcactgctcaggtgatggctgcacccaaatctcagaaatcaccgctgaagaacttactcatgtgaccaaacaccatctgttccccaaaaacctattgaaattacataaataaataaataaataggtacttggaggcaacaaaaagaatacagagaggggtaaggggtctggtgggcaaagtggcggcaaatctattcatttatgtacttacagcacctcagcaaggcacctgctatcttctagtgtgtatttattcccttctgctgctgtagccaatgaccacaaacctagaagcttaaaaacacacaaatttattttcctactgttctggaggtcagaaatctgaaatggggctgggcacggtggctcacgcctgtaatcccagcactttgggaggctgaggcgggtggatcacttgaggttaggagttcgagaccgacctgatcgacatggcgaaaccccatctctactaaaaatacaaaaattagccggacatggtggtgcacacctgtcatcccagctgttcaggaggctgaggcaggagaatcacttgaacccaggaggcggaagtttcagtgagccgaaatcatgccactgcactccaacctgggcaacacagcaagactccaaacaaaaaaaaagacatcaaggtgtccgcagggctgtgtgccttctggggattctgggaagaatctgtgtcctgccttttccagctcctggaggctgccctcattctctggctcatggcatcttccccagccatggcatcaacccgacctctgcctccatcctcatatctccttctctgactctgagcctcctgcctccctctcataaggaccctagtgattacgtggatcccacctggacagtccaggatgcttaccctatgcaaaggtctttaccttaatcctatctacaatgtcccttttgccatgtggggtaacatattcacaggttctggggattaggatctggacatctttaaggatcattattctgctcaccatgagttgaaaagccagctgtacaccttatagttgctcttttgcagggcatctgcctttttctaatacatggttttcggcagtttgaccacgatgtgccgaagagtggttttccttgtgttgatcctgcttggggtttgctgagttcttcaatgaacaccaactcagctgatgctttctattggttttggaaaattctcagccactttctcttcaaatactgcttctatgtcattctctcctctcttctgtaggcccccaactacattagacacctgatggttccccatgcatcttccacactctcttttgctcttttcatgctcttctctctgtgcttctttctgaaaatttcctattggttttggagttcactcatgccatcttttgttatgtcccactgctgttaaattcaccccagagtccttgatttgatactgcatttaaaaattctagaatgttcaattaattattctatagagtctaatattctgttaaattctctatctttcatccatttggtcatcttttcctgtatttcatttaacatattttttatagttattttaaagtccttacctactaactctaaagtccttgaccacttctgtagtttggatttaaaaaaattttggtcatgttttcctgcctcttcatatgtcttaatttttttttctttttcttttcttttttttttttttggagacagagctctgtcgcccaggctggagtgcagtggcatgatcttggctcacggcaacctctgccttctgggtttaagtgattctcgtacctcagcctcccaagtagctgggacttcaggtgtgcaccaccacacccagctagccttgtattttcagtagagacagggtttcaccatgttggccaggctggtcttgaacttctgacctcaagagatccgcctgcctctacctcccaaagtgctgggattataggcgtgagccactgcgcctggccttaaatttttaatgtatgctggatggtgtgtgaaagaaccctggaggatgtcaaagaaggttcaccctttcctctgtccagttggtgggagagggccggtcacctcaacccatgaggaactgagctgggtggactgcaggtttcgttagtttgactcattcacggtttactattcttgttcctcagccgagtttctcctagatgttttactgaatgcctggtgggtctctgcctctttatcgctttatctctcatatctcagtttatctaggcttcattgcatccacagctccctaagatcttcacaatgtgttcctgatgtgtttgtcttttctctatttgttgcagcgttgcattgcgtgatgctgtcttctactctttcttggaagtgaaagtccttccctctacatttcaaaacaccaacaggcgaaaagacctatagaacaacaaggtatcaaaggaggcaacaagtaagtgaggaaatgggtggcaatctctctggagaagtggagaccctctattaggaggtctttcggggggctcaacaaatagcacccttcttccccacccaacatctgaagcgagtgagaaataagtagtaagagagatataacccaaaatatcacctttattactgacacgatgtcttagtttgggctgctataacaaggtaccataagaccaggtgtcttataaacagcaagattttctttctcataggcctggaaactagaaattggagatcaaggcaccagcctggctgagttccgatgcaggacctcctccggattgcagacggccacctttcctctgtcttcacatgaggacaagaggacaagagaggtctctagggtcccttttataagggcgtgaatcccatttaagaggccttcaccctcatgacctaatcacctcccaaagtcccacctcctaatcccatcacactgggagttaggatttcaacatgtaaatctggaggagacacaaacattcagtccatacacaggctatgttaggagacatggcatttatctgtgggccttcataatactggcgctaaattttaaactaacacttaatgccagaattagcaagtgtagctaaggcagcccagagagacagcaatcgagacaatgtgcattcatcaggcagcctcctccagagacacaaggaagggcgtgagtggtgtgggtcattgccacttccaaaccagctgatcaaaagagatcccaggggtacaagggagacagacagtccccaggagaagccagcaagaagatgaacagacaaatacaaagccaggaggggggttccactgaggggaatatggagggatttggggatgagctgctgcaggtgtgaggtctccagcaggacagacagaaagggaggtagaggaggacaagccacggggaagggaaagagatggtggagcctggaggagctctcagggctcagcacggggctgtggtggctgtcagcctttggttggggcaggaggggagctggaaggcagcctccgtgctgggaaagtgggtcctgagttttcagtcctcatgcccaatggccttggcccccagctatcttttggaaactcagagctgacccagtccccagtcaatgaccttgggcatgtcttcagcaactccaaggaaaaggatgatgcccttggcatgacttcccgagccccctctgtaaccctacttgtcttcccaacctcgtctcccatcgctctgccttgtccccctcctgactttggcttcactgcaagactctcctctgagccgcggatcctccaggactgaggaggaatgggaaggccaaggtgggcagctcctggaaggtcaggcctgccagggaagcccattcagggggcggtcctgaggccaggccagtccatattctaagcagtatttagaagggaggacacaagctttgagctcaaagacaaagttggaggggaacagacagagcatgggagggctgggttgggaggccatgagcccaggaatgaccctgacacagcatcccttttcgacaaggctgaccaccctatgctggaccccagctatgaccaccgcaggcctccatacccctgatgtcattttgccttcactgtgcttgtgtggcccggtgcagtgcccttcctgcgctcagtgggccctcatcctcagaggcctgctgggacctggtatcgccgcagcactcggcaggcacctcccgtggcctgtagctgaggctgtgtgctccccatctctgggagcatggggtggatccagcgtcccgcagcctgcacccaaggtgcaagagaactgggaaataaatattttttttgaattcaacaataaaatatatctaaaggcagggttgattttttttttatttggtgagacagagtctagctgtgtcgcccgggctggagtgcagtggcgcgatctcagctcactgcaagctccacctcccgggttcataccattctcccgtctcagcctgccgagtaggggactgcaggcaccccccaccacgcctgggtaattttttgtatttttagtagagatggggttttgccgtgttagccaggatggtcttgatgtcctgacctcgtgatctgcccacctcagcctcccaaggtgctgggattacaggtgtgagccaccgcgcccggccctaaggcagggtagattttaatgatgtttgcaacatcagattattagcttccccagagcaattgcaatcacctgggttcttggctgcacctggggagacagcactgctagctcaggcccacgtgcctcagtggaaagatatccccacctcctcctcaggagccgggaagctgctatgctggcccctcacctgccgtcagcccaccagggacaccacggtgcccaagagcatccctcctctgcacaccctggccgtcccattgggtccggaattggtgggttcttggtctcactgacttcaagaataaagccacggaccctcgcggtgagtgttacaatttttaaagggggcatgtctggagtttgctccttctgatgttctgatgtgttcggagtttcttccttctggtgggtttatggtctcgctggcttcaggagtgaagctgcagaccttggaggtgagtgttagagctcttaaggtggcacgtctggagttgttcgttcctcccagtgagtttgtggtctcgctggcttcagaagtgaagctgcagaccttcgcagtgagtgttacagctcataaaggcaatgtggacccaaagagtgagcagcagcaagatttactgcaaagagtaaaagaacaaagcttccacagtgtgcaagaggacctgagtgggttgcccctgctagcttggacagcctgcgtttattcttttatctggctccacccacatcctgctgattggtccattttacggagagccgattggtctgttttacagagagctgattggtctgttttgacagggtgctgattagtgcatttacaatccctgagctagacacaaaagttctccacctccccagtagattagctagatacagagtgtcaattggtgtatttacaaaccctgagctagacacagagtgctgattggtgcatttacaaaccttgagctagatacagagtgcctattggtgcattcacaatcccttagctagacataaagattctccaactccccaccagattaactagatacagagtgccgattggtgcattcacaaaccctgagctagacacagagtgctgattggtgtgtttacaaaccttgagctagattggtgtatttacaatcccttagctagacataaaggttctccaagtccccactagactcaggagcaccgctggcttcacccagtgggtcccccagtgtggcgcaggtggagctgcctgccagtcatgcgcgtgcgcctgcactccccagcccttgggcggccaatgggaccgggcgccgtggagcagggggcggcactcgtcagggaggcttgggctgcccaggagcccatggcgggtggaggaggctcaggcatggtgggctgcgggtctcgagccctgccccgcaggtaggcagctaaggcccggcgagaaatcgagcacagcagctgctggcccaggtgctaagcccctcactgcccggggccgggggcgccgccaagcccacacacacccggcactctatctggcccgcaagcacctcgcgcagccccagttcccgcccgtgcctctccctccacacctcccggcaagctgagggagccggctccggcctcggccagcccagaaaggggctcccacagtgcagtggcgggctgaagggctcctcaagtgtggccagagtgggcgccgaggcccaggaggcaccacgagcgagggctgcgagggctgccagcacgctgtcacctctcaccatctcatgcctgtcaccctttgcggccaggagcactgcaagtcagggcactgaaaggtcctcatctctcaaggctgatttctcgagcgccggtcctctggtctggtctcaggagctgtgaactcagtgggggcttcagcctctggcctccctcaggccaacgtcttcccaggggagaggcctcgctgctgatatcagcagatgaaactagcccaggtgggatgctccctcaccaaggacccaggaacagcacagggttagtaattccaaggacacaggctggactcccggacggcctcccttaccagcaggggacagagcctgagccccatgctcggttgatgaacgaagaatgcttttcactgcccaagtgaggcccaggggagcatccacaggaagggtgggaagcacccaggctctggcccaggcaggcccagcctcaccaagaccactagctgggggacagggacagagatggagagggggcaggacctagccttatggacttggagctttgctagctggggagcagccctcagttctggctgctgttggattggtaaatatttggacactgtgagcttcagaatttctcctaaagtaggcaggggctcagaactatggagatgtggatactgacggtgaatgcgtttgtcccttggggctgataacatggcctgtgcagagatcctgtggaaagggctgctcctctggaactgcatgcacaaaagggcctcccatgcagacccacaggcgcaaggagattgctgagctgctttgggcaaaagcaagcgggaggggaagtaatgcgcttgtaacaaagtgactgagccccaagataagggtgacttcaagagaatcagtgccacccctccatcccagtggcagggtaggggtcactgctggccagacttgagaaacaaggaagcaacccggaagaggccggtctgatgcaaaacacagagaaagagtccacatttgtaattgagatgagagaaggagctgcattatttatgaacggctgagcccagagttaacaaggaaggaggaggcctttagaggggaaagtggtttcaaaagcatccgtatttcactgaaaaaaaacacacacaaactatgatttagagtgtgctgaggtttagaaccggaggtgactctagtgcagttaagaccacggggggaggacgagggtgtgggcagggagggcagaaggacagaggggcaggggcagggtgttcccgcaggccccagtgagagaggggcatgtggggagggggctgcccctggggatgaagcagtgtctatacatgtgcacgctcgcacgctcacattccccaagtgtgcagtgtgtgtgtaagagggcgtgtaggcacttggaacagacgaagggacagagggagggtgcccccactaaagataaagagccttctggggcttgtgtgcttgccagcctaatcttcataagaacttgagccaaaactttaagaagaggggtttcttcaattttttttttaaatttaaggtataatttatgtagaataaaatgcacatctcttcagtgttcaggtttgacaattgcatatgcttatgtaatcaccatcaaacacaagatatagaacataaccatcagcccagaaagttccctcatgttcctggccaccttttgacttgtaccaacatagatcaattgtgtttgttctagagattcatataaatgaaatcatactgtatatactttttttgtgtctggcttatttcactcagcacaattttttttgaggttcatccttgttgtgggtctaacagaagatggattgttgacgaggcctggtggttcatgcctgcaatcccagcactttgggaggctgagaggagaggatcacttgaggtcaggagttcgagactagcctggccaacacggtgaaaccccgtctctaatgaaaatacaaaaattagccaggtgtggtggcatgcatctatagtcccaactactcgagaggctgaggcaggcgaatcgcttgaacccaggagagggaggttgcagtgagccaagatcgtgccattgcactccagcctgggggacagagtgagactccatctcaaaagataaaaaataagatggttcattgtattgctgagtgatgttccattaaacggagatgctgcattttgttgatcctttctgttgacatgccttgggattgtttgcagtgtttgactcttatgagtatggctactgtaaacattcttgtataagtctgtgtgtagacatttgttttcatttcttttgggttaataactaagagtggaactgactgctgggtcatggggtagaagcatgtttatttactgccataagaaactgctagacacatcttcatccacaatgataaagagttccagtgtctccacacacttgtcaatgttcatcgtatttcaccttagcaattttagtggacgtgaaatgttatcttattgcaattttaatttgtgttgtcctgatgactggggacattgaacaccttttcagtgcttactgatcattcatttgtcctgtgagatacctactgaattcatttgcctgtttaaaaaattaggctgttcatgttttttgttgttgatttgtagacattctttatatattctagacccagaaaaggaaggtttttaaaagtaaaacagtagccactgatcatgatatcccggtcctttaagctgaatacctgccacccctcccattccacctcatatatcactttgggtggtgtgctgactttagaatgcacccactgtcacccaaatggctgaaatgctaaattctgtttaatcaaattcaactgactcgtgaagatccatttctaccgaaagcagaaaacaaaacaaatgaaccaataaaagcaacgaatcttactgcttccaggtaaactctctcccatttgacacttaatctttgtataattactctggccattgaggatttcatttaattaatcacagggtaaactctttttcagagtttcatcctcttgaaagtcctcctgtcccaccaagggatagtcaggaagttgtttctattcctcatgggggcaaagtagacattcctggttctctgtctgtcctctagtttcaagtctgactgtgtgggaggaacttaggttgttcttctggtgtctggaggtcggctccacccctgggccatgtgctctgcccaccgtgatcctctcttggcctccagctgcaggggtttgtctcctaccaggcaccaacctcttcctctcccgcgacccttttagtactactgctccccactcccatcccacacagaaagttctagatctcacccaagccacacagaaacccagggaacctcctctatggcatctcagattccctccatatctaaacgtttcacaccatcatttctcctctactgaagccccccagcatgggtgtagatcaccttgcaaggcagtctctgcctggaattctaaacagaaagtggagcacaagctttcagattcttctttggaccatctgaaatgtccataatctctcctgcactctaggtatagtgtcttaatctaataatctcattaactgaaaatgtctctcatctctgccccccacatcccagcccaagaagggctgttcaccttgctgggggacagggaactgctcttgggtcatttgtgaatccttctctacactatggtgtgtggtgaaaaccccatgcttgtcctctaagattattgtatttaaaagaaatgtatgcgaatttaggaaaccctttcctctcttaatggcccggctcttgcagttgaaatcttggctttcagtcctcctgttcttgagtttatttaagtatctgaagctcagcatcctgtcttcattcccactttccatttctccttcattccagctactgctcatgaagataatggaaactgtggctaagtaggtggaaatcacaaataaggagtgaaaaaagaaagcacattaatataattcaaggtattaatctgaacacatttactttgatgttaactatgaatgacttattccctcctccaaaaataaaaaaaaaagaagaagaaagaaatcgtgtattcctgcactcagctccaacttggctcctacttggccctcctacatttgctgagcctctggactttccaagccttaggctctcagatcccttttgtggcgcctgcttgactgtcaactctatgtctggcattgcctggtgtcatgaaaagattttctctggtatccagctccacaggacctatcactcctgggcacggaaggggcaggatacaaaccctgcgggcaggaactcctaggaaatcctccagatcgatttcttgataattcagatgagcctaactaagtttggattttgagcttggtgacagccacctccaatatggccatctgtagtcccacctcctagtatcaatgctttgtgtggtccccttctacatcggatcagggttggcccacgtgaccgatggagtaaggtcgagtgatggtacggctataaaagacattgtggcttctgcccttgtcgctctcaaatcactagcactggagaagctggctgccatgttgtgaggacactcaggcagccccatggagaggtctatgcagcaaggagctgaggcctcctgccacaagccatgtgggtgaaccatcttggagcaaacccagacttacagtcgcaggctaatgtggcagacaggactcatccatctagccccatcagctcagagctgagcaagtagaggcctagagaggtcaaatgatccatcaccaccacacatctggtcaatgtccaagccacaccttgccttccagtcccattttagataaactgattgatcttcagctcagagtagcttcttgcgatgggtgtggtggctcacgcctataatcccagcatattgggaggcctaggcaggcggataacttgaggtcaggagtttgagaccagcctagccaacatggtgaaaccccatatctactaaaaatagaaaaattaactgggtgtggtggcacatgcctgtggtcccagctactcaggaggcagaggcacaagaattgcttgaacctgggaagcagaggttgcagtgagccaagatcgcaccactgcactccagcctgggcaacggagtgaggatctgttgagacagatcaaaaaaaaaaaaaaaaaaaaaaaaagggagggtggcttcttggatttcaccattcgtgtttcctgtgcgctggcttctccatcctgtggcgcctggtcattagcagagtctaggacatcctattgcagtaggcagggagctggagtggggtagggcaggctgatgggcatcctgggctgagataatgtgtctaaagacacagcagtgtgaacatgggtggcatttttggagaggggtgagttgtctactgcaaaggaaggcaggggccatacagaagagcaccttcactatggcataaagtgacacttcctggagctcctgagacagccaagggcaggtgtcaaagttcctgcctcgagttcaaaacaggacagtgtctgtcctcgaaggtggagggccccaaacaacaaacacccatgggagggtgtgtgttattagcctgagtattgtgcaaggtaacatgccgtcaaagcaggcagggtttggtcagtcccattcatgcttgatcaggggagatgtttccagaaaatataaagctggagggtgcagaagagagtccctgcaatagcagatctggggctagccctgatgaccaagaatgctgaccttttcggcaaactttctcagcaggctctcaacaacctctgcacctgagcttcccaaaacaggctgaagcagcaaaggcagatggaatgtattgattcctttggttttgtttcatcttgttttcattcactgcagtaatcttcttcccaggaaagcagaggatttcctggaataaggatcctagcccttctctataacctgcatatgggtatcacttttcaaggccaatttacagacatatgtttcttgccagtaagttcaaagatgtaaccacatcaagtgcagaaagcctggttcttaaagagaaggataaagccgagttggaagacggtgggttttctagccccaatctccaccttgttccaaaacctatggtaaccccaagaggtgaggaaggttgaaatttttcaggcttatacaggcaaataacttacttaatttttttgattgaatttagtgcagctcctaaccccttatttacattcagtcactatcaaaattttctcactgtcctttaagtaaaaatggaatcagttatggattttttttattcctctttcctctctttctcaccaggtgttaaacttgagtgaggtgtattccgggttgggaggcaccgtgtgtctgcaacccagacagtcaatgttcattggccccaggacattgacacctacccagctaccccctgtatctgtggcctctccactctccagttgccagacctaagcaggtgccccgtgttctctttatcccactaccaaggctctgcagcctgctctcaggcacacctgtcctctctacatggcatggaaacgttggctgcgccaccctgggaaactgggggctctgggaaaccacgtgtggcccatccgctggggcccctccatgcttctggtgccacggcacacgtgggcttctcaagagacttgctgcccctttgtccctccccttcaccttcaatttacttgaagaaaccaaagcctgggctttgtaaagagtattgtcactgccatgtgtttaaagaaatccattcggaaattcagatggctttccctccctttctttgggtagaggctgccggccaacaaggaaaataagatacagaaaccttgagaatgggcttcaagtagagggaaatgccgtttgcaacaagttcttagtagcaagcaacagacacctattttggctaatttcagtgaaagggagtctcgtgaaaggctatggggcagctccgaatcattttagaggacacacaggcacagagctgatctttgaggaaccatgagtcaaatcacaccacagaacagggctgatggggaaaccctgccaccacctctgagcacccacacctcgcccaccccaggagctgtgcctggctgccactgctcctgcggccaccactgtcccttccctcctgagtcaccagctctgagtctggtgttggcaccttcacctggctgggaagccccactctttgagccccagctgcaaggcaggctggaaaaaggaagtatctgaccatcacttacctttcagagaggtggttttgctcttcacaaagactcaaaaaataaaaaaaaaaagagtgagagacgcaattctccacataaatatcaagatcatgcttcaggtgctgggaaaccaaagctcataacaagggcctcctttcacacaagaaacacactggggctggcctgagaaggttctctgagagcctccaaggtgctccacccaaggacacaaaccaagcagcatggagaggctgagggacacagagattctgcctccaggaagaggagcagaggcctgacaaagaccaaggagctgggagagaactcatgagagggccgagaaccacaaggaaagcccctccactgtggaggagcctggggtgaggcaccaaggaggggagcccctcccctgaggactgcgtttatccagcttgaagatgggactgagctgaaggaaagcccaccgtggctagaagtacttgagccgtcaacagtaaagctactcactgtgggcggcaccagccctccctcccattgctaggagtgcaacactgggatgaaaccagattctgtggaaaatcggtcagggccaggaggagagggaagaactcaacgcttggatgtggatgtcggagcccccctcccatccatctgcttggggggaggaggggtgggaagggcaaggccgaatcggggtaaaggccccaggtgggcaaataaggcagctccccattggtccacatgttgaccttttgtttgtggccttttgcccacaaggacagtatttccacttaaaggtcacctcccccaggcagcaatcattactgttttgcagcctgttgggaaagtcagatgtaagccatcagataacaaagaaaaaacacgacaagaagagaaacaaatatttcagggcactgctcttgtcattcctcacccctgaatgcaccgatcaccctggccagcagagatggctcccgcctccttgttcagctcttacggtcacggggtttgccttcctcgctgatgccaccagcatcctttggctggaaacaaaacagccccatcaattcagattgttcttaggagctttcagaggagatattggttgcatttaacacacagtcggggccaaaataaaggctgggtaggtgcccgggttattcagcgggaaatgacatcctgctcaggtacacaaatgtcatgctccccaagccctgacacaggcaaaccgtctcacagccttccttccccaggactccagattttccaaccgatggttctcttcttgccttcagacacaacctgtcccgtttgggaaggccaagacaggagaccacagtggcagggagcaaacaggaaacatgagagtggtatcactgacctaatcttttcctttgcagaaacaatctcaattaaaatgcatcacttcagaaaccctatgaaggacccgctctgtgaattctttcgaaggtcatcttaataatccaaaccagttgcccaaccaggaaagaattattctctaacataattgaaaacacccacaggcaggtgcttattgcttgtgaaaatgaagactcatgcatcattggagccttagttccagagaaggtgggatgtgcacggatctgttcttttgacaaagcagcatgaggaaaaagactctgtggccattgcccctaaaaataaaggtatcctgccaagcttctcactggcatcctcagcttcccctttctgaggctgagatgaggtttccttggcctcctcacccccaccaccatagagcagagaggcccaaagtctgttctcaaaatcactcacattcaaatgtgagtaactgacatcagccaaattgggaaccagagtcaaatctgaaactcaaaggaaaaagcttccagataaacttcagagatcttcactgtggggagatgggggggaccaactagatggagtaggggatctttatggccactgtttctctgaagggacagaaggaccaggctcactaggtctgggtggaaaccctagctctgaaagttccttcttacatggctttgagatgattactcggggtggttctgagcttacttattgcatcataaaaaggagagacccatgcggacttctcagggcgaggatgaagtgggatgctatttgtgaaggtgtttggcccatcaaggtgtccataggactaaagaccctacgcagaaacactcgtggccaggaccgggctcctccaggctgtggtcagagcgggccaggttctagtggaaaactctgcctcagtcaagggctgctcaggggttggtgctctcagtagaaagccagtctctggtacgtgactggcacaacctacaggggcttccagaacccgtcacagcagtgtgcctggcctgcagggtacctgagcattgctctcttaacctagcatttattcatcaacctcctggagctcctcctggaggcctggcttcagaatgagtcatattgcccgacaccacactcttttgtttagaattgatacaggacatggggttcctgtgaaattagcttgaaattaatttagccacaatagcttattgttagatttaattgtaaatgaaacaattcaccagggacgtttcactttgtaaacaagcacctcagagtcagcagggaatttgggtattttttttcctactctctagtcgctgcataggtttttacaaaatttgtggccaagcataaaaagcattttggacacggctttggagggacagcccactgccattcgtcaccctcttaggtgccctggcactgggtaggagcagtctgctttcacgcagcctgctgggcacaggaaggtgctctttgctgcagtcaatacattgtccaaaaatcaccctgactccattccagaatccccagtgctcctgcagaagcatcagtgctgctcatattaaagagtccaaaaaacagggtctgggcagtccaggctatggtttccttcagaagccctgaagccagtgtttcttagaacatgatgccacaccaccgttggaacatacagttattatcaacatatagttctcatgttaatggttacatgttcattttaagatgtattaaaacaaaaatcattcctcaaaactgtgatttcatggcaatacacataagtttacattaaaaggcaggtcagccagggacagtggctcatgcctgtaatcccagcacttcgggagactgaagtaggcaattgcttgagcccaggaatttgagatcagcctggtcaacacggcaaaaccctgtctttacaaaaaatacaaaaattagctgtgcatggtagtgcatgcctcccagctacttgggaagctgaggcaggagaatcatctgagtctgggaagtggaaactgcagtgaactgtgattgtgtcactgcacgccagcctgggtgacagaggacaccctgtctcaaaaaggaaaaaaaaaaaaaaaaaaaaggtaggtcaatatgaagaagagtaatttaaaattaaaaaaaattaaaaagtaaattatatgcaacttaaaaccaggagatatcatcttacaccagtcagaatggctgtaaaaagacaaaaaaacacagatgttggtgaggacgcagaaaaaagggaatgtgtatgtaccattggtggaaatgtaaattaatacaaacactatccaaaggaaaataaatcattatatcaaaaagtggccaggcatggtagctcatgcctgtaatcccagcactttgggaggcttaggcgggcagattgcttgaggtcaggagttcaaggccagcctggccaacatggtgaaacctcatctgtactaaaaatacaaaaatgagccggctatggtggtaggtgccagtaatcccagctacttgagaggctgaggcaggagaattgcttgcacctgggaggtggaggttgcagtgagccgagattgcaccactgcactccagtctgggcaacagagagggacttcatctcaaaaaaaaaaaaaattacctgtatttgtatgttcattgcagcactgtatagaatcaacctaagtgtccatcaacagatgattggataacgaaaatgtggcatatatatacaatggaatactattcagccatgaaaaagaaggaaatcatgtcttttgaaataacatgaatggaactggaggcctgtcttaaatgaaacactcagataaagaaagacaaacaccacatgttctcacttatgagtaggagctaaatcatgtgtacacacagacgtatggtatggaatgatagacaatgaatatttggaagagggggtttggtgtgaagggggtggataatgagaaattgcctaatggatacagtctacgttattcaggcaatggatactccaaaagccctgagtttaccactctgtaattatccaggtattaggttggtgcaaaagtaattgtggttaaaagtaatgagaaaacctcaattactcttgcatcaacctataacaaaattacatgtataccccatacattttacaaataaatttttttgaaaaataaaagcttaataattaaaaaaagatgacatgtggcaaaaatcatgactgaagttttctaaataacaccataagcctagcttcttggaaagtggtcatcagagagatcagggacattacctgagagcttgttatgattttggaatttccagccccgccccagactttctcagtcagcatctggattttaggcaggtccctaggggattaagcatgcattttagagtttgagaagagtagcctaagaaaacctggggagcagcgtcccgtggtactgctgacattgctaggtacatcaaatacatctagctgaatcccctctggcacaattgggtgaagttttggccagcagacacaattattttgaatatctgtggcccctccttcactctcacagcaagatgtttttttcccactgtgtgcgactccgggccgcctcagtgaccttgctttgcttgcacagaaacatgggctcagctggccgtagagtaggcaaaaaagcccagagcataggacagtctgggatggcccgggacgacttcccagtgcacacggctgagcctaaaaagaatgccgcaaagactacgtggaggccgccagctgcaggggccagaagataagagtgttaatttagcttggctggcatccagaaagctgagcaaagctaggcctccaagctcagggtaaaaataaataaataaaaataagtaggcagatgtttatgctcgcttcgtaacactagctagcatgtatctggtacatcctatgtgccttgtagcagctccagaaaaggcatcgttgttctctgtctcgcactgaaatccccaaaggttagcgttgtcaccccatctcacagtgagggccatgtggctccagtggtgttctgcttgtggtcacccagccctcctctaagccccaccactttctgctgagagctggctttaggcaggaaatggaaacaggctggtctttttcaaggctgcggcataaccaaagccctagtggattctgcatggaaagaactctcggtatcctaataaggtttcagaacagaaaggagtgtcttcatcactcttgtctttgccagccccatcccatcaatcttctctgtactttgacgcagacacgatggactgttatccacgtggcaaacttggaagcaccttgaaagagagtctaagtaagttgccaagacgcccgtctgaaggccgggtgcctctatgacaaatagcctgagcagctgcacctcgccgaggtgccaaacggatgaaacggggtcactttgagaaactgcacacgatgtgcctgatgcacggtaggtgctcagtacgtgggcagttccttccccgtcccctactccctctgaatgtggctgaccactgtggaccatttcctccactcaccccacaaagaactaaagagatgaagtcagcctttgttcaaacaggaatgaattctgccgctggcaaggcagttggaacactctcctttataatgccgattctccaacattttaaacctatgtcccattttgatcaatgtaaacattgtgtgcccttcttcaatattatttgaaatttcaaataaaaataaatattgtgattcaaagcaaaggaaatgaatcatataatttaatacactttatgcaactgtcctcaccctgcaagatcctgatatgaccatccagcaaggacagcctggctgctctcagttgagtccttatagatcaagccattgccggaacatgacgaaaacacgtggacagcaaaacggaacgctatagcatttgaacagcactctgatcgccctgtccctggtaaagattttgcctctcctaccccacagataggggcatagacaaagctgggccaatcatagtacctcacctacccctggatgcagtgatgggcccaggaggtgggcacatgaccaaatctgggccaatcatagtaccacacctgcctctgatgcagtgattggctcaggggatgggcacacgaccaaatctgggccaattctagtaccacacctgcccctcatgtagtaattggctcagagggtgggcacatgaccagatctgggccaatcctagtaccacacctgcccctggtgcagtcattggcccaggggtgggcacgtggcctaaccctacaaggacttttcctatggtaggggtggaggaatgtggtctctcatctctggtctggaaactggaaaggggagcgggagatcctaaagcccaggcatgctgtctcctgcctcatggaggagtggtttgagacagtgaagcccactcagaaagaaaggccgagatgagaggtagagagcagccaaagacgccccacttaccccatggcaggtacccaactccccaccccacagtttggcttcaggaggtatcattctcttattttagctaaatattgtccagttaaggttctctcccacatctccaatcaagagtggcctaactaaaacaaggggcgtgggagagaggattccacaatatccctggacacggaggcacggtctctcattgccacttagttcgcacagacctttcgctgcacagacgtggctttcttcctctgtctgcatctgccggttcctctcagtttttctgcacctccccagattatcttcttcttcaccgcgtccttttgtccacctaggcctctgactcttaccttcttttggctgttggttcacacttcctgtaatattttttcccctgggaaatcaaggtgcccacatgcccctgctcttggggttctgcgcatgctccctggctctatgctcttgagatgctggcctggctggacctggctggtctgccccatccacacactctagccagatgcgcctgggggtgggagggtggtgggactaaagccacagcagacttgagaaatacacacaggaagcagcccatttcctcagaagttgcccaaacttctgcgatacaattttagcatctggccaaccaagcaagttgggcctgatacatttataaaattgtttgttaaagaaatcatattccagagtcccatctgtgatcttttattttctgtttggtgttgcacatgtttgggaaaagaagtcaataaaaaccatcacaatttaattttaattcccacaaatacaagagaccgcagcaagtgacatgatagaaatccagaaggttcagatgacaaatgcaaactcatgtgaatggctgtaatgtcaactctgtggtccgcgagccaaggtttctagtcccatctagttacatcaggtcagcaaagttcctcaatttctcttagcgtctctttcctcatctgtaaaatagaggatactaagactttctctgtgaattcaagatgaagtaagtcactaataccactgctgctctggccctagagtagcctacaccttgtatatttgcataaggagtagattagggatgcagtaccacagctgtatgtcaatttccaaatctaagtggaggccaggcacggtggctcacacctgtaatcctagcactctaggaggctgaggtggacagatcacttgaggtcaggagtccaagcctggccaacatggtgaaaccccgaaattccatccctactaaaaatacaaaaattagccggctgtggtggtgcgcacctgtagtcccatctactgtggaggtgaggcaggagaatcacttgaacccaggaggcggaggcagtgagctgagattgcacactgtaatttagcctgggtgacagagcgagactccatctcaaaaaaaaaaaaaaaaaaaaaccaccaaaaaaaaaaaaaaagacaaatctaagtggagcctgttgggttcaataatgccataatttgtgttaaaatctcagttaaccacattgtgtgacattacataacactgtttaaagtttcagggaacagtaactctgctgtgataattctgcctgcaaacaagcaccacagtggatttggagaacttactaaagccactggccatccaagaagactacaaacttcccatttgtgggggcacttaaaaattacaaattcagtttggcttttcattgcattttgcgctattactttgcattttaatgagaatgggtttttaaagattttcagttatctcagtagctggaaatttaaaccaatcaattttctactttaaaattctactgtgatgtctgtacacaataaggctacatttttcactatggaggaagggaaggaaaccctcattttacccttttttaacttttctgtaagtttttgctttagaaatgtaaaaggctatttcacaccccaaggctgagtgagggttagtgaatatactctttttgataaaatacagttttgtggtgaaacgaacgaatagtttagaagcagaaaaataagatcttacgaagaaaatactagacttctaatacctcttctctaaggtccattcagattgctgactttttataagatgtccaattctaacccacctaggtacacccagactttataaatatacacacacctaacgcacgtctaaaaggagtaaatgtgtgctggggaaatattggaacaatgacgttcctgagagaagcttgttttttcaagttattaaaggaaggtggcaagcattcatgaggatataaaaacttaacgtcgtctgaaggaaactcttgaatatggttaacatcgctgccaaaaatctcagctatgttatgtcagaatgttcaattgcaagctacactttaatgaatggaaagatagggtaacagcaggaagtttctgcagcaactcacagcaatcttgaaaaccaagttcccagagttggctgggctcactggttcaggggctacgctgtctagttgcctgatctgccagttagcaatcaggcgtaccaggggccaacaagggagcagtgggagagcaggagagcaggagctatctgccctctcctcattgtcctagccaacacttacatggacaagcagctcactttgctctttctgaaaaagtagatggtccgagaaatacaccactggactgggaagacaagaaatcaatgccaccctgcattaagtacgtgactccccttcttttctatgcagcttgcttgcagtgtgatgctgctatttttatcggctctcttcaacccagctgttgcttcatgttgacatggcgaatggtgtgaaactcccagcagaggagcgtgaatcccagagggacccatcttctgtcatttctagaacagataaaatgtcatgagactcagtgggggatggcgcaagaacatttggccaacggagccagtgagaacatatcccacattaaagtgacacagagctaggggccaaagtttgtcctcaaacccaaccgaaagcacagacgtccagtggccagtaaggatcacgaatctttgtggaaaaattgggagcaggagtctttgcattttcagggcaggccatggttgttccaggtgtttgacaccgtggagtcaagaggttgggacaactgcctggagtccagcctggaggtggccccagagaacccacttccttttcctgagttagaatgtgacttgtaattttaagcccactctttgtatttcctctgcgaaaataacagcattttggcaagactgtgtgtagtggggaaaaagtgccacataaaacttacacaatttaaaaatacagctctaattgcaggtttgttgtcccatggtttggcaaattaggggggcaaattggagaggcccttggaacttgctccaggcatgaaaagattgttcagttacacatctgactgtgtagctggtgaactctttcaaaaacttatgaaaataggattttaggggcttccttctagaagagcagctattttctatggggggattattttgtgactgagtgctcaatttagaatttaagcatcaagggcttggacttctctgtacttttctttctccagctttattatgagaataaaatgatttctcttcctactccaaaattttcagattctctcaggtctagatgaaattcagtgaaaaatcaataccttttagtatctaagtgaaaatactaaatgccagcaaatttttcatttttaaatgattcattttaaaatctcttaggatttacaatctacagaactctcaaggacaagagttagagcttctatatttcaatgcaaactctgattcactttaaagattaatagttttaaggtttaaaaacgtctaaggggaggctaaggggagaaggatactgtggatggacacacagtctgtttgaccttcctagtgggcctttgtgtaccgcaaggctggttagctagcatcagctttttccaggatcccttgcagctcagcttttgatatgattctgtttgggcttttgcacaaagtttgggaggcagaagtaaggcacagactatgcttttgttgtttctgtgacaaatcccaccgaggccgtgttggatcctgctgcagtattagccagtgctgtttccatctttttccccagaggcaaggcacggcacgctcatgtttttgctggtatgggtcaaagtcactgcttggcttgacggccaatatttccacaatagttttctgatccccggattgcaatgaagggaaggtgtcctacaggcgatgtatccagggcagcttctggattcccttgctcctggttatggcagctctcagcacaccagtcatgttccttcttccccatcctgaggtctgtgcgtggtaccctctgatgatttttttaaaagcatactgttccttgtattaatttttttctgttcaaaatagctagtgtggttcctgatgtctacaaatgaaccctaacatagaaagtagggatgtggggctatggaaagtgggatcttagcctcagctgtgtcctcacatgttgggatgggctaccctctgcaaaatctcttccttggctctgtcctcctcccattctgctaataccatagcctctaccttcacagagaaaagtggaggcactaactccttcaacttttcatttttacctataaccaaatgagtcttatgccctttatgttcctttacatattaagagaaaacaaatccatcgccaggaatcttgataaagaatatagggctttacttttggtatttcttcagggtggatctttgggggtattacccagcacacaccatggatagcttccctcaaaccccgtgtagacctttctcccccggccacctctgggcagcatctccctgctctccctcattgaccttgggcttccttccctccatgcacccccttctctttcatcctcccctccacagtgctctctctgtaaaaagtccccacagagacgtttgctttatctgccaccaggcccgcaggtggctgggaaccccacagcaccgtaccctctgctcctccatagcctcccagtcagagaagctcaggaaggccctaagcctgagaagcagagttcccctatcagtctgactgcttttctcatgcgaaaacttctggtgagtcacgttttcctggccatacacctttatactggaagcaaacatataaacaagtcagatctttttcaaagcagatggatataaatctaagaaggcaagaagatatttccatccattttttaaaatttaggtgaaattcacaaaacataaaattaatcatttttaaatgaacaatttgccggcatttagtatcttcacaatgttgtaccaaccatcacttctatctggttctgaaacgtttccatcattccaaagtaaaaactccatacctataaattagttaccctccgttctcccctcacccttcagcccctggcaactaccaatctactttcatttctgtgaatttacctactctggatatttcatataaatggagtcatacaacatgtgatcttatgtgtctggcttctttcactcagtataatgtttttgaggttcatccacattgtagcatgtatcaaagcttcattcgtttttatggctgaataatatttcaacgcatgaataaatcacagtttgttcatccattcatccatggatgggtgtttgggtttttcctcctttcagcttttgtgagtagtgatgctatgaacattcacgtataaggattcgtttgggtacctgttgacattttagggggtttacacctaggagtggaattgctgggtcctgtggtaatcctgtgtttaactttttgaggaactgccttactgttttccaccatggctgaaccactttcagtcccaccagcaatgcatgagggctcctatttctccacaccctcactcacacttgttattttccatattttttattatagccattcttgtgtgaactggtatcctgtggttttggtttgcatttccctaatgaccaaggatgccaaacatcatttcacgtgcttcttggccatttatttatttatttttgagacagagccttgctctgttgcccagcctggagtgcaatggtgtcatctgggctcactgcaacctctgcctcctgggctcaagcaatttgcgtgtctcagcctctcgagtagctgggactacaggcaggtgccaccacgcccggctaatttttgtatttttagtagagacggggtttcgtcatgttgtccaggctggtcttgaactcctgacctcaaatgatctgctggccttggcctcccagagtgctgtgattacaggcgtgagccaccatgcctggcccatttatttatcttctttgggagaactgttcgtccatttttaacctggaaagctgatagtctttagaactagtgagacttgagttcagatatgttcaactatttagaagtggtatgacgtgagcacattatttctccagccttcactttcttcctctacgaaaagcgtagaataacttcccacagctgcctgcttgacatccttcaggtcagggtttcagtggactggctcagagaaactttcctgatactcttcttctttcctgatagattcctgtgttgccctgtttcacagtagccaatcttttctttcctaggactcaacacagtttgtaattacatagtcatttgtaagtttttgtcatctatctcctctactagatcattccttctttgtggtcaccagccattgactatcttgttcacagctgtgtatccagagcatagcaccatgtctgcatctggagtgtgtgtgatgtttgttgaatgggaaaaattagtaaattattaaataatatttgtagggaacttagcacagtgcctggtgcatattaaattaatggttcacaatgggggattttggaaatgtgttggtggtgatggtaatgtttgtggttatcacaataattgaaaagacaatactggtgtttagagagcagagtcaggagcactagacaatacctgtggaggcatcctaccatacaaagaattgtctcacgtcccacacaactttagaatataccaccagacatcgatatagggggaaaatctgtttgtaattatctgcacttataatgctgtttttttttcatataaacagagagtaacatttccacagttttaatatgcactgaattttccaagaatgcaacacacataaatttcaaaagttgttgtacattttgtttgaaactccactgagagttgtttgctttttcagaaaaatcacatctccgtgagcaatactgctcatggtgaatcctcaatatagcactccctgatcagcctgtatttgtaagtgtgattccacgtattggtgcaaaaaaacctgattagtgtattatgtcttccagtctaggcatgcctgaatatgtacatgttgcaatacatattttattgtaatttttttgccttcttctttgtattgtatttaaagtattatatttaattattttgaaattatgtatataggtagattatgaagtttattacaggattttagaaaaaagcctttttgttttaaagaaaaacattgagtcaaatagggattagatgtattagatgtgtattagatactgtctttcttttaataataataattacagtggaactttataggcttttctgagataaatggcaaaggaaataaaatcttatttttatcctaagatcttattttcttcttcttattgccaaaatgctccttttcacatacatggggacacttttaatactttgtgcaccccaaaattttgttggttcaacgtaaaaagtacattacagaacttcagagcaaaacttctacagagcagcccaaagtgaggtttatgcagctgtaatgacctacaaggtctggctggtgtttgagaaggatgtgtttgctggacttgaatcccggctccactccttagtaactgcattatttcagactagttgtttaactcactggtcctcagttttctcaactaaagaatggggtcaatgacagctgtctctagggtgctgtgtcatgaaatgtaatcaggtatataccaggcccagcacaatgcagtcacatggtaggtacctagtgttaattttcttctctaaaattattttcttcatctcccaaattattctaataattgccatcaaagacagatcctacatagaacttcataaatgcaaaatcataaaataatacatcacagacaccactggcctggattacacaagtgtatttttatactacattccatgcactctgctcaatgtaagtcttagtctgtgattattgaacctacagtctgtgcatgtggagttttccaggaagtccccaacttttgccattctaaaaggagactgcaatctccaaaggttagaaataaccacctggctgggcgtggtggctcacacctgtaatcccaatactttgggaggccgaggcgggtggatcacctgaggttaggagtttaagaccagcctggccaacatggtgaaaccctgtctctacttaaaaaaataaaataaaataaaaattagtggggcgtggtagcgcaggcctgtaatcccagctacttgggagtctgaggcaggagaatcgcttgaacctgggaggcagaggatgcagtgagccgagatcctgccactgcattccagcctgggcgacagagcaagacctgtgtcaaaaaaatattataaggtaaaagtaatttaacctttacatatgcagtttcttctgtcaggaatgttcttttccccttcaccctgctgatttcttttcatcctccaaaattcaactgaatcatcacgacctcaggaaagtctttctggacttcccaggctagatttggtctggatacatgttcctgaacaccctggttctttcctgtgttgtgggaggcagctgtctgtgcttataacttgataacatcgactaaccctcctgggacgtatatattccatgggggcagggattgtgtcctactgctcacctgggcatccctatcttcttattcagtgcctgacacataccaaaaattcagtacatatttcttgaacgagtgcatgaattttccatcaaaaccaatgaattgatttcaaatcaacttttctactagtaagattgaattgactatgatacaatagcatatttatttgacctcagttgagaggtctttgtaatattttcctccaaatattgtgctagtcctagacccatatgcattgacaaccccgagagtgtgtcaccaggattccacctcctccgactttaccttttctatgggaattctcctctttgttgaatgtcctcagttttgacacgtgcatcctgaactatagctagtgacagttgctctaattgttcagaagttgtctgaagtttcttgtctcctagactcagccaacagctccttgaaaccagagaatcattcaaatccccatggagtatttagcataatagacagcggacggatattggtggttgaacaccactaacttatctaacacacttcttacacgtttgtaaagtacaaaacaacttcaccatctgataattgcatcaaaactaataacttgactctgcctaaggtggttatttctttttctttctttttttttttcttttgagatggagtctcggtctgtcacccaggatggagtgcagtgctgcgatgatcatggctcactgtagcctcaacctcccgggctcaagtgatcctccttcctcaccctcccaagtatctgggattacaggtgtgcactaccacatcaggctaatttttttttctttttaattttttttgtagagatggggttccactatgttgcccaagctggtctcgaacttctgggctcaagcaatcctcctgctttggcctcccaaagtgctgtcattacaggcatgagccatcccacccagcctgccttgtagtctgtctctctctctatctatctttttattttttgagacagggtcttgctctgtttcccaggctgaagtgcagtgacatgatcatagctcactgcaacctcaacctcctggactcaaactatcctcccacctcagcctcctgggtagctgtgactacaggcacgagccacagcagctggctacttttttgtttgtttgtttgttttggtagagacagggatcttgctatgttgcccaggctggtctcaaattcctgggctcaagtaatcctcccacctcagcctcccaaagtgctgggcttataggcatgagtcactgtgtctggcctacaatatttttaaagaaatctgtaaagataattcaaaatgtctgatccagttaattctgcatatgatattattcaggccataattaaacaaaatattttatattttttgtggtctcagtcaattaagaaaatggcccctaaatattttaaaatatcatcctagaaccccaaagaagacaatgacctggagtccacaaaacctgtagggacaggggacgcctactgaaacagccagatgatagactgggtctttatccaagatagagacacgacttggagagagacagagtggttggtgttgaggactgaagggccattgggattcagcgacaaaagctgtatgcagtgacagaagctgcacttcatttgccctgagttgtaactaactagtgggaagagagaatcatggcattttagatcagaaatgatcttagaaagaaattttttctattctcttttattctcaaatagccagatttttgctgtattatgccatctggctaagaactttttgttagctaagaactttgctccttttttaaaaaaaatgataaaagtaatgcactcttatttttgaaaaattggaaattgtgaaaaagaatggccagaaatgcactcattatcctgtatctatttaattctattatggaatacaaatatggatagacaattgttcctacagtatttattgaaaagtcaatcctttcttcattgaattacctggtaccttaaaattagataattttctttatttcctaatgtaagtatttaatgctattaattttcttgtaaatactggcttagcttcatttcacatattttaatatgtgttattttactttcattccattctgaatattttttaatttcccttgtgatttcttcatgaatttttaaatgtattgtttaatttccaaatatttggagagatctcaaatatctctttattatcaattttactttaattttgtgtttaaatagttcttctggccaggggtggtggctcacgcctgtaatttgggagacgaaggcaggcagatgacctgaggtcaagagttccagaccagcctgaccaacatggcaaaaccccgtctccactaaaagtacaaaaagtagccgggcgtggtggtgagtgcctgtaatcccagctacttgggaagctgaggcaggagaatcgcttgaacccgggaggtggaggttgctgtgagccaagatcgtgccatcacactccagcctgggtgacagagcaagactctgtctcaaaaaaaaagctcttctatatcctcacaaatgttctttatagttgatctatcaatcacagataaaggaaagtggaaattttcaactatagttatggatttgtttatttttcctttcaactatttcaatttttgcttcaggtattttgaagctctgtaactagttgcatacacatttaggtattatcacatcctcctgatcagttgacccttttatcattatgaaatgcttttctctattcctggtgatattagcagtcattaaatctaccatgatgttaatgtagccactccaactttcttttgattagtattttcatgttgtgtctcccaagacaactcccagttttaacgatttactaggaggacacatagagttatattcatagccataatgtattatagtgaagagatacaaagcaaattcagtatacacggatgcacttaattcttccagcagcgaattgtaacaacacatgtgaaatgttttctgccagggaagctcgttaaagactcatggccaaggttttcttctgttttttttaagagcattggtcatatagacactctctgactagcacatatcaaaattccagactcccacaaggtaagtggttgttcaccataaaccacattatttgtacaaacagtttaggcacagtaagccattgtcatccgtcctgaaaatggtagtaacattcccaaaattcaagctcccacacaccattgaaggccagctttgcaagaaggcctgtctagggatagcagttttagacttttatgttaactcttttctgcacacaggatacattgttttctattcttttctttttaacatctttatacttaaaatattttctcataggcagcatatatttggatcttgctttttaaaatctaatttgactatttttgccttttaataggagtgcttaaatcattcatattaaggacattcctcttcaataaatggtgttgggaaaactggatattcatatgcagaagaatgaaactggacctttatcttccacaatgtacaaaaatcaactcaagatggtctaaagacttacatgtaagacccaaaactattttaaaaagcagtagaagaaatgcaggagaaacacttcaggatactggtccaggcaaagattttatggctaagacctcaaaaacacaggcaacaaaaccaaaaacagacaaatgggactatattaaattaaaaagtatctgcacagtagaggaaacaatcaatagagtaaaaagacaacctgttgaatgggagaaaatagttgcaaactattcatccagcaagggattaatatccagaatatacaaggaattcaaacaacccaacgacaacaaaaaacaaataatcacattaaaaagtgggcaaaggatatgaatagacatttctcaaaagaaggcatacaaatggccaaaaggtatgtgaaaaaatactcaatatcactcatcatcagagaaatgcaaattaaaaccacaacgcgatatgatcttaccccggtgagaatggatattattaaaaagacaaacaaacagatgctggccagggtgtgaaaaaagggaactcttctgtaccattggtgagaatgtaaattagtaaagccactatggaaaatagtatggagatttctcaaaaaactaaaaatagaactaccatatatccagcaatcccactactgggtatttagacaaaggcaaggagatcagtatatcaaagggatacctgtagccccatgtttattgcaacactatgtaccatagcaaagatatgaaatcaacctaagtgaccatcaacaaatgatttcattcttttttgtggctgaatggataaacaaactgtgtatatgtacacacaatggaatacattgagccacagaaaagaatgaaatcatgtcatttgcagcaatatggatggaactggaggtcattatgttaagtgaaataagccaggctcagaaagacaaatgttgcatattgtcactcacatgtgggagctaaaaaagtggatcatatgaagatagacagtagaatgagagagaccagagactgggaagggtgtgtggttgggaagcagggatggaaagaggtgggttaatgcgtacaagaatacagttagatagaaggaataagttataatgttccatagcaaagtagagtgactatagttaacaataggtgttatatatttcaaaatagctagaagagagaacatgaaatgtttccaacacataggaatggtaaattcttgaggtaatggatgccctaaacaccctgacttgatcattacacattccatgcatgtaacaaaatatcacaagtactccataagtatagacaaatattatgcaccaaaaatatttttttaaatgtacttataagtatggtggagtttatcttcttatatttttattttacctggtctttgctcctttttttctttctttcaattattttttaataatcccattagatttccactctgtttattggctatacctcttgattttgctttttcagtggttgctctagggtttacagttatatgtgtgtgtattttataatatatgtatatgtatgtacgtgtgtgtatatatatttatatatacacacacacattatcttcatcttatttcaaataacctatttgaaatattacaccttctgtagtataagaaacttacaatagcatagttccagttctactgacctttgtgctatggttgtcatatattttacttctacatatgttataaaacccacaatacattgttttttatttttgctctaaatagccaaatactttttaaaaacaattaaaaataggttgggcacagtggctcacgcctgtaatccctgcactttgggaggcctaggtgggtggatcacctgaggtcaggtcgtcacctgagatcatcatggccaacatgatgaaaccctgtccctactaaaaatacaaaaaattagccaggcgtggtggcaggcgcctgtaatcccagatactcaggaggctgaggtgggagactcacttgaacctgggaggtggaggttacggtgagccgagattacaccactgcactccagcctgggcaacacgagcaaaattctgtttcaaaaacaaacaaacaaacaaacaaacaaataaaagattaaaaataaaaaatattcatttttactataactttattcaaaattctggaaaataagatactcatgtctggcaaatggcaaagttaaaaaaaaaaaaacaactcctagtcattttgatttaactgtcagcaaaccctccattattttaattgagcagtgtccatgggcgaacagtgagtgcttgactggtattacttagtactcaccacaactgtctttgttttgtttcaccaaagatttatagagattgcagcaagtacctagcatgtaaacatttctttcccatataaagaggtttttttccttaactgttcttaatacttttatccagcaatctagcaccctcagacttttctacaccatattatgatccacttactccaaatacccaactctgaaattggatcctcatcttttattggtttctctgaaaattctctagcttcaatgtgagaaattaaagaatctaaacagctaaaattcttatttactaaccacagcagcaggtctattgcaatagcttcctctaaactgtgccaatcagttcttcaaattaattagattatattttcaatattttcattagcaccatgttattatatttctctatttaggtaaatgacatctcatctttttttttttagtgttaagtttcaggtcttgggtttacacaggaaataaagaattgtagaggaagctctttgtcatgaaggaacaaatagaacagatataggacttgtgtttgggaacctttccatcaagcttattatcatggtataattttgttgctttcctttatctacaacatcaatattactgatataaactattgactgacctcgaaggaagcagactactacgagtttaagatacttgaaataattatttgctctgtatgaataggttatcaatttgatatagtgttttttagtttatgttcatttttttttttaatagagacagggtctccctatgttgcccaggctggtcttgaattctagcctcaagagatcctcccaccttggcctcccgcagtactgggattacaagcatgagccaccacacctggcctagtttatgttcagtttcaatttttcctttttttttctatttctttttattttaaatgttatttttaaatatgtaagacatttatacagatcaaaactcaaagctattaaaaagggggtgggaatcttgctattcatattctctttaacacactcctgtctacccctcctaggtaaccattttcattagcttccatgtttctatttgcaaaaataagcaaatatgtatgtgtgtgaatatcatgttttttctcatttccctttctttcttacatgagaggtaatatattacatacactcttctgcgtcttgctttttttagtagttctttaatctttgagtttgtcatctgtgacacagggagaacactgtgtgcgaaaattaaatagaagggggcacacaacaaggaccaggcacagtgggacctacctccacatggtgcctagagcctactcctgttcctccaaatggcagcatcatggctactgatactcccattacttcaggtagtggttttagattaaaatgttcttggagaagttgggagcacacagcagatcatccagcatgaatagtttgtagcgttctagttgcatctacaaccaaggccactgttccttttcaatccaagacaaactctcagaacccaaggagggctgctggcgagtctcctcctgatggtgcccagcacccagtcttcccacaaatttagcagtgaatccatcccatctgccacatggaggcaaacagactcatggccaggctgcagggcaaagacttcttattaataaatatattttctatttgcccacatatttaccatttccagtacccttccttactttgtgtagatttatttccatctggtatcattttcctttttcatgaataaattccttaccttttcttgtggtgcaggtttactgggaataagttctattgccttttgtttgtcttttttacctttacgttaaaaaaatctttttgctggatataatatcctacatcgacagggtttttcattcagtactgttgcctcattttccaatagcttgcacagtttgtgactaaaatttgccatccttcttatcattgttcctctgtatgtagtgtatctcccccaactacccacacctgcttttaagatttttctcttcatcatgggttttgagcaattggattataatgtactttggtgtggttttctttatgtctactctgcgtgagttttgttgagcttcctctatcatgggtttatagttttcgtcaaatttgaaaagtgtttggccattatttctttcatttttctgctgcttcttccttttttctgggataccaactacatgccaatcagactacttgttttgtcccacaggtcactatgtttcctcaattattgagacatcagtaattgagaaaggactattgaaatctctgactataatttttctttttctctatttctatccagtctttgtttaatgtattttgaagttctgttactagatgcttacatgtttaacattgctatgtccccttgatgacttgacgtctttatcctgccgaaagaatcctcttttcccatggtaatatccttagctccgaagtttactcagtgtgaaattaatataagcattccagttttcttttagttagtgtcagcataatatatctttttccatctttttatttttatgctatttagttttcatttttaaagtatgtttcttacaggcagcatatacctgggtctctctcttttatccaatctgatgatctgtaccttgtatttaggtcattgaggccacttatatttaatgtgaatgaatatggttaggtttaaatctacatattgttatctgttttctaggtgtctcatcccttttatgttcctgttttcccttgtcctattcctgtggattgcttgagtatttctttttatttcactttttctcctttgttgccttataagctcaaacactttgctgggttattttaaaggttgctgtagagtttatagtaactttttaaatctgatcacaacctaccacaagtgatattatatcactttatgtatcatataagaaccttagaatagtactcttctatttcttccttcccaaacttcgtgctattgttgtcatacattttatttctacatataagcctcacaatacactgttttggattttgctttaaacagtgacatcttttctaaaaaagagacttaaattatgttttaaagttttatatttatacatatttctagtgcttttaattcttttgtgtagatcttgatttccaaatagcatgattttctatctaaaggactttctctaaatttttttttgtactgcagacctgctagtaatgagttccttcagcatttgtatgtttgcaaaagtctttagtttgccttcattttgaaaagacttttttctggataaagaattctgtgtttaccattttatttatttgagttttctctctttttctcttagtttggtgaaagctttttcaattttgcttatctttaaaaaaaaaaaaaccaacccttaagtttaccaatatatgttgttgtctagtgtctcttttatttatttctgctctgatctttactatttccttccttatgctatattgggtttagcttgttgttctttttctagatccttgaggtgtgaagttaggttatttaagatctttcttttctctcaatgtaggtgtttatcactacaaacttccctcttagaactgcttttgctgcatcccataggttttgatatgttgtatttccattttgtttgtctcaagatatttcttgattttcttttgatttcttgatataaccattggttgtccaggagtatgttgtttaatttccatgtatttataattcttgttttcctcctgctattgatttctaattttatatcattgtggtcagaagacatatttgattgatttcggtcttcttaaatttgttaagacttgttttgtggcctaatgtgatctacctggagactactctgtttgtatttaaaaaggatgtatattctgctgctgttggatggaatgttctgtatatgtctgttacgtccttttggcctacagtctgctatttctttattgattttctgtctagataacctatccattgttgaaagtgaagtattaaagttcccaactgttactgtattactgcctatttcttccttcagttctcttaatatttcctttatatgtttaggtgctatgatgtttgatgcatatatattttcaattcttacatcctcttgatgaatttaccccattattattatataatgaccttctttgtctcctgtgacagtttttgacttaaaatctattttgcctgatagtaagtatagctaccactactctgttttggaaagagaaggcattactacggataccatggaaacgcaaaggatcataacagactatgaacaattatatgccaacaagttggatagcctagaagaaattgataaattcctagaaatgtccagcccaccaaaactgaatcatgaagaaatagaaattttgaacagacaaatattgagtaaggagattgagtcagtaataaaacctccccaaaaataaaagtccaggatttaatagcttcactaatgaattctaccaaatatttaaagaagaattaaagcctatctttctcagaatcttctaaaaacttgatgaggaaagaatacttccaagttcattttatgaggctagcattaccctgatgcccaagccagacaaggacactataagaaaataaaattataggccaatgtttttggtgaacttgtatgcaaaaattatcaacaaaatactagcaaactgaattcaatagcacattaaaagaattatataccatgatcaaggggaatttatccctgggatgcaaggatagtttgatatacaaaagtcaataaacgtgatataccatattaacagaataaaggataaaaaccacatgataatttcagtggatgcagaaaaagcatttgatgacaacattctttcatgattaactctctcaataaattaggtatagaaagaacgtacctcaacacattaaaggctatatatgacaagtccacagctaacgtaatcaataatgaaaagctgaaagctttttctctaagatcagtagcaagacaaggattcacttgcctggcataagcaagacaagctcactttcattgattctattcaatatagtactggtagtcctagcagaaattaggcaagaaagagaaataaaaggtgatatggtttggctctgtttccccatccaaatctcaccttgaattgtaatcgttataatccccatgtgtcaagggcgggacgaggtggaggtaactggatcatggggacagtttcccccatgctgttttcatgataatgggtgagttttatgagatgtgatggttttgtgtctggcatttcccctgctagcacccactccatcctgccaccctgtgaagaagttgcctgattctcttttgccttctgccatgatcgtaggtttcctgaggcctgcccagcaatgtagaactgtgagtcagttaaacctctttcctttacaaattacccagtcttggatattccttcatagcagtgtgagaacagactgaaacaaaaggcaaccaaatcaaaaaggaagaagtaaaattgtctctgcttacagatgctatgatcttatatacaaaaaccctaaagcaaaagtgtcaccaaaaaactcttagaactaatacacaaattcagtaaagttgcaagatatgatattaaaaatctgttacatttttatatacaaacaataaacaatttgaaaaaagaaattatgaaaacaatattatttacaaaggcaccaaatatatttaggaatacatcaaaccaagtaagagaaagatctgtacattgaaaagtataaaacagtgatgaaagaaattgaagaagacacaaatgaaaggacatcccatgttaatgattggaataattaaaattgttaaaatattcatactacccaaagtgacctatagattcaatgcaatctctatcaaaattccaatggcatttttcacagaattagaaaaggccatcctaaaattcatttgaaattgcaaaagacccagaatagtaaaagcaatcttgtgcaataagaacaaagctagagacatcacactaccaaatttcaaaatacactgcaaagttacagcaatcaaatcagtatggtactggcatgaaaacagacatatagaccaatggaaaagaatagagagcccagaaataaatccacacatttatggtcaaaagtgattaacctttgatctttgacaaaagtaccgataacatgcactggagaaagaatagtcttcttttttctctctttctttttttttcataggatcttgctctgtcacccaggctggagtgcagtgatgcaatcatggcttactgcagccttaagctcctgggctcaagcaatcctcctaccttagcctcccaagcagctaggactatagatgcatgctaccatgcccagctaagacaaaaaaaattgtagagatgaggttctccctttgttgattctctctacactggctggtctcaaacttctggtctcaaggaatcttcctgccttggcctcccaaagcactgggattacaggcatgagtcatcacacctggcacatgcagaaaagaattggactcttatctcataccacatgcaaaaaatcaactaaaatggattaaagacttaaatataagacctgaaactgtatgtcagtagcaataaaacaacccaattaaaaaattgacaagggacctgaatagacatttcttttttattattattattatactttaggttttagggtacatgtgcacaacgtgcaggtttgttacctatgtttacatgtgccatgttggtgtgctgcacccattaacttatcatttaacattaggtatatctcctaatgctatccctcccccctccccccacccacaacaagccctagtgtgtgatgttccctttcctgtgtccatgtgttctcattgttcaattcccacctatgagtgagaacatgtggtgtttggttttttgtccctgtgatagtttgctaagaatgatggtttccagcttcatccatgtccctgcaaagggcatgaactcatccttttttatggccacatagtattccatggtgtatatgtgccacattttcttaatccagcctatcattgttggacatttgggttggttccaagtctttgctattgtgagtagtgctgcaataaacatacgtgtccatgtatctttataacagcatgttttgtaatcctttgggtatatacccagtaatgggatggctgggtcaaatggtatttctagttctatatccctgaagaatcaccacactgaattccacaatggttgaactagtttacggtcccaccaacagtgtaaaagtgttcctatttctgcacatcctctccagcacatgctggactgatgttgtttcctgactttttaatgattgccattctaactggtgtgagatggtatctcatggtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaacttgtttgagttcattgtagattctggatattagccctttgtcagatgaataggttgcagaaattttctcccattctgtaggttgcctgttcactctgatggtagtttcttttgctgtgcagaagctcttaaaggaaggaatacaaaagtccaacaggtatatgaaaaaaaagctcgacatactaatcatcatggaaatgcaaattagaaccacaatgagttattacctcacatctgttagaatggcaattaccaaaaagacaaacaataacaagtgttggtgaggatgtgataaaaagggaacccttgtacattgcacttactctatgatccagcaatctcactttagggcatgtatacaaaggaaatgatataagtctgtggaagggatatctgccctcccatgtgcattgcagcattactgacaatagctaagacatcaaagcaacctaagtgtccactggcagatgaatggaaatattatacacacacacacacagacacacacaatggaatattacttggccataaaaatgaaagaattcctgtcatttggaataacatgaataaacctgaaggatattatgctatgtgaaataagcccggcacagaaaggaagatagtgcatgatctcatttatgtgtgaaatctgaaaatgtcaaactcatagacacagagtaaaatggtggtagcttggagctgtggagtgggggaaatgaggaggtattggacagagggtacagttttttacacaggatgagtaaattctggagatctaatgaacagcatcgtgactataattaataatattgtattgtatatttgaaatttgctaacagagaagggcttaaatgttctcaccacacacacaaaaagacaattgtgagatgatagctatgttcattaacttcattgtgataatcatgccacaatgtataactacatcaaaaaaatcccatcatataccttcaatatgtataatttttatttgtcaattttaccttaataaagcaggaaaaaagttaaaaatagaaaactacaaaaaggcatacatagtttaatattgttcaactacattgacaaaactattgatttatgtcatagatttaggaatttttgtataaacaaattcagtaaaattgcaaggtacaaaatcagtatacaaaatttgttgcatgtctatacactagcaatgaactagctgaaaaatgaaattttgggtctggtcatagtggctcatgcttgtaatcccagcactttggggaccgaggtgggtggatcacttgaggccaggagttcgagaccagcctgggcaacatggtgaaaccctgtctctactaaaaatacaaaaattagctggacatggtggtgcctgcctgtaatcccagctactcaggaggctgaggcaggagaatcacttgaatccaggagatggaggttgcagtgaaaacaatcccatttacaatagcatcaaaaaacatttaggaataaatttaaccaaggaaggggaagatctgtacagtattatgtaaacatttaattacttattaaatatataaatactaattttttaaaaacttcttaaaggatttaacataaggagaaaaattgtatgttgatgggttttttgctttgttttcttttgttattttaatactttgaggatgttgctgtaccatcttctcacttgcagttccagatgagaaatgtgctagaatcctcactttgttcctctgtacaataaggtgtctttcttcctttggctgctttaagagtttctcttttttattttttatttatttatttattttgagacatagtctccctctctccctctgttgcccaggcttgagtgcagtggtgtgatcttggctcactgcaacctctgcctcccaggctcaagcgattcttgtgcctcagcctcccaagtagctgggattacgggtgtgcgccatcatgcctggctattttttaatttgtagtagagatggggttttgccatgttggccaggctgctctcaagctcctgacctcaaatgatccgctcaccttggcctcccaaagtgctggaattacaggcgtgagccacggcgcccggcccaagaatttctctttaccattggtttgaagcaatttgattgtaatatgccttggttttcttcacctgtttattttttatgttttaaattttggagacagggtcttgttctgtcacctaggctggtgcaaagctcactgcagcctcgaactcccaggcacaagtgatcttcctgcctcagtctcccaagtagctaggactacaggtggacgccaccatgtctggctaattttttttatttttttgtagaaatgagttctcgctttgttgcccaggctaatcttgaattcctggcctcaagtgatccttccacctcagcctcccgaactgctgggattacaggcatgagccaccatgcccagccttcttcacatttcttgtacttgggggttaattgagtgttttgaatttatagtgtgagtttatatttttcatcagctttgaaaaaattgagggtattatttcttcaattattttttctgctctctcctcctttggagacttcaattacacatatagtagaccacatgaaattgttccacagttcactgaatctctgttaatcgtttttttattctattttttcttctgtgtttcattttggatagttgctgttgccatgtcttcaagttcactaaacttttcttctgcagcataaatcctgtcccaactacttttcatctcagacatggtagttttcatctcttaattcatgtgtgtgtgtgtgtgtgtgtgtgtaatatctaccatatatctacttaacatgtttaatctttatcttctggtacacacgaaatacaattataattactatatttatgtccttggctagcaactacatcatctgtgttattttggggccagtttctattgattaatttttttctcatcatgggtcatagttttctgctgttttgcacgcctggtaattctgagataccagcattatcaattttacatttttaagtgttggacacttttgtattcctacttctattcatattcttgagttttatcctgaagttcagttaaggtacttgggtccagtttgcttctttcagattttactttcaagttttgacaggagggcccagaatagcatttagtctagggttaactttttccccattactgaggtagaatctgtgaccactgaactgtgaacccttccctgctcaggctgatttccagcgttgctccctgtaatcctttcaggggcttctttcttcagccgtgggtagttttctcttatgcatgtgctgatccgtccatagctgaagacttacagggacttccttgaagatctccagaactctttctctttgcagctctttcttctttgatactatgtcttgcaaactctagccacctctgtctctcagacttccaactgaagtcttcttaaccaggggagactagcaggctccagctgggttcccctgcctgcactcatgcctggaaactgtcttctggctgtacactttggcaatggtaggcttccctttattcatttcccagctctcatggatcactacactttgttagctgatttccaatgttttgaaaatagttgttttgtatatttggtgcagattttaagttatattgatggagagtctctgacccattatcccatctcgcctggcagccgaagtcttcagaggtaatcaagtaccaaagatttagtctaatgttgaatgtggatgaaaaaggaagtaccatatttttattttaatgcagtcattcttaaatgtttttatgctgcagatcctctggccatcttgtgaaacctatggattacttttgagaatgtttggaaatgcacaaggtaaaatacagaggactacagtggaaatcattatagtggatgtagttattagaatatttttctaagtgaatttgtgccatagtaatagatgtgtttcttaattaatgcattgaataacaagacctaatagtgggtctaatgagttctgtaattttcaagcagtaataagcataagcattattttgagatatttacaacaaggtaatgtaatttaaatatatcactacttcccattgctgacaacgtcagggtactattgatgttactgtggtttgttgccaacatacattacagaaggcaatgctaaatttcagtcataggttaataaaaataaacatccaattgctctttcacccaagatcaaagacccctgaattctgtccacagacccctgagaagtccgtgggtccaggataagaacccctattaatgaatggaaactggagtgcctgggagttgtgagtcttacacaattggctaagcttgtgaactgacaatgattttgtctgaatctaccttgggaatgtgagatgccatgaggataattttggcgtgggttggggggatagcatttacaagacaactgggagtgtccttcatgccaagatgggtctccctactgtggttccccaccaagcaagtttgcccccactgctgaggagtccacctgtcaaatggcttcttgcccaactcccagcctgaagctcaagattcatcactcaaaactgacaaattgggcaggtctgatgtttatttttgcctctggtcctttggccaggccacacactcttggatttctgaatatgcagttctgttcctaaccagtgtgtcccaaccagaaagtcactgtaatttttggttttgttcccaatctccctccaaatgtcattagtcatatcctccttcccatttctgccttgaataggcagtcattatgatgaagccaggcttgtttcagaattccatgagaaccacagtgtcaggctgtgacaactctggggctggaaatggaaaaggctgtgatctggggttggctggcaccgtccccgtgagtcattatggaaacactgtccccggattctgctgagaggactgggttgctggtgagtccatctgtcagatgagatcctgaccccctgacaccttaaaacgttccataatatgtgggatgttgggccttctgtctggtatcctggctacattaaaatttgggttgttttattctatttttggttcccttgcagtttccaatgtgttaaaaaacaaaatacaatttttttcagattacaaaaataatacatattcattgtacagaaattgaaaaaggcagaaaaacatacagaaggaaattctaccacccagagataaggattttttaaaatgttgcatttgctttcagatgctatttagattatagtttataaaatacttttgtaagctgtgtgctttttaaaactctaacagtatagctcacacagtctgccttataaaaagcacaaattctatcatttttttctctggaggaggccttatataagaccatctagtctaacacactctttgtaaaaatgaggcaactgtgatcccaagagggtaagtaacttgctcagggctccccagcgtatgagccacagagtcaggaatgggagtatggatcttgtctcagcatcctgctgcctcgtgacctgcccatgtgctgtcagtgtacatcttcagacaagagctgaaagcactccggcctctctgcctcttgacccggaggaaatgtagatgagttcccaggcttactgaataggacatttgcccctgctttagaccttgagttagggaactatttaacatctttgaaattttcattccctaggggaaagcttaaaatttgaggaaaaacaaaaggctctttcccatgcaaaaattatttttggttatcatttggaaaagaaaaataggcattactaacaacttaatgacttcactaatatacctgcctttaaacttaagaatagttatttaataaagtttataaactctactaaagtacgtacacaatagtatgtatattttataatatgtgtatttccaggaaatgtgaattcaccccagaaagtaaggaggctgcctgtatggtatgggatgggatgggatgggatgggatgggatgggatggtattagtatgggatggtatggtatgggatgggatgggatgggatagtattagtatgggatgggatggtatggtatgggatgggatggcattagtatgggatggtatggtatggtatgggatggcctagtaaccgtatggtatggcctggcatagtatggcatggcatgttaaggtaatggcatgctatggtatgataatggtatggtgtggtgtggtatggcatgggatggtatgggatggtaatggtatggtatggtatagtgtatagtatagtctggtgtatagtgtagtgttgttatattgatagtatagcatagtataatatagtaaaatgactgtaattcagatttaggtggtcttggatttaaatcctatctcagcacctacctggttgtgtaatcttggaaactgagcctctttgagctttatttcattatctgtaaaatgaaaatagtaatagcagttatcccaagatatagatacaataaataaaacaatgcattcccatttcctttttagaagaaagtaaagaaaaggtaagaaacgaatttatgaactggtgattgtaatatttctgaattgttgattatgacaattgcctactgctcatcagtattactgtgccaaacagctgtgatgagaggagcagggataaggcctccccctaagtatgggtgccaattccaaaagaaggaactgctgagagccacactgccaccccaactggtgaatatttcactctttacgatcgtctccttctataatttttaataaaataaaaatcaaatctataaaaattacaaaatcaaatatttcaattaaattgaaatattgggtaacagataataatcaatttttcagaatacacaaggacatgaacaacaggatgtgttaacttcaaggacaaataatagggtcagacttcaagtagaacatggttgagtaaatcaacatctttcaccttgtcctccagagaatcctacaaaagcagcaaggagaatgaaaaacaccctacatactccactttcagtgaaatcaagatagctagatattatatgcagactctaaaatttgtgcaaggaatgtcaaggcggctgatattaagcaaaagctataagaagaatataaagaaaaaggttcagagagcagctagatggcccagggtgggggtgggggtagcagagttgaaagtgccaataaaaataggtaagaggctctactcgacgtgtacatatgtgtctcctgttttcagttaaaaaaaagcaagaagtatagtaagcaaagctgggcagcagaaacactcttggatgggtcatatgatacaaaaaagcaaaaaaggtggagctgctcaaagaatcacaaagatgcgccttatctgcaagaaacagtctgtctctgtggcagagcagagaagaagaaattctgtgagttgtaaaatttagaaggttatattgtctccagtccacctctccataccactcccctgccggaaaccttttgatccggggaaacccaagtcattcaagatgaataatttttaaaatgaactacccaaacacaaatttaaagatacctgcttttatatcttgctgaaaaaatcagcaagatttgccaagaaataaagaatacttatcagaaaaatgttgtcatcatgaaaccagtaaaatgttgcttaatatgttgccatgaaatttaaagattattgaagaaatttcctctaaaagtaaaactacaaggcaaaaattaatattaaaaagcaaaaatatcggccggggcacggtggctcacactgtaatcctagcaatttgggaggccgacgcaggtggatcacctgaggtcaggagtttgagaccagcctgaccaacatggtgaaaccccatctactaaaaatacgaaaaaaaaaaaattagccgggcatagtgatgggcacctgtaatcccagctacctgggaggctgaggcaggggaatcgattgaacctgggaggcggaggttgcagtgagcagagatcatgccattgcactccagcctggaagcgaaactccatctcaaaaaaaaaaaatctatctatctatctatctatctatctatctatctatctatcatctatctatctatcatctatctatcatctatctatcatctatctatctatctatctatcatctatccatcatctatctatcatctatctatctatcatctgtctatcatctatctatcgtctatctatctatcatctatctaatctatcatctatctatctatcatctatctatcatctatctatctatctgtctatcatctatctatctatcatctatctatcatctatctatctatacacatatatcagggaagagatgatagaataataggaagaaacaaatcacgtgcttgaagaacttgggaaagaaatagaataacatagcaaaaggaccatagaattaagacaaaattgacaagaacataaaagagaagacacagtattgacaaaaaagagtaaaagtgaaaacaatgaacagatgaaatggaagtaaagaaagtttttcaaaagatgaaagagaaaatgttagatgtagaagacaggcaaaggatatctaacacatacagacaaacttcagaaaaccaagagatggttgaacatagcatatacctaactatagttccaaggcttaaacaaatgtggggattagcatgacagatcagaaaatgtgtcccataatctgctgagatgttagaaatgatacaattccagaatagaaaagagaagggaggtaaaggtggaaggtagaatatgctcactaattgacccctttgtagttgcagaaatcaaaggatatcacttaaggttgaacatcaagtaaaagatttatgggcatattaaattgtacaaagataaacataagaaagataacactgactaaaattagatgatgaaggaaaggaaaaggtagggaaggaggaggaaatatgctaatttcattattgctcataatagggacctgacagatatagtccaaagtagagaactaagagcatgataggaagttatcattacaaaggtaaacatcaaacatgcaaacctgcctaatttgcagaagaaacttgcacaaaaataaaatgagagaataaggtaagtagtgaatgactttaatagataaagtaagcataatataaaataatatgacagtagtgagatcacacatatctgttatatcgatcactgtaaagcagcttagcttacctataaaaaaagagtttcaggttgaattacaaaactaaacccaattctatttttttttttttttttgagacagagtctcactctgttgcccaggctggagtgcagtggcacgatctaggctcactgcaacctccgcctcctgggttcaagcgattctcatgcctcagcctcttgagtagctgggattacgggcacgcaccaccacagccggataattttttgtatttttagtagagacggggttttgccatattgcccaggctggttttgaactcctgagctcaggcagtccacccgcttcagcctcccaaagtgctgggattacaggtgtgagccaccgagcccagcccaactctatttttgtgtacagaaagagtgagagcaaaagttaaaaagagaagttttcctgctggcctctgatggagtagcaggcacagacataatgtcccaccatcaacaattagaaaactggaccaaatatttcaaacaatggttttctaacatcagacactggacagcacaggactgtgatctctcggagaaggaaaataaacgaggtgagcccgacgattgtcccagtctgtctggagacagtttctagaccactggggcaaacggaggacacagactgagcccagtggcgtcgctgagctaacgagatggagttttcagttaaggacattcttaggagaaatctgggaaaacagccactcatacatttccagtaggagtgtaaattggtacaaatctttatggtggccaatttgccaatacctggcaaactgatttttgagttagtaatctcatgtctgggaatttatcttacagatatacatgcacaggtgcaagatgacatatatacaaagttacagcagcattgtaatttgtatttgtatgagaaaatttttggaagaatgtgaatgtctgttaatacgaagctggctaaacatgtaacacattgatacaatggaatagtaggtatcaaaaagtgccaatatatacaacaatcctaataaaatgttagcacctcaaatccatcagttaattaaaagcaatatattaccctaactaaggataggatttgttccaattaaaggaggaaaaaaaatgattctcctgagagacacagagaactcagttgacaaaattcatgttcattccagctcaaatcagaaggaaatttttccttctaaaatcagatggaaagttttattaacttggttaaaggtatgtgatatttagtagtgcttttctccaatgtttctagttttcatcttcccaagcacaatgtgtggtattagaaagattgaccatccattgcggaaaaaaaaaaaaaattgaattaggcccctgttttgtgctacaattaaaaactagttctagataaagaacagaactagtcaataatcgggagaaggtgcaggaaaatatgcttataacttctgatggtattacaagcaagattcacactcaacaatccatgccaaaaatgatgaatatagttgcctgcataaaaatgtattcctctgtaccataagagaatgtattcaaaagttaaaatataaggataagactgtggagaggggaggagtggggagagaatggggggagtgggaagagaatggggggagtggggagattgttggtcaaagattacaaggtttcagttgcacaggataaatactttttggagttctatcacagagcagggtgactgtagttaataagaatgtcttgcatgttcccaaattgctcaatttcaaatgtctcatcacaaaaaatgataagtaagtgaggtgatatgtttatttgcttgatttaatcattccacattgtatacctatatcaaaacattacattataccccatacatatatataattatgatccatcaattaaaaataatattaaaaataggaatagcctgagtgagaatatttcaacagaaatatttttgaccctgtctcaaaaaaaaaggaaaattgatactttgttaatatgcaggattggtgaaggtgaggggaaatagttactctttttcactgttggtagaaaaaggattgccgtctagaccaaccctatctgacaggactttctttgataatggaaatgtcctctctgcgctcctgaacaggacagccactagcaatgcggctagtgagtacttgaaatagggccagtgtgactgaggaactgaattttaaatttcacttcattaattcaaatttagatagacaggctgggcacagtggctcacccctatactcccagcactttgggaggccagggccagtggatcacctgaggtcaggagttcgggactagcctggccaacacggtaaacctcgtctctactaaagacagaaaaattagccaggcatggtggtatgcgcctgtaatcccagttacttggggggctgaggcaggagaaccacttgaacccgggaggcagaggttgcggtgagctgaggtcatgccactgtactccagcctgggtgataaggcatgactgtctaaaaacaaacaaacaaaaaaagccacttttttttgatagacaaatagggcaagtggcgaaccatcttgacactgcagctctagcgtttataaagaactcttcttaaagataaaaatagtaaaaagataaatagcagacaaactagccatgaatgtgaacatgcaaatcacagaaaacatgcaaatggccaataaaagagtaacaaatattgaaccccctcctttttaatgaggcaaattttaacacaataagatacctttttttggtaaaaatttgtgagtttggcctggcaccgtggctcacacctgtaattacagcattttgagaggccaaggcaggaagattgcttgaggccaggggttcgagaccagcctggacaacacagcgagatccccatctctacaaaaaattaccagaattagctgggtgtggtggcacatgcctgtggtcccagctacttgggaggcagaggcaggaggatcacttgagtacaggaggttgaggcctcagtgagctaggatcatgccactgcactccagcctaggcaacagagtaagaccctctctcaaaaaaattgagagtttgttaatatgcagggttggttaaggagagaggaaacagttactctctttcactcttggtagaactatatattgacatgacctttttgatgggcagttttgcagtatctattaaaactttaaatgtgtgtagccttaatctagcaattaccatttttatggatctcaataaattcattataaaattcacctagaatagaaaaaaatgagagaaaacaagaaattttttcaaaaagaaaaataatgtgagaagtaggcttttgcctcaccagaaatctcttccctagagaaatattaaatacaagcacagaggcatagattagatgttaattttttaaaaaacaggtaagttcaggttttgatgatgtgatgatattatagggcaaccagaacactcacacaccactggagagaatgtttattggtacaactaccttggaaaactatttggcagtatctacaaaaactgaacatatgtgcatgctaacgatatgttaaaaagaaatgcatagctatttgcaccaaaagacacacaaggccaggcgcagtggttcacacctgtaatcccaacgctttgggaggctgaggcagatggatcacttgagcccaggagttcaagaccagcctgggcaacgtgacaaaaccccgtttctacaaaaaaatacagaaatctagccaggtggcacaggtctgtagtcccagctacttgggaggctgagctgggaggattggttgagccctgggaggtcgagggttgaggctacagtgagccatgatcacaccactgcactccagcctgggcaacagagcaagaccctgtctcaaaacaacaaaaaagtcatacacaagaacattgacagcagcaccatagcaacattcagaatggcctcaactggaaatgccccaattgtccatcagtagtgttatgggtttataaattataatctgttcatgcaccagaaagctctacaataatgacagagtgaactgttgctacatgcaatcatataaataaatttcacaaatgttatgttgagtacaaaagcaagacagaagagtacatttcaaattattgcaattacatacatgttataaacaagcaaaggtaatgtatggtggtagtagtcaggataatggtaaacttgaagggaagggagagtgactgtgagtgatgggcatcctggcaggggttagtccccttagtgtctggtccctggttccttcatggaagtggggcctgtttttcactggtccatctcacacaggatgctacatcagcagtcaagatttatttctccctgcttcccttactcctgagacccatgcattgagaaataggagcttaatcttttctggctggaggcttccttgcttaattttagtaagtgaggctgaattggaaaccctagcaactgaaaccatttgttgtctggtaagcaggtccttgaatggagattttagctggtacttgaatcaatgtgttaatcattaaagggttcagaactgtgcctggcacattttaagcacatatatgtttgctttgatttgtattatgcctttttacatatccaagcttaacatgtatctcccttttctcatctccaaggcaaaaaatcatatgcagaaattttagaaatccctatacacacctaggttccataacatttactttctccatcccatcatttttttaaaagtttattttgattacgaagtttcaaaggtacaaaaaagtacagaaaataatatgacatataactacagagcctctacttcccagatgtgacagatgttgatcttctgctgtttctttcagatctttgtgtgtgtgttttcaagtaagcagaaatagctgagtcctcccctctgttcctctttcctctcagggaatttctctctcttgaagttaatatttgccatctgacttttactctaaatgcatctattaagcgatatagagtcccaatttaattatttaaactattaattaaaagttgaaataatatacaatcctgatgatcagttttttaaacatgtctttagcaagcaaagaaaaaagcttcttgaaacaaagaaatgtccattcaagggggatttggtggggtaaaggagtcctattcacactcagtaaagtttctgccttgtacataaacccactttctgtagaaataactactggaccatagcccatctaccaactcatctcaaaattttaagcactggcatcatctaccacacaacccacaacatatgctgcatggaatgtccgacagctgaatgatcaaggtatccacttctggtctacagcatttatgggtggcacctgctagtggctgctggcctgcttgcctgaggccagggacagctgtgacctataggtgaggcccctgtggttatccaaatcctttcttgccctttggatagctggccctgggttcttttttgtgacttacccaggagtttgtagcggctatgctgacaggtgctctagcacctgttggaccaaagactgggctgttgcatgtcacctgacattagacgtgatgagttgcccaggtcctaaagcttcttctgcaacaaggatttctgtctccctggagtggctcttctgattcagccattacctccagcccctatagagacacctctagggcttgtgaatgccctggcagccgcacaagatctgatcattgccttgataagcatttcttggggagctccctgtgcaaggcctgcagtagtttcatgagaattgcatgaaccctgctgcctgaaacgacagaaacatgtatctccagcacataggtatctgggagtactaaggaaattcaaacaaggggagatttatgctagcactttcacaactgccaccttggaagtggcccttgatgagctggtcctattgtcccccatctcccatcagccacagctgccaagataacaaaatatgagttctgctccaacatctctggggtgtgagcccttcaggggactcacaccaattgccttgcagatgatctttctgtctcagccgagccgtgcattaggtaatttgggggtgggcggctgtctcctggcctggaacctggctccaaggcgtccactcaggcattcctagattgctttaggagctcacaccttccaaggtggtttttggattctctggggtctcatttgggtgtgtctttctccagctgttttttgaaggcaatagcctattctcctggtatttcctgcttcttttcattatcccataaaaaattacctttcctggatgccgtcttattaaggctttattgttttctttattggtacttttattggtagcagaatagttgatatgtgataccataagaattttagggcagggcgtggtggctcgtgcctgaactctcagcattttgggaggctgaggcaagcagatcacttgaggtcaggagtttgagaccagcctgaccaacatggtgaaaccctgtctgtactaaaaatacaaaaattagccatgtgtagtggtgtatgcctgtaatcccagctactcaggaggctgaggcaggagaaacgcttgaacccaggagagggaggttgcaatgagctaagatcacactactgcactccagcctgggtgacagagcaagattctgtctcaaaataaataaataaataaaagaattttagagctaaaagtactatttagttccagaattattaatctaatttcagagcgaatgggattctggaggcccagagataatgtgaaactaaatgcagtgttttctgtgcatttcagtggaaaaggtccgaaggcctttcatcaggttcttaggagttccttgagatagatgatagatagacagatggatagatggatgctaggaaccattgacctatcgtattcattcactgcattgcattcacgaacctatattgcattcaaccaatatcagacactggagccagccactaacaaagcagacacagctctaccctcgtgtagctaagaatctggtggggtgaaacaacaaacaaacaagcacacacgactaatgaattgcaggtagtaatgagtgctgcaaaggaagcagagtgaaaggataagggatggggaggacctgtttggaagtgtgaacaggggaagtcctgtccacactgagacctgaaagatgtttaggagtggccccgaaaagccaggagaaaagcattctagtcaaagagaacagcaaacgcacaggccttgagaaaggaatgaaactcgaggattggagaggtagaggggcccgatggcaaagggagggagagtggggctggatgggacgggaggggcgggaccatgcagcgggtaccatgtaggaagccaccatcagcagcctggggtttttacaaaatgcagtgaaagccatgttaggggattgggcgggggagtgaggtgatggtgctcgtgtttcagcaatatcccatggctatcgatggggaataggaataagggacacgggccaagagtaagcagtccaggcgagagacagtggtgacctggcctagagcagtggaagagaagacgggaaaaagaaggtagaatctggatgtatttcagaggtgaaactgatgagacttgcccacgggttagacgtagggaagagaaagggaagaatcaggataatggctgcgtttgcagattgaacaactggctgaatagtgtgctgcttcctgagatgtggaaacctggggaggagagtcacggttggtttaagaggtaaagtcaagttcagatttgaacatattaagactgagaagaggctgaggtataaaatggtcacactgagcaagaggggagcaagcttatcaaggaaatgtagtcagattgcctcaggcattgggtgcccatttaagattttttttcctttcctttttttttttttttttttgagacagagacttgatctgtcgcccaggctggattgcagtggtgcaatctcagctcactgcaacctccgcctcctgggttcaagcaattctctcacctcagcctcctgagtagctgaaattacaggtgttcaccaccacactggctaattcttgtatttttagtagagatggggtttcaccatgtttgccaaggtggtctcgaactcctgacctcaagtgatctgcctgctttggcctcccaaagtgctgggattacagattacaggcatgagccactgtatctggccccacttaaggtttaaaatcatgaattaaacgccgaactgtgtccagccatgttcagctacttaggtgcagtcctcaagagggcaggtgaagagttcatcacaatgttgcagtgttaccagctcatgattttgaaggcagagagagggccaagagaattgaggctactcgtcaggtgcaactacagcgattgtggtggagacggcaatgcattcatccaaatccattttcctctccttccttcctacatttccctgattttcttgcaggcaggtgtggccctgggactggttctaaccagtggaatgggaacagaagtcttgagggccgctcctaagcttggcccattaaaaccttccagatgtgtctttccatgctcttgtccccgttgagctgttttggtgacctctgggggaaccatagaagctgctgttgaagacggcacagttgcagtcagtttgtgttgctggggcctgtgtgagaccactccaccaccacactcatattcaacttaccctgacacctgtgagctagattatgtgagctagaaattaattcctcttatcttgcgccattacacattttggtacatttgttactaaagccatgtctgccccaactagtacagtgacaggtcatgtcagagggtgaagaaggagtggaaactgatgagtcagagggccacatgggggcccatatcttccactgaaacctcagagagctgagtggctcacctagagaaactagggcagtggttcgcaaccatggctgcacgttaaatcacctgaggacccttagaaaaccctgaggcccagaccgcccagaagaccaatcaaatccgaagaccaggggaaagagtgaggcccagacattttttaaagctccccagttgattccaatgcgcaaagtggagaactacaaaactaggatgaataccaacggaaccagattcaaggatctttgtccagtggggtttcacagccattttatgatgaatagggcacttataggagccttatagctgagtaagggaacactgcatccaagccatagcagacaccaacaaggaagtggctgtgcttaagatccagagcggactggagatctcaggggatgccaattggttacagagaatgaccgtgaaccagcacctccctccctccactccagtacagctcaggagcagactaaaaaggcagagagtctttttgttttcttttgttttgtttttcttggagaaagagtctcactctgtccccaggctaaagtgcagtggcatgatcttggctcactgcaacctctgcctcccaggattcgagcgattcacatgcctcaaccccctgagtagctgggattacaggcacccgccaccatgcccagctaatttttgtatttttactggagacggcgtttcaccatgttggccaggctggtcttgaactcctgacctcaagtgatctgcccgccttggcctcccaaagtgcagggattacaggtatgagccaccacatccagccagattcttgaattagatgggattcaatttgaaataacccactttgccgccagttggctgagatttacattatctgcttctatcaggaggaataaaagtgtcacattgagacattgggttgtatggcttcagaaataagtacctgctcacctgcattttaatcatgagcattttgttttattttatttttttcaatttaaaagcaggcactgtttattaattgaccagattagaaaaaatcctggtagacaccttagttcattctcctaagaagcctattgatccggtcttccctgttgccagcatctccaccttctacaaaataggtggtctttttcttcattttacctcatggagaggataatttgaagagccgcaggaagttattagcttcttttaagtgttttccaacagtatagatctcatgaatcagatcctccatgcaggcgatgccatatttaccaagagatcgagcaatcaacgtgttatctgccaaggcaattcgcttcttactgattttgccataaccaggcttgtagatttttactgacttcaggcttggttacccccatgcaatatgtggttctacgatcctcaacatgttaattgaagtcttgttgtgcttaacaaagattccactgaagatttgacaaaggcaaagaagctacaacacctttcagacctttgggctcacatcattgatacctctgttcctgatgacaaacgccaatttgggttctgcaggtacttagaagttgtcagcttttcttgccatccaagccatttgaatttcagttctgtatatatgtctgtatttcctgtgacaatgcttcgttttttcgtagataagcttcctccttgcctttcaaagcatcttttaggcaaaattctttctcaggtgctcgatgttcagctctgcaaaattcctttgctttttcttaagggtttgggcacagcaggaaccttcttctctttgatacctccagggttccagtggacaagagtgcattttgttttaaaacagcctctgttgtcatctctaggactcactgtaatggtggagatttcaggccctggtccatccacatgaaagagattttttgtggcaatcggtactcaaagcactggtccagttcatgccctgatcctttcttggatgttacccaagtttttggccctggttagctagcttacaggcagaattcagtgcaaactcatcccctcagctggcaggtacctcaaggagtctatacctgtgtccatgtctgaatcatctttatttccttcatcaaattaaccgcaaatgttttttgcttattgtagacattcaaaaatactaacagattaaaggataatagtaaccataataataataataatgatgataataacaagacatgttccactcatacttttttttttttttttttttttttgagatggagtctcgctctgttgtccaggctggagtgcagtggtacaatctcggctcaatgcaacctctgcttcccgggttcaagtgattctcctgcctcagcctcccgagtagctgggattacaggtgtgcaccaccatgaccgactaatttttgtatttttagtggggacagggtttcaccatgttggtcaggctgatctcgaattcctgacctcatgatccacccacctcagcctcacaaagtgctgggattacaggtgtgagccaccattccctggccccgattatacttattcaatggcattgctcatacttgagggctcctccatgtgccatttttactgtaaataaatttcgctataactttaaagaaaagtgtttaattgtctctttaattccttcgtcttttacatagccttttttacattctgatgttttctaaattttcttttataacattcatatgtttgcatttgtataagtaaaaaggaatataaagaaaaatatttcaaataatccatactcttaccaccctgatgacatctgtcaaaaattttttaaagtgcatgcatatgtacatggttagaatgtttgaacagcacatgagagtatgaaatgctaggagaaagctgcctgggacactcacatttaccctgccctcagctcctttccccatagcaatgatgtaagtgactattattcctttcagaaagtgaaatgtctatgtgaagatgcaatttaatatatatatatgtacatagactgacagatacagacaaagacatatacagatagataattgtaatttacatagaaagaagcctatcattcttagtgttctccaacttgcttttttcaaggaatgtgtcttagagattattccatatcaacacatatggactcacctcgttttttaacagcagcagaatattctatagcgtgactatgatgtagtttatatgacagttttctcctggacttttaaaagttttcagattcttgccattatgaacaatgctgcaaccaatatccttgcagccctatctcggcaaatttttgtgggtaaatttttatatgctaaatttgagttggtgtttaaaatatctcaagaactaatatatatgatttgaatagtaaaaactgcacattctggccatcagagagctgtagccctgaggttaactatcctgagaggaagagaaagagtgatttgcctttttctacatctccgagttctagagtcaacgtgagcagaggcaaacagtcaaagaaagctacccacttttctttacttttaaagtcaacacccaacctatcagtgatgtttctgtccctgggtgaccagaaatggcccaggaacttgtgaattccaagcagtttgtctcaacctcaagctcactcactgcatctgccattttgtctaagcaaggaggggatcaaggcaaaagaagatgaaggaatggctgttgtgaaacctgctgctgtctcatacccagcctgagacagcctgagaatgcacattggaaaactggttagcatttactctttaacagaaaatgtggaatataaacacgtgcccaccaagccaaaagggtcttccagtttcccttcttggaggaagagatttgtctagaagaaggatttttcatccttggcactgttgacatgttgtgctggatggttctttgttgtccatggggaagtgctgttctgtgcattggaggatgcttagcagtgtctctggcctctaccgactagatgcctgtagcacccactccccacctcacccacagttgtctccaaacgttatcagatgtctctcttgttaaaaaccactggtctaggagcacacgcacacatatgcacatgtatttgtgtcatatatttatagtaggtaaatagtattctcttatatggttgtactataaattatttacccagtctcactttgataggtatttattccttttttgaattattttgtactataaacaattccgcaaggaatatattctgcaaaggacaattcttagatgtggaattgctgggtcaaggctaagcacatttgacattgtgatagatattaactaaattgctttccgaggagaatgcaccaatattcactcttgctaacaatgtatgagaatgcctgtttctatacgcccttgccaactcagcatgttaacaaaccttttcatgttttttaatctgaaaggtgaaaaatggggtttttctgtcacagctctgcctctgtgttcagttctagaacaggtagtctaaagggaagttgctcaaaaatgtaccctcatagagatccaaagcccaggacagagaattctggagaagaattctgataaagcacttcagtttcttttttctttttctaggttaggccaaatccaacttatctaagctgctggaaattgcaaatgattctcaacgagagacccagccccttgaaactgtgtgcttaattcacacgacatgccagagcgtgatttctggaaaggctttttgcattcctgtagatccatatgtgataaatacttttatcattttctgtggcgttcaccatcatggtgctgagaggtgctgtctgctttcatctacgtgctgaattacagatatacatgatcaaataaagtcaagacaagaatcaaacctcataaaaatcttgcctacagcatgtacccaaaaaaatcagtcatgccaaggctatgcaggccaagtgaagccagaagttgtgcaattacccagaagaggttgaaatttctgacaaaaacagggaccttattgaaaatgtaagcataaaatgaatcctcattaaaagagaaaaaaaagctgcttcaatactttgctaatgtgaacactgaaagtcataatttctgacctccagtatgtacttcatctgtgaagcccacagtgaaatagattttccattccccaattttctgggttggtcactttggctcttaacttaaaacaagtttttgaatcagaccagagtgttccacactttgcagttgcctgattgaagacaaagatctattctttcactcaggactcatatattggaagcctactatgtgtcaggtccttagctagactctggggaaggtactaacgaggaagacaccacggctgctggcctgacctcacaacagagaagatctgagaagagaggctggggactagcagaatagaggagtttgctggtgtgtgcagtggcccccacgcctaccagtaggagctcttggggtttatcatagtccagtccagtctgaaatcaagtgaccagtgcaaagggctcttggctactgtcaggaaagtaattagagtgtagttctgatcacctcctgtttactctcttggtgaaggagggatcccttgctctaattaatatgagatggccaaatacaagacacttgacactgggtaggtgaggttggcaccagtctattagtcacatatcctcacagccttggggaggaggataccgcgcaccatgtggagccacattggggttacactcggggcagagggaaacagcaggggccgtgggaatcaggccttgtagtaacaagagggtgaggtgtccccaggttcctgcaggaggatgtcattggcttgttttgataattttacaggctggcagtgacatggaacctattaggtttaggtccagatggtgtgcagctggtctggctgataggggaactagctgggtgaagaatctttcctgctgggtgggggccatatctggtgagagaaagcagggggactcagggtgagaccttttggatctcatgagggtcaaagacggtcaaggcagcagcacatgatatttcaggccttacaagatagtctgttacatttcttactgacaattttccttctctatctctatctcttcaatagtagcccaggattatctttgaggatatggaccaaatttctgccaactacagcctgaatacaagcatacaatcaacacttgctgaacaactgttgtgatactgattttctttttgtctgtctgacgtacaggctcccttcttctggtaatagcatcccaatttggggaaaatagctcccctcactttcagtccatgtgcccctgaggttttgatgagtctgaatccccttccaggactccaggggtgggagagccactcagacatgcccaatcagagtactccatcaccctggccatggtgattggttaagagagacatgtgacctgggccaggctcaactctgggactttgctaataagaatgtaaaataaagctcttttttgatggagatcgttaagctggaaactataagaccagagttgaggccgggagtggtggctcacacctgtaatcccagctctttgggaggccgaggtgggcagatcatgagggtcaagagatcaagacgatcctggccaacatggtgaaaccccggctctactaaaaatacaaaaattagctgggtgtggtggcacatgcctctagtcccagctactcgggaggctgaggcaggagaatcactggaacctgggagttggaggttgcagtaagctgagatcgcaccactgcactccagcctggtgacagagcgagactccgacaaaaaataacaacaacaacaacaaaaaaaaaacccagagttgttgcaggaccagctgtaaagagggcctgcatgggagtgaaggtgacacagaggggcaccgaatgtggtggtggtgttgggggacaggatctgaatggatgatgtcatttcagcttctaatccagcaatgctgggattgtaaatatccctgaacctttcagtcaaacaaatgaatacattctttctcttttactttttggcttaagttggtttgacttgggttcctgttacttgcagctgaaaagctaacagacagccagggccaggtgcagtggctcatgcccataatcccagtactttgggaggccgaggtggggggatcacttgaggtcaggagttcgagaccagcctggccaacatggtgaaacactgtctctattaaaaatacaaaaatttgggtgtggtggcgcacgcctaatcccagctactcaggaggctgaggcaggagaattgcttgaacccagggggcggaggatgcagtgagccaagatggagccactgcactccagcctaggggacagagcgagactttgtctcaaaaaacaaaacaaaacaaaacaaacaaacaaagacctactagacagccagaagtagagtcacttgtcccttttgaacaggaagggagcagtttgtactaaccctgctaacgatttaatctactacttattcctgattaccctccttaggtaacaacaatgcaacaaccttccagtggtttaaaaaccaccccctgccccctaaccttgctccagccgcacgtgtgctctttctgttctttcaacaaaataacctctgtcccacctggggaactttgctatttcctctgcctgagatactcttctccaggtcttaatctggccactcggcttaaatgtcattgcctcagagaagcctttcctgaactcatagctaaggcattggcccaattactctatctcatgattattttcatcatagctcttattaccatctgacattttcttgttggtgcattttttattgtctgtctacccccaagactacaagcttcatgagaacatcgatcttccagggaagatcgatggaattacttcctggaaataccagggcctgaatagtgcctggctcacagcaggggctcagaagtttgtggaagaaatcaatgaaccacatatgtaactattatttatgttggtacatgtagcttatggaagcactttaaataaccttgagtaagataatcttactcaagattatcatcttttatgataaccttttatcatcatcttttatatggaggaaaattgaggtttggagaggttgagcaacgtgcccaacataacacatgtaggaaatggtggagatgtgatttaaacaaaggaacttttgactcgaaaatatgtggtcttgccatttcagtcactcccagatttgtctccaatctcaacattcgaaaattcttacagatataaatccttgctagatcatgagttgcaatctggaactgatttgtgttctctctgtagccatcacagagaactgaccgttctctctgtacaagatctttggggacatccagacccagaattggtctaaatggacatcttaataggcatggtagagtctgataatgcctggaatgcatttcaaaagagattactgaggggtgactaaagggttcttggtaggagaggtcaagcctttaaaagaaatgttgagacaaaaatacacaggcaaagaggacagtagagagagatcatgatggttatatatgcaagggtcgaagtgggtgggatatcgggagatgtgtgaaatgcagtctgtctttggatagaatataaaacatgaaaagaaaataaactcaaggtttgaaattcctgtaattgacatgtgaatatattgttggttgtggagagaatcacaaagtctgaataaactctgtacaggagaaaaaatacaatataacaaaatgacaacatataatagaaattgaaagacttatttgaagttcaattgtgtaaaacatccagctgtcaaagattcaatttcttatattttaaaagtttgtttaatctttaggtggacttctacatgcaagaatataaactgagcaaagaaaagctcttttatctgcttctttgagaacctgaattcatccttttcatcatcagccattcaagaataaaagcccatgtgatattaaaataagaaaagtgaaaacgcccctttcaatacctgaaaagggtgtaatgggccacattatacatgtgtatgtgtcagtttctggtgtttcggaatagccacatggtggacatggaaccctacggctttgtgtaataattgcaaacattttattattttctgtgattttccccctcaattcagagcactgatcaccttaacacattcatacttataaacattttccaatggtcttaatattgcccaaactgaagttgaatttaccattgtaaagcatcgtaaaaatactttatactggatatattaactccatatgacggttaaaattggggaattgagtaaagcatagaataactaaaatattttatcacttaattttttatcctgaaataatgttagacttaccaaaagttttaaaaatgctgcagaaaattcattgaattcttccataaggatagtatgattatcaaaatcaggaaactaacattgatataacactattatatatactcatagaatacagaccttactcaaatttcaccagttttcccatttctgtctcttttctgcaccaggatccaatccagaatcccattttgcctttagtaatcaggtctccttgatttcctccagtttgcaacaggtcctcagtcttttcttgtctttcatagtctggacacttttaacgagcattggtcagttattttgtaaaatatctccgcaattgcagtttgtctgatgttttcttatggttaaattcaggttatacatttttagcaagaataccaaagaagtgagatgcccgtctcattgcttcatatggtggggtacatgacgttgatatactttgttactgatgatgctagccttgttcacttgcttaaggtggtgtctgctgggtttctctactataaagttactatttttctccttgtaattaataaatatcttgtaggagactactttgagactatgtaaatgtcctgtttctcatcatcctttcacccactgtgacaattattaacagtggtgtctgcctaatgatggctttgcattgtccttattccttgtacattttttagttggaattctttggtcaggaagatctgtaccatctctcccatttatttattcacttaattatttatttgtatcagtacgggctcatggatatttattttattcctttgacatgcccccatcattttttgagcacttccttgttttctggtaccataagttcatcttgcttttttcttgccccagtcctgaaatcaaccatttctctaaggagccacagttccttagccatagtttattgtaaaacggcacttattacagatctgggtgtttatcgtagaacttgcaatagaaaacgagtgtacaattttctctctctggcacacagacattagggatcttaaagctgaagaactttccatgaacagaacaaagcagattctgtttttatctctaggtttaattaatagtgtagaattttgattttctgaaatagttacaagtcactagatcctcgatgtaacaagtaagacatagttctcttatatgtggcatttctcagcaagatacaagtctttatagaaagttaaatttggagggagaatttactactaatttggggtaacagattaaaaaccttcaatttttaattatttatactcatacaagatcgatatatagaaatacgtattagattttttttttagatactttgcttgggtcacaccatacttaaaaagtatcaactttgtgtacaagtattggagacagaagattgaacatggcatagtccctgtcttcaagtggctcacaaaactccttcgaggctcattttaccccaatcacttatttgctctagttttccctggttcgggtaaactgacttttttcctctgtgaatccattcttttccctgaccacctccctctggtcattcttctactccataagtcatttccgtttttcttcagcccatatacctcaacttcaaaaatctgcttagatttttcctgctggccgggcacggtggctcacgcctgtaatcccagcactctgggaggccgaggcagacgtatcacctgatgtcaggagttcgagaccagcctggccaacatggcgaaacactgtctctaataaaaatataaaaattagctgggcgtggtggcgggtgcctgtaatcccagctactctggaggctgaggcaggagaattgcttgaaccccggaggcaggggttgcagtgagccaagatcacgtgatgcactccagcctggggacagagtgagactccatctcaaaaaaaaaaaattttttttttcctcctccaagaagtcccctgctaacatgtccagtctcatctagttgtatctttctccagctcctgaggctaaggagatattgtcccacaggcatctcaaattcaacacaagcataacggaactcatcctatttctttctgtccagccccagctccttccatcttgtcttcctccagggttccccacttaaataatgctgctactgtccacccaggagcctgaacaacaaacctggtggggacaactgggatttcttgaccccccctaagccctggttcaaaggtcagcaagccagtgagttgtgacttctaaacagctttctattttgcccctgctttctcatttgtatcaggaaactgccttcattcaggtcctctttcttatctcaggtagcatcggcatcaaataggtcccctgagaagtagactcccaaagattctggtgaaggtagagtgtttggaaggtgatcccaggaagtgagagaggggaaaggagaagaggtaacagaagtgtgcaaatgggtaggtcaccactgctgtcaatgggtgcccaatctactgggacatcccatccctccacaagagacttgggggagcatgcctcagaaatgtcttcctgagttttgaggaagctgggatatttatctacgaagaccagccctctaagctagagcatgctctcaaacacagacacacaggaagtcatcagcatgtgtgggaactttgtgaagatctttggagatgagggcgggagggggtctgacaacatcagtacctcctaactggttgttttgcctccaggcttgctctccccaccaaccactactccctaagtagtctttctaaaatgccaaatagctcaagctcctcacctgcttaaaatctgtcaggggttcagaataaaatccaaatggcttgatcttgacatgttaatgatctgcgccatctcattcccagctactcttttagctgcttcccagtactcaatgcagactccaggcacactgtgctagctgtcgggtctcagagccacactcgaggtccccgcacacagcgctccctctgcctaaggtctgctcataaatatttaagaaacatttatttgattttctaggacattccaggcattgtgctagacacagtgaatacaataaagaataagttacagttttagtcttcaaggagctcactctctaaagggaggaaacagacatacaaaaagaaatacactattcgttgagtaaaaccccatattagagaaaatgatgcctaagtggagacttgatggattgacttgatgcagagtttaccctgcagacaggaggaaacgggctggtgtgtacagagaagcttctcaaatttctgaatggagaaagtggggtgtcaggaagaagaggtgagggagaagctggccaagtcgtcaggggttcctttggcttctaggcagcttgagcattattcttctcatcaagacacagtgagggcccttttttcatcctaccaggaggttttccagattcactgtgggcattatgtcctctaagaagcctaccctaattcttgtccctccttagacactcatcatctgtgctcttcctgcactctaggaaacccctcatgatgggttgtgttttaaggtgtatcctccccacggcctgccagcccctttgaagaaagggctgctctttctcacctctgtatctcagtgcctggcccagtgcacagtccctgcagctcagaaacatctggacccctgagtgcctttaaggaggccagaggggaaagactgacagatgctgctcctcagttccctccaagccagtggcacacgtaagtgctcggcacagggtctttctgagcgctcgaagttgctagagacgctagacttcaggtataggttttcaacagctgaaacagaggctgtggcaatttcctaaaattggttgcttttactacaaataacagtgattgtgctctgctaatagctgtgctccacaattcttaaacttagccttccacttttccttctctccttcctttccttccttccttcttaccactgcctgcaattctcagacaagggctttgacatgcagagtggtggggagagaggtgctctttaaggtgatgcaaacactcttttcatttctgctgtggctggactcatagttgagttctctgcttgacattttgagggtaacaatagcattggaatgggtaagggctgggcagtctgagctgagtcttctgtgcctcaggaggctcaatttctggaagggtgggagccggagtggagcaataagggtgaaaacatcttttggaacagtctgttttcattgcctcttcttccagggtgacagcaggtggcaaggagagggccactgatcactgtgcccccactccagaccctaagttttaaaggataagtattaaactcttctcgtcctcttggagcagaagagccaaatccagccggctctgcagcttctggcaggttaaaaagcatgcatttccacatgacttgctgatttacaccacattttgacatgttttaaaaacctccctgcagttccttttgctggctcccctgaacactggtgttgtggagctctgagcagagctccaggtttattttctggcgtctgctgtctatgtgccgcctttgttttgggctctccccagcacattgccccgttgtccttgagggaggaagccagccagtctctggcttcctttgtaacttcccagttcctccactcacagcctctgctcatctgctcacccaccccaaccactttgttttaagtgctgcgggattgaatttctcatcttcaaatgcaaacaaccatttggcttcgtgtccattacacaggcacctctgggggcacatgcaggcactgtggccccgaaaaactcttcagaggtgagcggctttcaggatgagagggccaacaatggctcatctcctaaagacctcgataaacataatcagtagccccagaaaacacaacagctgtcccaagcctatcccctttgcacctatctcagaaaaggcaacatgcagagtggtcaggagttcaagtcctcagggccctactctgaagctgtgaccctgacaggtcactttagcgctcagcttccctttcctcatctgtaaaatgggaatagaaactgaatctgcttcatggggccttgtaagtattacataagctgtcatatgcaaaatgtccatcacatagttcaccgccccaggcatcctagaaactattaagtcacgataaggaggttgctactgtcctgggacctggggagctcggctgtccagtccgaaagggccttctcgccctcgagaccccttcaagtccctttctctccgggcccgggtcccagagtccccttgtgcttgctcctgagggtgacctgcccgtgccccggggcgagcacaggtgcggccctggccacaatgcgggcgtggcgagccgacacccggggaggccaagggcgcctcgagggagggagggaggaggctgacccgggcgtcccgaaggacccgcccggccccggactccgggcggcagccggcctcgcgccccgcccccgccccgggagccccgcccagtcccgtcgcgccgcgccgccccaccgcccgggttggctgccctggaggccacgcgcggcgatttgccacgcgccgcgtcaccgggccgctcccggcctgggctcccgggggctggtcagggaggtggcggcggctgagcggcggagcgggggcggcagggcgcgacgccgccgggccgccccgccctgggaggcgcccgggccctcatcaagtgaccagtatcccttccaggggaacacggtccttcagaggaaagcgagctccaacccgcggccccggcgccaagccgccgtcatcttcttcctgtgccaggtgatcgtctcctcacccacccggaaaaacatagtccgcccccacgtccttgtggaatagcgcccgcttccaagcaccgtgactctctttgccctacccttgtctttcccattccaattactctagaacccaccgagaggataattcagtcctgaaaagaaactgatggggagaagcgaggaagggaacccaggagggaggggaggcagggctgcggagggacaccgaggcggcggaggtagtgcgcacgcgcagcacagaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggtgagggccgcgggcagcggggctcagtccgcgacgccggtagtgctggaggggggcggcgtctcgcttaggggaccgagtaggggttggggtggaggtgctggggcgggggacggcgcggccgagagggtcgcccggggggctccggggacccctggacgaggccgtgtccggcttggagggggccagggtcgcgttcgcgcattggcggggcgggtagggtgctgggaggcgggtagggtgctgggaggcggcgaggggtggtcgggtcggggtcggcgctgaggagctaggcgcccggggaggtgggggcggggtgccctgagggcgggccggtggggctggatggggctcggctgggcgggccgaggggagctcagtcgcgcgggctggtggcgagcagcctccccgggcgcgcaccccttggggccggggggcggtggtggacgtcgcctccttgaaagttgaaggagttctcgggagaccccggagaaggtgcgctctgagggccctttccttccccttttccctccaagcccgggggtctccccgaagggattagccccaagtgcggggggccttctgccctgttggacttgaagaagttcccccacttctgctttgggagaagattggtctaacggggtggaacgcttaggtacgaattctgtgagtgtgtagatgtcagtggcggggtcggtgtttggggcggacacctgcggttgcggacgcccgatcgtgcggggagacgtcgcggggacagaggggctgcacagggaaccgctggctgaacccctgccatccggctagatcccagctcgcagaaaatattttttgtgttagaaactttgctttttggctcgatttcatgcctttgagctgtgagggttaaagtaagtgagatagtgcaaacaagtttggaaaaggtgagcaatcctgaataagaaaacagtttttctttaaaagtgtaactatagaattgttgctcacatccgaaatagattccggagctgtgaagcgagcctcctgttatggtccagcagggaaccgtgtgtagcttgaatataacatagtgttaacctgcgttttagtttacagtgagattgggattccaataaatgccctattagaaaggcctgctgtgatgtgttaacaatagcatatgtatttttaaacaaacattgtcttaacattttttcgggtttttagcacagtatgtttcccatgtgtcttgtatcatctattactatatgaagaggaggttctctaaagctgtaattaggtgtacattacccaagagtactttccctttaagaatccagctgtgttgttttggcaactgctaagtactctagttgtcagttttagaatctgtgttaccttggcagttcttgaacagtctgtggaaaaggtaaacaaaatagttcttttttaaacatacaaaaatgacatttcttttaatatgaatttaggaagtgaggataaaaatgactgcattgtgcctttatggcttttgtatgtactgtgtgtgtgtgtgtgtgtgtgtgtgtgtgtgtgtgtatttttggagagctcagtctccatttctttttctgtaaattacaacttttgttttagggaatcaagagttttcactaaagcagatgctgatttagattagtttatattaaatgtcataaacacacacctgtatatcataaaacattaagatcagtatttgttatatatggtgacacattgacaatagaatcacctttattttaattctcagtgagcattgttgcaaaaagttgtgataatggtgttacaataatcaaaagtactctgaagagctaaaactggtgatttgaatgtttgtagactctagattaacagttttgttgaagagtgtggttccagtagctacttagtgaaaacagtgactgtgaagtaatggtgacctctctaaacgcaattatttgcttacctatttcctttaattcacactatggttatatataaaattgtggtttgatttcatattagaacaaaagtgttaaaattacactttacttgccttcaaaagttttttaaaaaattaaattctggggggtgttcagtggaaggaaaatagcttattgacacccagaaataattgtaatgtcaccatgttgaattatggtttgagaataatttccttctgtattcttagagtttgttttcatatgggtatgtgtgacaaggatttttttttgtaaatgcagttggaaataatctcttaaaaaggttgagttgtttcaaatggtgatgttatgtttttcaaagcaatttcgttacaatttgccttttccatcatgcattgtgggttaatattaattttattaatattccagcaatagcagtgtcatccattaattggctaccaaaaagaggaatattgaattatattctgagggtggttaagaaattatggaaatgtttattagaatatgattttggagtttgaaatagtctagctaaatcttttcagtagatttgtgttctgatttaggaggaagaagccatgaacaaatttgttactgaaaaatagcatgcttgtcagtttggaaaaccatcttttttcctccctttgctgcttttagtctggcaagaagaatgtagtgtaatatacgatgatgatgggcctggatttgggggcatttctaatttcacatattctgtgttgtcatcagaccataccccggttactcatggtacatatgaatgtttcaaagtctagctgaagttttcttttatgcgatgacactatgagaaaaccatttgtggaccaaaaatgatcactatttcttttttctagataagaaagaaaatctgtggattcttagtaaatggagaagtgagtgccttctctcctaatgtttaaataataagtgtaaatatggaaatcagatcaccctttaagctggataacctcgtgcaagagaatgcttttaacatatgctgatttgcaagccccagtaaaggaaggctgcttgactctgtagtcagatcttgattcagatccagctccactgctgacagagttgagatatctcctgtaaaatgagatagaattacactacctgccccgtgttggaattaaatgagatagcgagtgtaaaagttctaacacactgcgtgaagcttcatgtgcgaaaatgcgtattgcctgatctccctgcatcccttctggcttttgtttcttctttcctctgaagattatgtaggtaccctgcccagtacccatacgtttagtgtttgtgaccaaaaggatttcgtataatgtatcaatagagaatgcttaatgtgtttgttttggataaaatatcccagcatcttaaattcattgtcagattatacataaaacgcttaattggctgttttaaaacattagaattttgatcttcaaccatagtttgtttctaatctccataatctccccaaatatttttctaaagattcaagttaaatataaatagtttcccaatcttcagtgaattctgtcttttagggattgactgtgggagtggtctctaagatatagtatttgaaatttaaagttagaagaatacttctgtaatctaccttgaataggtattttaaaatagcttaatttctgaagaaaagtttttaaatattttaatattgaaggttattttaatattttaaagtaactttagttaatctgtaatttttaaaatactttgatttggtgtgaaattaatgattttctcgtgtatagtttatctgtgtgccttataataaatggaccttgtgtccagtttattataattaagagtgtaaatccatttgttaattagtaaatcttacacatagcacacgatataggttggtacttatttaataagtactaaatttttatatagatgctttatactttaataatatttatatttacagaatttaattgatatttactgaatttaatattttaattattaattatcttagtcgagatgaaatcataagcatatgagttaaaaatattagctcctttgtgaggtggaataccatatttaaacattggtgtatgaaggcaggtaatttacttcatcattattttaacaagtgatgttgataaaagccagaggaacaaacatgggtgaaaaacatattaattaatcaaacttctagtaaataccaacccgggcatgtctttttatggttgtcttgaattaatactaattttacttccttacacaaaaatacaaacttcaaaaacaaaataaacaagaaaacatgaaaacataaaaaggaaacaaagcaaaaacaaaacaaaaacctttaatatatggacttaaaaaaattctcaccattattaaaattatatgcttgagaaaggttttcagtagtggtcagtaagtttatactgcatgagctggacatttttactttgttacttgcgtgaccagcagcatgcatgtgcaggttgacgtggattcatttgaggcatgatttgtgacacttggaacaaagggctgcttcccattcgacctggtaaaagaaattgtaacttttgggcttaataaaacaagcggctcttgcattgactaatactatatttgcctgtttcacctctcgtcctcatccttagctgtccatcttctacatagaaattggaattatatttctaaaattcagatctatatgtcatttcttcttaaagaaaaaaaaaaaaacaacttttgaaggcgtatgagatcaatagagtggcagtaatgtaagggatagaagattggcctgtaaaatcagacttcctggctgggcgcggtggctcatgcctgtaattccagaactttgggaggtggaggcgggcagatcacctgaggtcgggagtttgagaccaacctggccaacgtggtgaaaccccgtttccactaaaaatacaaaaattagccgggcatagtggctcacacctgttatcccgccactctggaggcttaggcacgagaatcgcttgaacccaggaggcagaggttgcagtgagccgagatcgtgccactgcactccagcctgggtgatagaatgagactccatctccaaaaaaaaaaaaacaacaacaacaacaacagacttcccatcctaagttaaaatacccactgttcttactgtgttcttatttagttacttgcactttgtgttcttcagcaagttcttatgatttttgaggcttagtgtataaaatagtaattataacattatttcatacagtttttgagaggattaaatgaggtgtgtattataaagtgcagtgcctggtatataacctgcattaattttcctcctaccattactatcgttactactactgctattgctgttagtcatggctcactttataatatgattccatcgtgtcttttgaggctcattttcagccatcacctttcagtttctatgccctagtcaaagccagctattagcgctaatctgaaaaggccatatgttttcatactgatgactactacttttattttcccagcccagacttctcttgagtttgatattcacttggaagtctagttggaatctcaagtataatataaatgatgtgggtaaaatatagctatttttccctcttcccccaaccttcttcctacccctaaaccctggtgtctctgctggcattccccatatccataaatggcagtacccaagccaaaaacttaagatattattcttgattctttccatttctcttaagtccaatccatccccacgtcctgttgcaccttcacaatttgccttgagcagtccactgctcttagtcttcgttgccacctctttatttgaagccatcattctcttgcatgaagtactgcagtaattttctaagtgggctgcttctttttcttcttgctccatagaagtttttttttttttttttttcttcacacagcagcctgagaattattttaagagcctatattggatcatatcatttctctgcttaaaatcttctggtgacttcccattcctctcaaaatcaagtcctccattctgtggcctaaatggccctgaatgagctttctccttctcatcattcttcccctcattcatcacatgtcagccacgaaggcctctcagtgtttcttaaaccctctgcacccttttttcttctagggccttttgcactttctgtactccctccttgggatattcttcaaatgtctggcttggctaaacactttggagtttggcccaaatctcacttctcactcagaggcctaatctgaccatcctatttaatattgcagtctgtcattttactctcttacacagattatttccttcaagacaattgtaatttgtgtatacctggtttgtttagttattgcttatttatggtatttgtccattacctgaatgtaaactccataaaggcagaggccttgttcatcttactcttagctgtatccccaggcattagcatgccgcctggcatttggaagatagtaaatatttgatgcttctgtatctttgttcctgttttttgccaatgattggaatgctgtcttgcacacatagttatagttattgaactacttatcctttaagtcttagctcagatgtcatctgtgataccagttttaatctcctagacaaaagttttttgctcttgctcttgtgtgcttctaaagcccatgatacatgcactatttgtagagtaaatcccatgttaggtatttagaatattatttgattatttgaatataattgatgtcactgtcttctattaggctgaattgctatgtcaaggaccagctggctcttttgtgtgctcagtatctaccaaccaacctattatagtagatatagtgaattctcagtaaatgttgaattgagtagaagttgtcctaatcggccgggcgcggtggctcacgcctgtaatcccagcactttgggaggccgaggcgggcgattcacgaggtcaggagatcgagaccatcctggctaacacagtgaaaccccatctctactaaaaatacaaaaaattagccgggcgtggtggtgggcaccagtagtcccagctatgcgggaggctgaggcaggagaatggcgtgaaccctgggaggcggagcctgcagtgagccaagatcgcgccactgcactccagcctgggcaacagcgagactccgtctcaaaaaaaaaaaaaaaaaaaaagaagttgtcctaatcaacggaaataaccaaccacagaccagttttcccaaatcacactttaaaaatcataaaggtactttccaaattataatcttactttatgtgttttctattaacatacggtcattattctaagggcaggaatttgagagctgtggagcacaaggggcatttcctcagattctattttgctttcttgctgggcactgagtagccatcttgtctgagggaagtatttccagtttgaaatgcatatctctgttgttcattactaaccaacatcccttctggccctattacttccctctagcttatccaactaatttcatatgtttatagaaaagctccaagttgaggggggaaccttatggaaattaacacagtatacatgaaatacattactaattcagctgtattgctaatgaaaatacatcaaagaacttttgtagccaacattaggaacccagtcaccatttgtaatagtgaaagtcattccccattctaaatagctgacttacaaataggcttttggaacatatcccatttgtaaattggggattcctttggcaaaatgtttattttgatactgaaaacctttttattaatggtgttaaacctaattgatggtatggattacgaagagaaagggagagaagaatctaggagttaaggttttgtttttgttttctttcagaaatggcttaatttccacaaagtacagttttagggttgacagatttttttttttaaatttatttcggaaaaaaatcaaacctagagaaaagttacaagaatagtacaatgaactcccatttatatctgccgcagattcaccagttgttaccatgtaccacatttgctttgtcgttcttgctctctttttatatttgcagagtgggtacaaagtctggaaacagagattattattttatttacagattgaaactccttgattacatcttctgcctagagcagctattaccagcctttttggcaccagggaccagtttcgtggaagacaatttttccatgaatggtggggggaggggatggtttcaaaatgattcaagcacattacatttattgtacactttattttccattattattacattgtaatatgtgatgaaatacttatacaactcaccataatgtagaatcagtgggagcccagagcttgttttcctgctactagagggtcccatcttggggtgatgggagacagtgactgatgatctcatcaggcattagattctcataaggagtgcacaacctagatcctttgcatgtgtggttcacagtggggtttgtgcttctgtgataattaagtgttgccgttgatctgacaggaggtggagctcaggtggtaatgcaagcgacggggagcggctgtaaatacagatgaaggttcactcactggcatgccgctcatctcttgctgtgtggccccattcctaacaggccatggactggtactgatctatggccccggggtggggacctctggtctagaatatgtcaaagatgcaagtttatttagttaaagtcagtggcaaaacatcacaggtatgattaaattcaggttatatacagggatagatggaaatgctatgttaatgcactgtgtacatttctaacaaggaaacctgacatgttattatcattaacatatcaggcattgttatataatatcaagaatccactgtgtagatctttttcctcatctcctttttttctcttttttgttctcttcctattaaaattatttttattgttgaaccatttgagaggaggttgcacacatcaagttcccttacccctaaatacttcaactgatatctcctaataagggcatattcttacattagtatgggggattcaagaaatttaatattgatcttattgtttaatgtacagttcatgttgaaatttttcccatagtgtcaataatatcctttaatatttttcccattccaatattatacaatgcattttaattatatcccttgtattgtttaatctgaaacagttcttcagcctttttaatttttgggttttgtagagtacagaccctttgttttgtaggatgtccatcagtttggatttgtccaggtgcttctttgtaattagattcaggttttgcatttttggcaaaaatcccatgtaagtgatggtatatcctcagtgcatcacatcatgaggcagtacggtgtcattttgaccatgttgttgatgtttatttggaccacttagttaaggttttacctgctagttttctctattacaaaaggtatcatagtcccctttgttattactgaataatctgttggagacacttggagactgaaaatttcctcctccaaacgcttacagaatggttttagcattcattgattactcttgcctgaatcacttactacacagaattgcaaaatagtgtttttctaaccatcgttccctctccatttattagtgggcattctagtctgttttaaagaagaccttgtcctattcattttgatatcaatatgatataatggattcttttttattaagtaggttgttttctattacctgccagtattcattttgatgttccaaattaacccacatttggttagtggaaacttcttcacattaactcattggttgttttaacatgcccccatcatttgttgagcactttcttgcattcgggaccagtaagatattccaggctcatcttatggtcatctcctgctgttgtcctggaatcagtcattacattatttcaagttttcctttattgggtaagagtatttagaaaccagaaaccaggcagcaggtatgctattgatattggagtttcattgttttagagccttttggcttattaacctgagaaattttgaatttatgctgattcctcgggcagtagtttgtaatttatctttatagtcccaaaactcctaggagaaactgttttctttgaaagtgttaacaatttaaataactactttcaccgaattcttaataattctacagtggttgggtcttgttttccaaaacattttaaaacaggagtgtgaatcctgttttatatcttttacttactcagtgagtatgttcatagtgtcttgagcgtggttgatttgtctcgaacaaggttgttgtttataattataataatgacccaacattatttttattactttcatatgataatgaactattcctgtatttgttataatattttagttaattttgtggaaacctttcttttaagtgaagtgttgattttatatattttgtttttaataactgttattctagaagaaacataaactttagtttttttgtttttttttttttgagacggaatcttactctgtcacccaggctggagtacagtggcgcaatcttggctcactgcaagctccgcctcccaggttcacgccattctcctgcctcagcctcctgagtagctgggactacaggcgcctgccaccgcgcccggctaattttttttctttgtattttttagtagagacggggtttcaccctgttagctaggatggtcttgatctcctgacctcatgatccacccacctcggcctcccaaagtgctgggattacaggcgtgagccaccacgcctggccataaactttagtttttaacttaaaaattttaaaagcctaattcctgaaattaaagtatataattaatgaacatcaaaatgcctaatgttggcgttgctgttatactgtttcgttcattagcaagtaaaataacctttctgggcatcactttaattatacaatgatatgatagctagatcctttttaactctgtgttacacactgtatatgtaattaatgttaaattgtttatgaaagtgaaattaagtgctataaagcatagtggaaggaatattatgcttctgatccaggagttattgagttcaaattctttgtaactattgtgttactttggcttatatattttgtttttaataactattattctagaagaaacataaagatttatttcacagtttgaaataactggtaacaactggtaacttcattactttattcagtccactgggctaggtgctgcaaggcttggctttcacggtcaggggggagtatggacatagacgatttgtgcttgattttgatgtgtaatagatgtgtacgatgcagagtacacatctgcaagggtaattaacctagtttcaggaatgccaggaaaataagctttaatgttggacagctatataaccataatgtaaatgccaaaaccaggaaagtaatactggtatgatactgtttaccttttcactatgaaaaccttcttttgaatttaatcagtttttcttctaatggtgtttatctgttctaagttctaagtttcaatccataatcccacattgcatttatttgttgtgtttctttagtctcctgaaatctgtgatattaactcattttttttgttgtctttatgatcttgatgcttttttgaagagtactggtcgttactttgtagaatgtctttcaatttgggtttctctgatgctttcttatgattaatgtgggattatacatttttggcaatataccgaagtaatggtatcatatcaggaggtatgtttatatcaggggctacaggatgtcactgtcttattactaatgacgttaatcttgttcacttaattaaggtaatatctgctgatctctcctctgtaaagtcatagtgtagttgataaatattttgggggagatactttgagattatgctaatttctgttttttcttccaactttcatccattcacttcagcattcattgctggaacttatctgtgatacctactactgtagtattaacctcatggtgattttgtgatttccttgttcctttctcatttattaaaattcttcagtgaagaagtgtcccttctccctcgtttatttattcattcatttatatcagtatggacttagaggtttttattttctaggttgcaatctgatgctgttgcttatgttactgctcagatcgttctgctttggcattgagagctctgtccggttggttccttgtcctttttacattctcccttcagcttgaaagctcttcttcactttctggtactgaaaagtttctgagaaacttcaggctcatcttgcattttaccagctccaaccctgtaatcatcttctttcccacaaagccctggctccttgttttgggggatagcatttagaaaccgagatctgggtactaggactgccgctcattgctactggggagtctttttccttctcagcagacagagctaagaaatacgtgtgtatacgaacccacacatttactcacatccacagtcaattctgctataacgcagcatatttattccccaaaatcactatgtatgcataatcatgcaatgaaagccacagggttcgtgtgatcaatgaagttagagaaatagcattcaaaaactttatcactgacacagtaaaagaaaggattggaacttaaacctgattaaaacagtggcatggttttagacatgttaaatcattaaggaatatataagtacatgataaatgtgttactttaccatgaaaaaggcatgaagtttgcttatgtgagtgtcctaaggtgtgtggcttttgagttactgtgaaatggtggaaggagagttgtcagatgaaacctaacaccagatgtggatagatggggctcataacacatgacctgtggtagctcattttcatttgaatcacttctttcttgggtgccttgcaatttagtcttcatttctgtactaatgttgtattttttcccatttcttgtctgaatttagccaccttttaaattgctctttgtattttgtccatttagtttttagatttctgattcacggtagttttcatatcatcaaatgcttgtttgaatgtatttaattctgtttagagtattggcttatagtttttttttctgctttagggttttttttttcggtcagtggagggtggggcagggttccttgctggatatgtaccacattctctttcttaattttctggactttatttttcttttgtccttttttttgagacagagtctcactctgtcacccaggctggaatgcagtggcgtgatctcagctcagtgcaacctctgcctcccagtttcaagcgattcttgtgcttcagcctcccaagtagctgggattacaggcacgtgccaccatgcctggctaattttttgtatttttagtagagacggggttttgccatgttggccagcctggtctcggactcccggcctcaagtgatccacttgcctcaacctcccaaagtgctgggattacaggcgtgagtcactgtgcccagccttgttcatttttatagtattgagtgttttatagtattcctagtttattgattccctcttttgtcagtatagagtagtcctgttacttcagtgattttcatttgtttcaatggttggagaagagttgtgggacttgcaattttatgagtcttttaaggtcttgtaggaccttaactattcccttttctttttccttttaccttacagttactgaagaacagtttcctctcccttttgcccatttttgcctgctgccagaagctgtgtgtttcggtgcgcctctttatgtggccctttaaatcaagagaattttgaaattccttccctgtagtctgtgttctaatctctccagacacttctccactattttcagattttagggtgggtttaatatttctgatgatctttccagatgatccttaggtcccattgctagcctcttgccacaaagctttggggtttcggatggatgagagtttgggggatcagtcaaagagttggggtgaatgacagtttgagggatcaatggctgggatttggtgacttcccccgcccccctcacagttttgcattgtcaacattctttgtcttcaggctgtgctgtgtggtttggaatagaatttccttttcctttcttgttttttcacatggtttagggatagtatttgagtgcatagatacacttgcaccactgtggcaagtctttactttgagaggggtgaggaaaacccattgacttatcctgcccgtgctaataaagcttttagttatgaaaagacataggcagtcaacttccactggtaagctagagtctccggaaggtattgtggaggaggagaaataaactacatttaaatgcccttacttcattctgataacttgcaaatactggttctgggttattgcaagtcttactgctttttctgaaaagcaaggttattcagaggtttgtgtctataatataaataggaaatggcttggttttattatatgaaggagttataggcctgtatttgaccaagggcctcctttggtactttttattccaatgtcaatctaacataagatgttttctgaaaaggtaacttctaaacttgtgaattggtttggtagatgttagctttttgaaaattaaacttcattacctctttatatatttattctacttttggttttcttggttttattttatggttttgacagttgttcctttcttccaataaatggtaggtatgatgttattccttgactctacacttgttattgtgtttagtaagatggcactaaatctgttaggtagcttaattagttctcttttatgccttttatctatttttttaacatgagagatttaacataaagttggaattgtgtagaagttctttatgcttggttttcctctataaattagttgcttaaaatatttattacttgtgaacatttctttccttagagttagtaagtagtctgtcagtattttctgttggagtaagaaatagacttaacttcattagtcattatacatttctttttgtaaaaatatcaaccagaattaaagggcatattggcttttaacatcagaattccatcataatataaattaaaatcttttgctattaatgacacagctttggagttatccacatggctttcaaatgtttagaggcagtcggtctctatgcccatgtgtctgtcattgggacttcatttatgagctttcttttttttttttcatagtttccacaagtcttaatgacttctcagactcattataccttcatttcctcatttgagtgatcatttgccaaaactctttctttttattgacctcccgtgtttttctttcaactggtgaatatggatcatccccatacaatggcctaggttctgcttcccccaaacccttcctcttttggactctgtcccttatctgtttctcactgttttagtgattatttctatattgttgattctgaaatggaaacatatataagatatagctctttgcttctaggaggtaatggtttaggcagggtaaaatcccattaattactaagtgatgtgtaaatcttacacatgataatggattagggagttcaggagaggaagagtttggaggtgttcagggaatgcttcacggaaggattgacatttgaactggatatcaagttttattgtcagagttgtggaaaaaatacaccacatagaacagtttgagcaaaagagccaaaacagaaaaagaagagctgcttgttggacacagtttggctagattggagggtttttcagaaaaagagatggtaaagtgggaaagagagctcgagaccagtttttaatgccgctggaatgttcaacagtttaaattttgttcttcaggtaaaagaaaaaaaagagccattgacagtttgtaatcgtggaagtgaccaaagccttctttaatatgcccatataagataatgaagataatgtatatgtcctttcttattattaacattaataatgattaataaagcttggtgccttaaagaataatgctgaagatacttttttagaaagcatagtgataggctcattctttgattgtttgaagggaattggtaggaatacacagctttcgagtggaagatgggggtaaagattgtcctttcgtcattcttccttgtatcccgctttcttcttgatttcctttcccaggccagactgtgctgtccttgaaaactggattccttctcattagtagtttttctcttttaaaatccgatagtattttttctgccttactgtatttttcatatttgaccttatactaaggtaatagatgtatacacactgcattgaaggcttttctgcttgtcttatttcttcttgtattctcttgatgtagcatctcagtgaaaatgtggtatgtaaatgaatcctttacattgctgtcttacaaatgactcaggattttacgctttgcaaagtcgctattcatctagcatttggactgagctgagctttcgacatatggctttaaagtcatctctgtagctctgctggtctagataagtagttgtcagcctttttcttctgtgagatacagtaggtaaaattttgacatgcatgatgcactcccttgacttttatagcagagaggtctagtattacagtaatttataattgccacaactatcctgggatatgttgtagatagaacagttactaggtaatgtgcaattcttagggcagtagctataaatcaccccagttctcttccacggaagaagggatatcatagtgtaagcaaaggggatgttatgaggatagtctgaaataaactcatttttcttttaagattcaaactaatactttaggagtgtcacgttacttgtaagagaactcccaagttgttatgttcatctgtcaagttagctttaagaccttttggaatttttattttccgttagttcaggtgctttttgttcgttttaaatagatagaaccctatttcgatatagattagattggtagttggtattatactgctggattctatttcatttctctgagctttagagtttgcattcctcaaatgtcctctgaggcttcttccagttcagaactttaggaagttggtgaatatcatgaatagagcatccaaactttttctacattctggttaaaagccttattaatatggaaacctgtttgatagacttcgacactttactagattgtttaaccaaagtcatgcatatttggccattatgtgaagtacaaaagattacattttaaagtgttcctatttttaaagtttgtgtttgtgtgtgcttcttgttacaggtgtttgggtggttgaggactgtaaaagtgatggattccagtcaccatatgcctgagaaggaatactgggaatattagcttgtaccatgatactgaagagtagggcaaatagaaacttagcatttgggaagtcacatcctcaatctgaagaattaaaattctaatgaatttgtaattgataatatgtattaataaatattagccttaatatttattacaggctaatattaagtttaatgtggaaactttcagtatggttactgattatagatttgaggtggtagtagtgataacttatttgggaaaatacaataggtacagtcatgagtcacttaatgacagggatatgttctgagaaatgcatcattagccaattttgttactttgtgaacatcatagagtgcacagtatttacacaaacttagatggcacagtctactacacacctaggctatatttggtatagcctattgctcctagtctacaaacctttacagcatgttactctgctgaatagtgtaggcatttgtaacatagtagtgcgtattcgtgtatctaaacatatctaaacgtggaaagggtacagtaaaaatatggtataaaagataaaaaatggtagacttaatatagcacagctccattataatcttatgtgaccaccgtcatttatgtggttcattactgactgaaatgttgctatgcaatgactggggaatgtcagccaatatgtggatcactatggagaagatgttagataccccaaggcagtgatacagaaaatctgaagacactcttaggttttttattgtaagaacagaagctagaaatgaacacatagattcatgtgaaaacttgtgtacaaatgctcatagcagcattagtcataataggtaaaaagttgaaatcacccaaatgaccatcagttgatgaaagaatacataataggttgtatttccacacaagggaatattattcagcaataaaaaggaatgaagtgtagatatgtgctgcaacagggatgaatcttgaaaacatgttaagtgaaagaagccagccacaaaagaccacatattgtgtaattccatttgtatgaaatttctggaataggcaaatgtatagagacagaaagtaggtgtcccactgcctgagactgagccatagggggctggggtaggcatagggaatggggagtgagtcctaattagtactggggttcttttaaagggtgatgaaaatgttatggaattagatagtggtgagggttgcacatacctgagggtatcaaaacattcaagtgtatgctttaaatgggtgaattgtatgtaaattatatctcaataaagctactttcttttttattttttcagaaaagaacggaagctgtttgaacagatgttttgggcctttgggtagttgagtggatgtagatggaggtggaagggcatgggggggataatgggtatttcttggcattactgtgttatcacattgtcacacaaatgctaccttctccatccactagctaagaatgtaataagttgtgttttagtggagattgtataaaaacctatctttttaacctacctagcacttgggctggaattgtgctttattctagttgacaggattaatcttaccattctcttatctgtattttttaatattaaattcagatgctttcctattttcagggttaaggttatacaaaattgtgttctgcccatctgtctatcctacaccctcctttgctgtttgttcatccctattcaagtttgtgtcatttttcttttttacctcctgtaattggaacaatctcgtttcgtgagtgtgtataatcactttcttccttaaatgcttgcttgtgtgaaattttactgacttaaagatattgtttcctgtgaattagtatctatttatatgttttgaaataaatctgttcttttaagaccttattagtttttttaaaaaattatagtattcagctatttaatgattctaaatatattccaaaacttctaatttggcttttactgtaatatttgcctttctgatgtcttggacgcagtgacgacttttcaataagaatgtcattaagaaattagtcgtgtgtaccacagtaaatacttggtacttaaggagtttttagtgtatgccagtcactgtgctgagcacattacatgcttacttaattctcacaactgaacttacgaggtatagatattacaccatttatagatgaggaaacagactcaaacagtaatgctgattgttcttggtgttaactttgtgaaatcacaaaaatcttttaaattatagctttccagtgttgaggagtggctttcataatgtatgaattgtggatctttttgtgttcttcggtggtatcttaaaaatttgtaggtttttttcctaaatggaatcatgcaataggtattctctagtgtctggcttttgtccctcagcaaaatgttttcgtgattcatctgtgtttgtatctgtcagtagtttgttccatttttctgttgactagtgttccttttatgtttaaactacaattttgctgtttgcctttcatggacttttggtagtattatgaataaagttgctatgaagatttgagtacatgcctttgtatggacatatgctttcatttttcttgggtgaatattataccaaagagtgggatttctgggtcacatggtatatgtatcttttatttcataagaaactgtgcaactgttttccaaagtagttgtatgattttacagtcccatcagtagtaaatgagagttccagtttctccatatcttcaccaacactttgcattgtgagcctttttaagttgagacattttagtggatatttacttgtatatccatatcgttttaatctccacttctttgatgactaatgattctaaatgcttttcatttactgagtggctcttcatacatctttttaagtttaatgttcacatcttttgcccatttttaatagggttatttgccttcttattactcagctgtaagacatctttatatattctacatagaagtctttttttcattttctccattatgttgtgaatatttttatcccttaatggtatctttcaaagagcagaaggtttcaattttgatgaagtgctgtttgtcagttttctcccttatggatacctgcttttttggtgtcctgtctgataaatgtttgccttacatggggcagtgggatttttgtctcaaactataaaactttgagaagttttatagtttagcttttatttataagtctacagttcattttgagttaacttctgtgaatgttatgaggtaatgtcaaggttcaagtatcatttgttgataaggtttttcttttccccttgaattaccttgacatctttgttgaagatcaaatgaccgtatttgtgtagatttatttctggattctctgttatgttccattgatgtatgtattttgttattacaagagcacactgtattaaatagtcttaaaatcaggtagtgtaaatccttcaacttttttttttttaaattatactttaagttctggggtacatgtgcagaacgtggtggtttgttacataggtatacatatgccatggtggtttgctgcacccatcaacccatcatctgcattaggtatttctcataatgctatccctccccttgtcccccaccccatgacaggccccggtgtgtgatgttcccctccctgtgtccatgtgttcttactgttcagctcccacttatgagtgagaacatgtggtgtttggttttctgctcttgtgttagtttgctgagaatgatggtttccagcttcatccatgtccctgcaaaggacatgaactcatcctttttttatggctgcctttgtttcttttaaaaattgttctggctgtattataaatttttagtttttttgtcaatctttacaaaaatgctttctgagattttgacttagattgtgttgaatctatagatcattttagggagaatcagtatcacaacagtattaactgagtgttcagctccatgaacatggtatataattatttttgtatgccttccttaatttctttcagcagtattttctagtattcagaatgttagtcttgcacatgttgttaaatttgtctttaaatattttctgcttttgaaactaatataacatatttttacaaaacttaattttacattttcattacaaatatgtagaaatacagttgatgtttaatagtgatcttgtatcctatacccttgcaaactccacttcttagttccagttactttattgtagtttttttttgttttttactgtgtgtgatgtttgtgaatagaacctgttttaattcttcctttccaatctggatgccttttctttttcttacattattccactgcttaggaccttcagtaaaatagcaattaaaaatggtgagagtggacattcttgttttgttccagtcttagagggggcaattagtcttttaccattaagtatgatcttagctgtaggttttctgtggatgctctttataggttgaggaagttgccttcttttttagtttgctgaggtgttttgttttgttttgttttgagacagggtctcctctgttgcccaggctgttgtacagtggcaccgtcatggctcactgcagcctcgactgcctgggctcaagcaatcctcctgcctcagcctcctaagtatttgggaccacaggcgtgtgccaccacactcagctaatttttttttgttgtttttttcttttcttttctttttttgagaaggagtctcactgttgcccaggctggagtgcagtggcacgatcttggctcactgcaacctctgcttcctgggttcaagcaattctccttcctcagcctcccgagtagctgggactacaggcacacaccaccatgcccagctaatttttgtttcatattttagcagactcaaggtttcaccctgttgcccaggctggtctcgaactcctgagctcaggcaatctggccatctcaccctcccaaagtgctaggattacaggtgtgagccactgcacctggccttaatttttgtatttttttgtagagatggggtttctctatgttgcccaggctgttctcaaaccctggcctcaggcagttttcttgcctcagcctcccaaagtgctggagttatagccgtgagccactgcacctggccagtttgctgagtttttgtttttgtttttttttttaaattttttcctgaatgggtgttttgttatttctctatgtctattggaattaatcacatgggtttttttggcatgttaatgtagtgaattacattgatttttgaatactgaaccaaccttgtattcctgagacaaaccccatctgtactgatattttctttacatattttgctggatttgacctgctaatattttgttaagaatgtttgcctctatacccaagtgacactggtatgaagtttcttttacttgtggtcctcttgcctcattttggtatcagggttatttatactggcctccttaaatgtgttagaaagtgtgtcctctccttctgtttcctgaagagattgtgtacagctgatattaaatctttagatgattgaagaattcactagtgaaaccatcttggtttggagttttctttgtggaaagcttttaaattacgaatttagtttattcgatacagaattatttagacttttctttctgtgtcagttttgatagtctgcatgttctaagaaattttgtctacttaagttgtcagttttattggcataaaatcacccttagtatacttttaatgtttgcagcatttgtggtgatgtcctttcttttatttctgatgttggtaatttgtgtcttttttcttgaccagcctaactagaagttcttttcaaataaccaactttaattgattttatctagtttgtcccacatctctgttaccattttctacttttgttattcccttacctctacttttagtttaatatgctccttttttctagtgtcttagggtggaagtttggaacgctgttaaaccattattttttcttctaaaatacgcacttaaaagctgtaaatttccaagtacgtatctttagctttaccctatataatctaatcatgtttttgccatttagttcaatgtatttttaaaattttaaatgatttatttgatccatgagttatttagaaatcttaatttccaaatgtttggaaaatgtcccaaaatagaaatgtccccccccaaaaaagtgtcctttttgtaactgatctttaattcttttgtggtcagaaaacagtttctatgtcatttcagttcttataaattcatgtgtcttgttttatggtccagcatatgttctttgttgttgattgtaccaagacacatgtacattttcatgtttgttcttatgtggttggttgtagtattcagttaaaccaaggtggtttatagtgttgttcaggtcttatacatcttcactgattttccatctactcattttaccagttagtgtgaaggaagtatttaaatctccagctgtaattgtagatatctatttctccttttagttctgtcagtgtttgctttatgtgttttggaactttatcattggctgcataaatgtttagaattattttgtagttttgataatttgagactgtaagcattatgaaacgtattccttctcctaaaatcttctttgtctgatattaatataggcactgctgcttttaggattaatgtttatatgatatatccttttctattttatgtttcctatctgtgttaatttaaagtgatatcttatagacaacatatatatagttgggtcttgtttttttacttaatctgacaatctctacttttaatctagtatgacagtctctactgtttaattgaggtttgtagataatatatatttactgtaattattgatatagttagatttaagtgtaccatcttgccatctttgttttctacttgtcctattttgtgttttattttcctctttttataccttttttggattacatattttaaaaatatgcattccatttaatctactttcttggttgattagttttattttatgtatttggtagttgccgtagggttttacaacatgaatcttgaacttatcgcaatccaccttcatcactttagaaataatgtaagatccttactgtagtgcacttccagtttccttcccttcattctttttgctattgtcattgattttattctacatgttattaccatacattattactacttttgctttagataatcaaatatcttcttaaaacttaaatgtcttataatttgtcacgtttaccatttgttactctttccttgtgtagagctaggtttctatctgctcttttaaaaaatttcatagactatatcttagagcagttttagctttacagaaaaattgaacagaaagtacagagttcatatatactaccccaatcccaccctttgcaggttccctcttgtattggtgtggtacatttgttacaactgagggctgatacattattcttagctgagtccatagttcacattagggctcactctgtgatgtacagttctaccatttttctgcttcttaaaactcttccttcagtgtttcttggattgcaggcctcctggtaacagattgtctcagcttttgtttgtttgaaatgtctttatttcccctttatcggtgaagaatatttctgctttatatagattttagcttacagagtttttttttgtcctttctagcactttacagatgtaattcctttgttgtaaacttgttgcattactcttgacaaggagtctggtaattattatctttgttcctctgtgtgtaatgtgtctttccacttctttggcttcttgtaagattttctctatatgactggatttctattatgtgccttggtgtggtttctttgtgcttaatctgctttatgtatgttgagtttcttgaatatgtgtgttcagttttcctcaaatttggacctttttctggccctatttcgtcatgtattttttgtttctccttccttctgcagttccaattacattatgtttaggttgcccttgatcttctcacaggttcttcataatctgtttttgttttgttttgctctttttgatgtttttacatcttcaattttgtcatcttcttttctgcagtttgatctactgttaattccatccagttacttttttgagatactgcactttttatgtttagaaaatgcattttattcttttaaaaatcattttcttttttgttcctttaaaaaaatcgtttaatatatttataatattttgaagtttatgcctttaaagacaccctgtcttgcttctgggcttctttcttttatcggatttcccccctggtggtgtgggtcacacatttcttcattttcttacatttagtaagttttgattgactcctggacattcatcacactgttgtctggattttgttgatttcctctgaagagattttaattttgttttggcagactgataaatttcttgcagacgtgtatgaaccttttgagcttgcttttacactttgttctggcagatctagtgtagcctttactgtaggactaggttagcacgcggcggtgctgctgctgcattttctactgattgcccaggtttctctgggtggaacttgaacattctgcagtcttatgtaatctttgggaactttttttttattatactgcttcctgatcattgttctttgcctggccttgtgaatttcactttattcatgcacacattcaatgaaaaactatagagctgtgttgttacatgtggtatccattagccatatgtggctcttgagtgtttgaattatggttattctgaatttaaatgtgctgtatgtgcaaaacacactgtgttagtctgtttgcattgctgtaagggaataacttagactggataatttataaagaaaagaggcttattttgactcatagttctgcagacgtacaagaagcatactgctggcatctgcttccagatgagtgtgtcaggaatgttacagtcatggtgaaagggaaaaggggagcaagcttgtcacatggtaagaggagaagcaggagagagtgggtggggggaggtactacactcttgaacaaccagatcttgcgtgaactcagagtgagaactcactaccaagaggagggcaccaagtcgttcatgagacatctgctcccatgacccaaacacctctcaccaagtcccacctccaacattaggggttacatttcaacatgagatatgggtggggacagatatccaaatcatatcacacacactgaatgttagggatgtaggttggaaaaacatatatgaaaatctcactttttaaatatcagttacatcctgaagtgataatattatgagtgtattgggtggtatacaatattgtattaaaattaatttcaccttctttttcctttacagtgtagttactagaaaattaaaacttacattttaggttcataatatgtttcttttgggcagtgctgctctagaatccctctgcagatttcaggagcactttctctcctgagtaccatcctttttgctaatctgtcgcacaaattcccattacctcagacttcctgaatttttatctgtctcttgtactccgtgagtctccgtattcttcttggcttcccttttctgcactgtcgtcctgactgtgcatccaagcatttgtagagacactttccctttttccaggcctcacagtgcggggctgttcattgtctgatgttttaaaattgtagttttatatattttatcagttttctagtttagttcaatgggagagcatgtccgataccagttactacatcatgcctggtagcaaatatcttaaggcatgaggagttgggtgcccatatgagttcacccttatttggaattaaaaatacccgttgcaactaatcctaaattttgattacaagtgaaattcataattttgtgagtttcattttggattgactttggaactgttttcatgtagaaacttttgttttctttgacactgcattatgctcagtacagaagcatccagtgaaattttgatagtttttgaatgtaaggtagttcaaatagtttgaacactgattgaagtcatttcatttaaccattcctactagtatggaaaattggaagctgagttaagttgtaccgtggtataaaacatgatattcaacatttaaatgtccttgataatgcttcaaaggtcttgtttctttcaggagtaccttctattaaaaaagatgttttgttttgtttttaatcacctatttgagataggtaaaaaacaaattattttttttttgtactctttcacacaccactcaccacaggatacgttgccttcggtcaccaaaacgtgtgtgagggtttcccacttaccaagtagttctccagtggacaccagctggatttcctataattcagttcaattctgatactatctacctggagatggcatcatatcctacaggttgagggctcagcctgacaagactgacccacttcagatgccaactacaagtccctggttgtgatcagtacttctgatcaattggctgtaaatcaggggttctcactaccccttcttctggtttgattaatttgctagagcagctcacagaactcagggaaacactttacttatgtttacccatttatcatgaaggatatagatgaatgaccagatggaagagatgcatagggcaaggtgtatagaaaggggcacagagcttccatcctctatctggttgtgctaccgtctaggaacctccacgtgttcagcaatctggaagcactccaaaccctgtcctttctttctttttttttttttttttttttgaagggtttgttacctaggcatgattgattacatacatcattgaccgttggtaatcaactcaaccttcagtctctctcccctccccagaggttgggagttggggctgaaaacatcaaccctctgttcatgcctaggtctttctgatgaccagcacacgtattgaagctacctagggccccctagtcactagtcatttcactggcatgcaagagacacttgccactccagcagaaaccaaatatgtatttcttattacatcacattatttctatctgtgtgatttgtgtgatattgtataatttttagttctggtaattgtcatatagaaactctaaatatattttaaagggtgttatgaaattatcagtaattgtaaatacttcaaagcaggtgtctgtctacatgttcatggtctctatcatatataggtattgatgtacaacgtatatctgaacctgctcaaatgtactggtcctctgagactgaatttgctttgctgtcttgaatctattgctatagtaggcattcattttttttccacctctttattcaccaaaagcatttactgaattgtggttatgtatagcagttaaaagcattcctggattctaatcctggcttcaccactttactagctgaataccttgggaagttgcttctttagtatttgcgttccctcttgagaatagtaatggggtaataatgaggttgttgttggcattacatcaggtaatgacatgtaaagcaattagtatgctgattagcatatgataaatactcaagtattactgctgctcttgtagttgttgttattatgttaggctttccctggatgcattgtctatagttttaatctccttcctctggcagtacttccttccctgcttaatttttttttctcattaaggacttttccaccaacctaccacctatattatatattccttattcaccttgtactataggtctccccactagaatgtaagctctatgaagtcaggaatagggatagggattgattcctagcacctagaaaagtgcctggaatatgttggatgcttagtaaaaattttccaaatgaattatattgaatcctgggccagatattgagtagatattggggatataaaaagaacaaagtacaaagttccttcttttaaaaaagcatatggtataatagaggagactcatacttgtacaactaactacaataattttaccccctgggagtgatggtgatagttaaggtgtactgaagatggcgtcacagaacgcgtcattgaagtgtacgtttgatctatataagagacacaggggaaagttatttccaggtggaggtaaaaacaaagttaaagagcttaacagtctcagcaatggcttgttgtctaggttaacagtgtgtgtcaacgggtagtcgagggagatagggatagcaattagaggaccaggctgtctcccttttaggtgggtggaagcaacgggatttgaaggctcagtgtatgaaatttgatgataactgactcagcactaacattctagtttagtttttttttttaaagagcgtgtctcattacagattattgtaaaataactataaaaacttgattttttacagtattgtcttttagaaactacttgaaaactaggtacaacatacatcatcagtaacagtacatttatataattgaggaatgcattttgagatgagaatatgtactgtgatgtgtaactatcaaatttgtgtttaatcacttgtttgccatgggccaaatagctaaattttggctttactttgaatgattgtattttagaagttggtaatgcaactaaatttgaggaatttttttctgcattttagtaccattagattaaaagctgaaattggtgttttaaagtaagctccttttacctttgcaaaaaaaaaaaacttgtttatgtgtttttatgtcttttacagtttgggtttttaatacttaatttgttagtataaaaagaatacttggcagtttgtgtttttcccgcccccagaggaggtgtccgtttccaaatagaaacaaaatcagggtcataataattaatactgctgaatcagattcaaaagattggtgtttctgtggataaattaccattttcatttgatgaaatggatttacttggggattggttgaatcaccggatcatgcaattctaaattattgtgttagcattataattgatcctggccaataggagcgaggagagagatagctttcctttttctacctgaatgtcctgctctatcttcaagcaagaatgtagcagggctggattattgtttgtgcacctaatccattgagcagtgttcactagttgttgcgagaagtcagggaccccaaacggagggactggctgaagccatggcagaagaacgtggattgtgaagatttcatggacatttgttagttccccaaattaatacttttgtaatttcttatgcctgtctttacttcagtctcttaatcctgtcagctgaggaggattatatcatctcaggaccctgtaataattgcattaactgcacaaattatacagcatgtgtgtttgagcagtatgaaatgtgggcaccttgaaaaaaagaacaggataacagcaatgtttaggcagcaagagagataaccttaaactctgactgccggtgagccgggtggaacagagccatatttctcttctttcaaaagcaaatgggagaaatatcgctgaattctttttctcagcatggaacatccctgagaaagagaatgcgcacctgggggtgggtctctgaactggccccccgggtgtggtcgtctcttatggtcaagactgcagaggtgaaatagactccagtctcccatagcgctcccaggctcattaggaagaggaaattcccgcctaataaattttggtcagagaccagttgatctcaaaaccctgtctcctgataagatgttatcagtgacaatggtgcccgaaacttcattagcaattttaatttcacctcggtcctgtggtcctgtggtcctgtgatctcgtgatctcgccctgcctccacttgccttgtcatattctattaccttgtaaagtacttgatgtctgtgacccacacctattcgcacactccctccccttttgaaactccctaataaaaacttgctggtttttgtggcttggggggcatcacggaacctaccgacatgtgatgtctcccctggacgcccagctttaaaatttctctcttttgtactctgtccctttatttctcaagctggccgacgcttaaggaaaatagaaaagaacctacatgaatattggggcagattccccgataactagtgttcctttattaatgtgaatcatagacagccatcagtcttctattcatttttgtagttttgtgttaatttcattgttccctttaaaatatagctagctagtgaaaattacaaatatacacattgtattgaaatacaggtatattttatggtgataacaattatttcacaattttcttgatgaaaacaatatggtgaacattttaaactatttaaaacaagtttagtttattgaaactagtaagttcaataggctatacgcacagtacagataaatataaagcataacatgatacagaggataggaaaatgggacctaggaaaccaatttttgaatctcgcgatgcaaagaatattactgaacatttgagtaatacttcctgaagaaaaaggattcgtaatagtagagatactcagttggctgacgttttgttttattccaaataaatgactttttaaaatttaattttcatttaacagtatttgtggagctttctgctaggaatggtgttgagtgctagaattttgtataatgtatatttaattcagctttggagtcaagaacaataatgcatctcaaatttttttcttttttaaggaattgcattttgtgaaaaaagaacaagaattttctgcaaggatcatatctaagtgcactttttgctgatacttcatttctagtaagacattttttcttttctatgttaagtagatacaatggaaatgtattttaaaaatcaggctgttcttgtgagattgaatggcagttattttagaggttttcttgggggcgaggggggcttaatttagacccagttgaggaaatttgtaaaattcggttgaaatgcgtaatattgtgtagtggcagtttctcttatattttgtctgacgctgctgaaatcatctcatattttttcatctttcacacttcttccatattctctatcagttaacctctatttgaagaaagaagaaaaaaaattaagtaggtagttggtagttactgagacagttaataggatgaagggagagttgggggacatgagttacatgagctgaggaaagattttcaagtgaaagatgacatgcatgtctagccatatctcatgaagcatgggaaaggtcaaatagaaaaagcaaattttaggggatcttttaaaaatgtggacatttttaatgacttggaatttactgccttaaattaatgggttcatatttgcaaagctcaggaggagactattttgattaaaaaacttacattggcctaggttaacattcacagtatctcagtaagatgtgtagtcctcaaaagttttcatatgtgtagtcctcaaaagttttcatgagtgaaaccttacctgaattccaccttctacttaaaatggaaaagaagtgaattatattaatgctagaatattttaaaataagtaattttgaaaaatgttaggggatattctgcagtgtgttataataagttaacattagcattttaaatattagatatcattgatccaggctgatgattatgtcagtaaaaatcttggaaaaggtatcttaaaaatttttattttgcccatttcaggaatacttttgctacttaacataggtctaaattttttttcttgaatgattaaatagtagaaagaaatcacattttacaaacttagaaaaatgagttctttgttgaagtatgatattctgacatcagtttcatatggttatatatttttcttgttataacttgactgaagaacagcccatttaatgattgataatctttagtttaggagactaggagaaaaaggcctgtttatccaactgatgcaaagtaccttcagtttaaaacttgtgtatgtgtaggtgggatgggaacagtggagtttaattctcattttaaaatataaaccttggttagtcttctgtaaatctttttcttttctcatcattacagttggccctctctacccataggttcctcatctgtggatcaaccaactgtggattaaaaaataccctatacttcaaaacaataaaaaataatacaccaataaaaaattttacattgcattagatattataaatattctagagatgattcaaaatataggaggatttatgtaggttgtatgcaaatactgcaccatttttatataagagacttgagtgtcctaggattttggtatccatggaggatcctggaaccaatttcccactccacagatactaagcaaggattttacttaaatttctcacctgtttgttttgttcattaactgctggaaactgagtgatatgagctaaagcactcatgcccttagctgagaactctgtactttctctgaacctcagtgatggctgtgggtataacttcagatgttatattttgagtcatgtttagattttagggaattctctatgctgcttcctctactagtctctaaggatgtagacagtgtcttatccttcatgacgggccttctatggttctatgggttgtgcctgagttaataactacttgtttaggagttactcttgagtgtttagattggaaatgtcctttctttttgaatagattcgtatgttaactggcgaagctcagattagagattttctttacaattctgctgcagtagaaattgaaggtttgtcatagggattagacagaatttctcctggctttccttcatgtcttggaacttctttggactactacattgaggtcagtgatccattttgaattaatttttgtatatggtgtgaggtaagggttgaagtttatttctttgaatatagatatcatattgttccagcagtttttttgaaaacattatattttcccctgttgaattatcatggcaccattgttgaacattaattggccattatgtgtgggtctgtttcaggactctgttctgctgatctatatatccttatgacagtgcttcactgtcttgattactgaagcttttatagtaaatcttaaaatctggtaatgtaaatcctctaagtttgttcttctgtttcaaagttgtttcttctattctggatcctttttatttctttctatgtagtttagaatcagcttcttaatttctacaaaaaaagcctaacaggatcttgattatgaatgtttttaccctagagatcaatttgggagaattgacctcttaaggatattgaatcttattaatgcgtgagcttggtacctctattcatttaagtcatctttactttttctcagcagtgtcttgtagttttcagtgcagtggtctgacacatagtttgttaaattcatctctaattattttaactttgttattataaatgggaatttaaaagaatatcagtttccaattgattgatgctagtctacagagatagaattgatttttatataaaactttataatttgtaatattgctaaattaattattagtgctagtggcttttttgtagatttcttcaaatcatctgtgtagatcattatcttctctgtgaataaagactatcttatttcctccatttaaatttatgcaccttttattacttttgcttgctctattagactggttagtagtcccagtgcaatgttgaatagaagtggtgagaactaacatccttgccttgcttctgatcttaggtggaaaactttgagtttttcaccaggtcttggtcagagtttttttttttttttttttcgttttcacgagtaggtgttgaattttggccaaatgttttttctgcatctattaatatggtcacctacctcccctcctgtttgtctgtgcatatggtcagttacattgattgattttaaatattgaaccaaccattcatgtattcttaggataattatcacttggtcatgatgtgttatactttttgtgtattgctggattcacttgctaaaattgcgttgactcttttaaaaagtctacattcatagaaggcattggattgtagtttttgtctgttttgtgtgtgtgtgtgtgtgtgtgtgtgtgtgtgtgtgtgtgtgtgtgtgtgtcagggtaatgctggtctcagaatgagttaaaatttcttgttcttgaagaatttgcatagaattgatgttatttcttctttaggtgtttggtagaattcaccaatgaagacctctggacctggaggttctttgtgggaaggttttaaactgttaccagcggtgaatctgcatgggtctacggcaacctcagttcttgccctctcagaagaaagaattcaactgaggggtataaggcagaaggagagaccgaggcaagttttagagcaggagtgaaagtttattaaaaagctttagagcaggaatgaaaggaagtaaagaacacttggaagagggccaagtgggcagcgtgagagatcagtgcgtggtttgacctttgactcagggttttatatgttggcatacttctggggtcttgtgtcccttctgccctgattcttcccttggggtgggctgtctgcattcacagtggcctagcacttgggaggggagcctgtgcagtgtgtttactgaagtcgtatgtatgcttccttgaggtattcttcccttaacagtccaatgtccctaggaagtcatataccagttaaacgctaccattttgcctcttaatgcgcatgctggagcccatatgtccaactcctgagatgttatagggaagcggctgatcaccagcttcaggtgttttctatctgttgggagactgcctttcactggcttgggccgcgaccaattatcattttagagagacagtttaacaactgcctgaccgtcacctggtggttgcctgacattcctggggtgtgtgtgtgtgtgtgtgtgtgtgtgtgtgtgtgtgtgtgtgtgtaggggtggggagctttttgtgtgtgtgtgtgggggggtgggggtggggagcttttcgtgtgtgtgtgtgtgtgtgtgtgtgtgtgtgtgtgtgtgtgtgtaggggtggggagcttttcctgccctgctcatgtctgactagctacctactgtaacaaaactatgaatttggtttccttaactgatacagggctatttggatttatgttaattcttgttaaataagctttagttgtttgtttttcaaggaatttgtctattttatgtaagttgtctaatttattggcacgaagttgtattttagaatccctattcttttacatttgaagaatctgtagtgatattccctctttcgttgctgatatttgcaaacttccttctttttctaaaagagtatttaatcttttaattttcctttgtttgcatcctacaatgttagtaatgttgtgtgttcatttacatggagttcagagtattttaaaatttccattgtgattttttttccttgacccacgtcattttcaaatatttggttaattttccagatttctttctcttacaggtttctaatttaattctactgttgtccaagaacatactttgtgtgatgtaagttcttgtcaacttgtggagatttattataagacacagttgtggtggtctgtgttagtaaaatttttttttttttttttcaaagacagtctcactctgttaccaaggctggagtgcagtggcgtgatcttgcctcactacaacctccacctcctggctacaagcaatcctgtgacctcagcctcctgattagctgggactgtaggcatgcagccatcacacctggctgattttgtgtgtgtgtgtgtgtgtgtgtgtgtgtgtgtgtttggtagagatggggttttgccatgttggccaggctggtctcgaactgctgacctcaagtgatctgtctgccttagcctcccaaagtgctgggattacaggtgtgagccaccatgcccagccagtgttagtaaatgttttgtgtgtacttaagaagaatgtgttgagtggagttttctaaaaatgttaactaggtcacattggttgatagtgttcttttaagacttctgtgtcccttttgattttctgtttgtttcaataatttctgaaagagaagtgttcaatattcaacttcaattgtggatttatttttccttttactggttcatgtgtttggaggctctgttactaggtgcatgcgtaataagggtttttatgttttcttgatgaattaggtctttgtcactattaaattttgtgaaatagtttgtgaaatagtttgcatagtttctgacaaaaagtctgctgttcttaccttttgttcccagtatgtaagttttctattttctttggctactcttaagactttattactaggttttagtcatttgattatgatgggccttgtatggttttctttgcaataatgctgcctagattttttagtttattgtttaaaaccaaatttggaaatgtttcaccactatttcttcaaatatcccacttactccaggtttttgtttttgtttcccctgtaattttagttatatatttgaaatattgtctctcttggcactgatactgcttttgtttttcattcttttctttctgtctgtgctttattggttggttaacagtaccatgccttcaagttcactgatcttttcttctgcattgaataatcccatccagggtgtttttaatttctgaaaatcatttttcatttctggaagttttatttcttccattattctcttcatgttcttatttttctttgtcttctgtaacatactaagtttatttataatctttttttaatgcccttgtcagttctgttaactttatcatttttgaatctcttcatattgattgacttttattatatgggccacatttttttgcctcttctcattccctataatgtttggatgctggatgttgtggtttgacattgttgggcttaggggttttgttttttttttttggtatcttctatatagtgttggactttgtttttgtacgtgtataagttagtatcagctgaatctttttgtttaagcttgtcagtgttggtccagagaagccttttccgtggggttaatttactgcccattaaggttatatccttttgagggctatactccatgctcttctgaggattattctcaattcaaagtaatcccaaacaatattccaaaaattttgttagtttatctgcttttgttggagacagagtcttgctctgtcgctcatcctggagtacagtggtgtgagctctgctcactgcaacctccacctcccaggttcaagctgttctcttgcctcatcctcccaagcagctgggactacagtcacgcatcaccacacccagctattttttttgtatttttagtagcgacggggttttgccatgctggccaggctggtctcgaactcctggcctcaagtgatctggctgcttcagtctcccaaagtgctggaattataggtgtgagctgctgcgtcctgcctctcttccacttttaaagatgtgttcactttgagccaacccagataatccaaattaatttacctattttaaggacaaatgattaccaactttaattccatctgcaaccttaattctccttttccatgtaatgtaacatattcacaggttctggcaatttaggatgtggttttctttcctgcataattattctgcctatcacaacttccaaagttgaactatattgtgcaaggtggacatccaagctaccaacaatgttgaaagcttagatttgttcaacacatttacagacgttacattcttctttatgcctgaaaggtagaccttatacataaagcatgaacaagtaaattggtatgcttttttgtaggattcttggctcagggcccaaggagctttacagtactttttagattttagatttaaaaaaaaaaaaaaaggggctgggtgcagtggctcgtgtctgtaatgccagcaccttgggaggccaaaggtgggtggatcacctgagcctaggagttcaagaccagcttgggcaacacagcaaaaccctgtctctacaaaaaatacaaaattagccaggcatggtgacgcatgcctgtagtcgcagccactcagcaggcttaggcaggaggatcacttgagaccgggaggcagaggttgcagtgagccgagatcatgccctgtgttggattttaaaggaaattttgtggcccaagaatagctaaagtagtcttgaaagaagatcagagtggaagaactttctctattaaaaacttatataaatctacagtcactgatttcatgaaataaagccacaaggataaacaaaagaaattaaatgcctggaaaagggttcacatgtacacggacacttgctttatgacaaaacgcacactttagtagggaaagaattagtcaataaatcgtcctggaacaagtgataatctgtatggaaagaaatgacttatgttccataccatatgcaaacatcagtttaagaatgattcgtatatttcaacatgaaagacaaaactgaaacttttggaagctaatatagatgaacaggttcatgctctttggccaggaaaatatttcttaaaaaaaaaatcaaaacggcaagtattaaaaaattgataattttgactaccttaaaattaagaaattttgttcttgcaaagtcaccattaagaaaagagaggcaagtcagagtagagaagatatctgcagtacctttaacagacaaaagacatgtatcagaatattcaaagcgcttctacaaatcaatgtgacagagacaatccaatagaaaaatgggcaagagacatgaaaaatacttcacaaaagaaattcagatatttaagaaacgtggaaaaaaaagtgcttaaccttattaataatctgggaaatgcgaattaaaaaaaactaggctccaccatatgcccactagaatggctgaaattttaaaaagggatttatagtacaagtttttgagaggatgttaggttatgggaactcagccactttaagaaacatcttgacatttacataccctgtgatgcattaatttcttttcatgggtatacacttgagtaatacatgtacatgtgtgtggagggatgtgttaaagaacgttggtagctgtttgtaatagcctcacactcaatatgatgttcatcatagttggctacataaataaactcatgatacattcatacagtggagtactttacagctgtaaaaatggaataactatagctatggataaatatcacaagatgtttctcaaatgaagccagaaatcacacattatgtgtgattccacgtatataaagtaaaaacaaaacatgcaaaaataaaacaggtaaaataagctatgatgattagggatatgtgcttatgccatgaaacggaaaatgaataacagcaacaacaaccacaaaagagagttgctaccacaataatcaggaaaattgttgacttctaggtgtggtggaggagggatttaatgattgttgaatagtgggtgattttaggagtgctcatattctcttagatctgaattgtaacttgagtttgtaatcagtccttgaattgtgaatttttgttttatgtatttttacatctctgatatatactcaaaatcatatttgactgaataaatattgataaggttagacttagagcacatttatcaggtttgattcagatgatatgaggttaaaaggttttaatatatttgatatttgaatcatgatgtagagaaccgagattatttctagtaatgataattcatctttttgtatgatttaattatttgtaaaacattttttcccccagtagttatgacatcctgagaagtatttgagataggcataagtatctgcattttacaaatgagggagcattaattatgagagtgagttgttggtggtagaggattagaatctcattttcatttctatgccttgccttgctgtatcctttatttctcttttgtgtcccatgtgaagacaggacgttgttctttatgttggtgtaattaatctgaggatgaaagagcatggatggaggggctctcctcttaacagggcagtttacaaagtctcctttctaatgattttcgtaatactatgcttatctctaaggagttcaaggtgccctgtgattatatcatcagttcttataatttcctgtaggagttttgagccatagtcttgctgtgctttgtagaaatgaattgaggtagtagaagacatgaatcaccgaaaatcaaattataattcattgatacatttgatattttatagactggtcatccagataaaaattttgaagttagtagtttggatgatttaccatgatcaactaatggtttatgtagttttaaaataatcatatgtcctgtttaaggaagcccaacttaaaaaaactttgaacttcagcagttaagtgaagggagtgattattgacattacaaaaaaaaattacttacagctttaatcaaatttagttaatttcactgtgaatgtaaggtacttgcactatatttgctattcattgtataaaacatgttgcatatttcactaatagtaacaggctgtaaacagtttacccttaagcttcttttatttttcaacattcagctttgaatgtctctaatctaaaaacactgtgtggaagcatacaaaaatatataacttgttattaatcagagaaatccaaattaaaatagaaagatgccatctttcaaaccatgttttagatttttagatgatttctcccctcctcccatcctgtttttgttttggtgtattgactattttacctaaaacataagaagtaaacacatgataaaaagtaatactttgggcgagcgtggtggctcacgcctgtaatgtcagcattttgggaggccgaggtgggtggatcacctgaggtcaggagtttgagacccagcctggccaacatggtgaaaccccatctctactaaaaatacaaaaagttagctgggcgtgatggcaggcgtctgtaatcccagctacatgggaggctgaggcagggtaatcacttgaacccgagatgtggaggttgcagtgagttgagatcgtgccattggactccagcctgggtaataagagtgaaactccgtctcaaaaaaaaaaaagaaggtgctattttgttgttctgattttaggcaaaggtaccagtattcagtatttcagttgtcttaacttttctaacaagtagatagtttagaggtatcatagctagaccacagctagtctttgcaaagttggaaaaggcccctctgattttaagtaaatagtggcttctgctacagttaaggtgctagacagtggaagacaagttggctttcagaccccacctgctcactcttggccccaggcccatgtgcatggcatgacattgttcataatggctttgggtcatagtgatttcttgctctcttctagttagtaagggattatttttctcaatgctgtgtgtatttttgtatgtttattgatcttatttcttgaatcagatgttagtatttttgaattttacctaaaaatgtataataacctaatttaattcagaacttcataaaattagtgtgagtatttgtagggtatgttctgcctttatgaaagttacataaagccaaactgcactttcaggtaatgaccataagtctatgagatttatattcaaagtacagtttatgtttttgttatcgaatcctttctttatggctgtgattgtgtttgtacgacataatgttgtattttaaaaacatatgataatatagcatgtacaattgaggctcaaatggaataccttagtcattttccataaaataatagcttatgatagtctcaggctaatttagaatttgaattttgcctggatttaattgtaaacattaattaaaacatcttagtttagtgggaacaaagaaaaattatcttatattaaaagtaattagaaaataattccataagggtaaagaatctgccattgtgttacaaattatagaataattctcctcaagcttgacaaagagagtatacagtatgagtgggtttttatttatatattttataagaaaatatatggcatcatttttgtgtgtggaatgtagttgccttgtcttatattaaaactgggattaaaattaattggcatttcttgattctggtttttcaccatcttttagcaaagtagacagccacttgggtttcttacttagatcaattttttttcattctagtggatactatttagaggacccagggtatcatatttaaatacagtaaaaattttaaattaaccatcttttatattactggaagcatttgaaatcaagaatcgtatagagcactggcagtgaacaatccaaaaatgaaattatgaaaattatatttatagtattatcaaaataatacagttcttaggaataaatttcacaaaagacacagagcacctgtacactgaaaactacaaagtatcattgacagaaattaaagaagacctaaataaatgcaaagacggtaccatctttattgattggcagatttaatcttgttaagattatagtcatcccaaattaatcaacatatttaacacaattcctatcaaagtccagctggtctcccccgcccccccccccccccacccccccccgaaattgacaaactgatcctaaaactcatacggaaattgaagatacttagaatagccaaaacaatctttaaaaaggataaagttggaggcctcccacttttgaatttgagaatttactacaaagctactgtaacctagacagtatgttactggcataaggataaacagatcaatgggacagaattaagagtctagaaataaacccatgcatttatggccaattgattttttttaattattattttttttcacaatgatgccaagacagttcaatggagggaaatagcctttttaacaaatggtgttcagacctctaacactatatacaagaattggctcaaagtggatcaagtacttaatgtaagagctaaaactatataggctaagtcttcatgatcctgaatttggcaatggtttcttagaaataacatcagaagtagaaataaccaaagaggaaataggtaaattggacttcagcaaaattaaaaacattttgcttctagggacactatcaaggaaatgaggccgggtgcgttggctcatgcctataatcccagcacttcgggaggccgaggtgggtggatcacttgaggtcaggagttcgagaccaacttggccaacatggtgaaaccccatccctactaaaaatacagaaattagccaggcgtgatggcagggacttgtaatcccagctactcaggaggctgagacaggagcatcacttgaacctgggaggtggaggttgcagtgagctgagaatgtgccactggactccagcctggatgacagaacgagactctgtctcaaaaacaaaacaaaacaaaacttgatgagtgggagaaggtatttacagatcatatatttgtaagtgttagtatccagaatatatgaactcttacatcgcaacaatgaaaagacagtaacccaacttcaaaaaggattttctccgaagaagataaataaatgaccaataggcacatgaaaagatgcttaatgttatagttgttagggaaatgcagaattaaaaccacagcaagataccacttcacacccaccatgatggcataataaaaaaagacagaaaataagtgttggagagaatgtggagaaattagtatcctcatactttgctggtggtaatgtgaaatgcttcagactccttagagagtagtctggcagttcctccaaaagttaaatgttgttaccatatgacccagcagttctgctcctagcgatatatctggtagaattgaaagtatatgtctgcacaaaaacttgtacaccgttattcatagcagcattatttataatagtcaaagtggaatcaactcagatgtctatcacctgatgaatgggtaaatgaaatgtggtgtatccatacagtacaatattattcagccaaaaaaggatgaagtactgattaatgttataacccagatgaaccttgaaaacatcatgttaagtgagagaagccagacacagaaagctacagattgtataattgtatatttccagaataggcaaattccatagagacagaaagtagatgagtatttgctggggactagggagaggaaggagtggggaatgcctgctaatgagtatcaaatttctttttgggatgataaaaatgttctataattagatagtggtaatagttgcactgctttgtgaatacgatttttagaaaaacaccgggccgggggcagtggctcacacctgtaatcctagcactttgggaggccgagatgggtggatcatgaggtcaggagatcgagactatcctggctaacagggtgaaaccctgtttctactaaaaactacaaaaaaattagctgggcgcggtggtgggcgtctgtagacccagctacttgagaggctgaggcaggagaatggcatgaacccgggaggcggagcttgcagtaagccgagatcacaccactcactccagtctggatgacagagtgagactctgtctcaaaaaaacaaacaaaacactgaattattcacttttaaaaggtgagttttgcggtatatgaataccattcacataccatatttaaactcaatttaaaaatcatatagaattgaagacaccaccctgaacaacacagtgagaccccatttcttcaaaaaactttttttaaaaattagcagagtcagggcaaaggagaggagctgagatgagagggttccttgagcctaggaggttgaactatgattgtgctactgcgttccaatctgggtaactgagtggaaaccctgtctttaaaaaataaataaaggaaaacagtggtgtacttctaataaactgctatcaaacctggatacttttgacagtgaggggtcttacttaatagttacacctgtctcaggtaaaccagaatgtatgttctccctactttggtgtgttgaaactatttttccttcagaaatgtgaagaatataaaattcttctcatattcttctttagcaagtgaaaaaaaaaaaaggaaaagaccaagaaagccatgtaattcaaggaaacgggagagagagatttctctatggaaatgaaggccataaatgtgtgtataaattgcagtgcgtagatataatgcaatcaggacttgattcatttgtatgattttgctacttcactcttgtacatagccaatcagtgtttgaataaagagtgtaatattgtaatataataaaacagaggctgtgaactaaagacgtacatcatcgtaatctgtggagcttttaaaaagtactcttgcttggatattagtctcaattatgatttgctggttttattgtggggctagggcaagtttgtgcatgcagagtatatgttttagttcctcagttgaatccggtgttcttttaaattgagaaccactgcattagatcagtgagttttattgatccatttattgaactatctagttattattgttttatgcaacaatagtaaacggcagtaggaactgagagaacctcaatctaaacaatacacactttaacagtccccgcacccacccctcctagggccatccctgtgggtaatctagcaattgtgattcctctaagtctttaataattgagattgagaggagtcatttatttctctttttttaaaggtaccttgaagcaggagtagtagtgggaagtaagaagctcaagttcctttgcaaatgcttgcaactacagtatatccctggaaggcagggaaaggttatcagcgttgatagcagagcaggagggattgggaaatggagacctttgaggaggtcagaactcttaaattagctgataagtgctcaaggcatttgtattttgacagcccatggtagcatcagataaattgccttttaacggggaacgtattgacatgtagtggtccttccacatgctctagtttcccttgtgcagccatacacaacttagtagaaattgttttaatattctactactgaaaagtaccataaactcatgaaattggggttagatggctccttgaaggttttatcacatcagtggcatttttaaccactatttaaatagttccggtggtgataatgtactgttatggaaaaagacatgatattagggccaaaatttcaactctgcctcctagtgtgactttgggtgagtactgattgtttttactcgcagttgcttcatttagaaagtggaacagatgccatctacctcacagggttattgttactgttacatgagataatatatattaaggtctaacacagctactgataaatgtagaagatatttaataaatattaagttaccttcccttctgcagttcagtgaagaataacttctttttttttggagatgaggtctcactatgttgctcaggctggtcttgaacttctgagctcaagtgatccctcacctcaccgtcccaaagtgctgggatcacaggcgtgagtcaccgcgccaagcccaacaataacttataactccaaaaaattggttcttagagaatgtccaatagcctgggattgtgaaatctcatactttgacttttgctttcatttgttaagcaactatggtagcagctgaggttataggagtaaatacaacagacttgatcttctcccttggttacagtttggttgggggaaaagaaatcaaacatttaattgtataaggaagtaattacagttgaggtaaatgccataagagagaagtacagtctgttaggaaagtgcattagaaatcctaacatagtttggatgttagggaacatttccttgaggaaataatggtaatactgagacacaaaggatgggtaggactgtcagtaaggagaagggcttgggataagagctactgagagagagcaaggtggtagtatgtatgaaagccctgaaacagaaaggagttaggagctttctaagtacataacagcttgtgtcaagaagcttgctgggcaagaggaagtgtggcatggaatgaggagttccatgagtagaggagtgacaggataaggcagagccttacaggccatgttaaaggcttgggcttttaagaacagtgataagtgacatgattatattggcacgttaaaaggttgctgtaatgaaaatgaggaaattgcactggagggaaataaaagtgcctgctgagaccagttagggggctgttgcaatgcttagggtaaaggtgaacagtggctggtacagaaaaggaacaggcttggtgtgtttggtttaagaaaatgttgggttttgagatacctgtagggtatcttaagttgagtagttgagaatgtggttggatatagccagttaggctagtgaggtagctctggctgaggcctttgcagtaggctgataagctgagtttctggtatttgtcttttatgcagacttaacagcaacttgagtgcatgtgttgtgagtatttttatactcattattttacagtttttaatattaagtaatgattatcacttaagtaatgggtattgcattattttacagtttttaatattaagtaacggtaataataatggccaacattgagcacatgtgcagattactaggccaaatacttcatatgtgttatctcttaatctttacaagtttatgagctttattattagtccagtattttaaagatttggcatctgaagcttagagaaattgagtaacttctcaaggcaacccatgtagtaagaggtggagctgaggtttgaatgcaggcgggcatgctgcagaccctgtcctgttaaccatgttaaccactaccgtatgccacttctctgtgaaatttgaaccaaccagacaaaccaaacagaatgactgagggaccatttattagtgaacttttatggaagacctgtgtatactacacgttgtactataggtgatttgatacagtctcttatttacatcaacattcacatggcctgtgaagtatggtttttgcctcattttaaaaatgaagaaactgtggctgagcaagtaagtgacttggtcaagatcactaatagctatttagtggaacttggattcaaaatggactcttctgtgttatactacttaaaaataaaaactgtgttgacttaaaaataagaaaatttcgctggggaacacaattagatttagtggttcccatatatcaagccacagtcagactagttcttaaaaaaaaattagatctcaatgtttaaaattatagattgaatttagagaacaaacagctgagaaaattgagatacttaaaaataaataataggtattttacgtgtatacaaagtaaagactttattaaaattattttagaaaagataaaatgagaaaatattttctaggaaatgtgtatccattttataatatctgcgaataggttagacaaaattacaatattgatgactgggttttttttgtcaatagttaattgttagcatttgtataggactgcatcttgatcttgctgtaatcactctgtcctttaaaatttcttctgtttcttccttagttttgagaagacaaatggaaattaagtcaatgaggtaacatattataatgcatcttaaatattggcttcttttagcatcagagttaagactcatcttaccagtactttctactgcctactaaaaattaataagaggcaattaagcatagtattaacagtgtagctcctttgggatctggtttttggaatactctgttttcagtaagccctttgcagagagatttagtcttaggtatatactaaaataaatatatatatatatacacccatcatgtgccttccacttttttactgacagttgatgatgagggacatcttttgggtaccggatatctgtaaagtaatgttatatttggttttctttcggtcgatgggtacaccattgagagctgtggccatggggcttgttattacagtaagaaaaagcctatctcctgaggctagcagaacctgtctgaaacagataattggattttgattggttggctggatgtgagagcctttttgaagcagtcttataaggtgcttttgattttaggaagccaaatcaacaagttactcttccactgtctcctgccttgtctttgttacagtcatttatttgtcttttttcatgtgattatgatctgtgtatcttacgagaattgcttgctcttctttgaatgctgtcttctgtcacccagcactgctgttcagcagtttttgaggacttaactcacacatcatcatttcttataaagactgccatactgagttacctataggatatcagaaacagtcaacttcagaactgtatgagaagtttcatttttaaggccatatatgtgtttggtttttttttttttgtatggtctgtatttatttgtaaggtatctttgctttctatttctagctttctgtatcatctggcattttgacttagatgattttggtcttcttgacactttagatatgttattagtacagtttttatggctagaatagaaaatataagatgaaatgacagagcagagaaagaatatttatgatttgacatgaaaatgacctacctaaaacatttttgaatgatgtataatctccttgtccttttgggaacagattataatcagctcttaaattatcagcatgtatgtatcaggatactttctgctgcaagtaacagaggctaatcaaaacaggaaagattttaccatctcatataatgagaagtacagtagggtggttccagggttggttaactccagtcactctttcatcttttctttgttattttcattttcttccactctttcattctaaatttttttttgttaaattgcccataactattagcatagtctctaagcagtgtgtggttgacataaactgtgtttatgcctgtgggggagaagaagcagtagtcataggcttctttgctctgaattgtttctaatgattctagtgtattttctgtttcatcttttattctcgtagttgaacccaaaggaatatgaattgttgtctagatacctaacagtgtttatttgtaaattacatgtaaacatttaatgaaacaaactttaaaaaagcacagaaaatcagtgtttctctctgtagtcagaagccccacagacaataaagcatcctgtcagtaaatccattgcacttactgtgatgtcccttgagttgtaaaacatactaatctttgcttagcagaaattataatcttcaattaatattacatattacatttttagaagtgctttatagatattagaaccatggaatgttagagctatgttaccctaagaaggatcgagaatcacttgtgtagtattttggctggaacaatcctaaactgaggaatattctgtataatgactggcttatattcttgaaaatgtcagtgtcacaaaagagagaggccaagaaactgctctagattacaggagactaaagagactgacaactaaatgtgatatataatcctgaattgatcctgttactgaagagggtaaaaaatgccctaaagaacattattgggataagttacaaaattgcaattatggcctgcgctttaaagtactgcggcaatgttatatttattgaatttgataactgtgcagtggttatctttatattagagaatattcttcttaggaaatttcgactttaaatattgaggtgtaaagggcgtgatatatgcaacttacccacaagcggttcagaataatacatttatttatctatgtttatatagatgtgtagtacatatacacataaacatatccatgagagtgagaagagagagaatgaaagttaatgaaaaatgttaaaaattgatgaatctaggtaataggcaggcattctctatactgttcttgtaacttttcactaagtttgaaattatttttaaaatgcaaagttaaagttgtaagttaaaaagtaaaataaaaacagtttttctaaatggttgcaaatatgagtatacttgctaaagacaagctttatgttttaaggcatgtgtgaaatttaaattgtgaaaggataggtatactggatctaggaagatctacattccaaagtatgagcaaataggaggtggcagcacttgaagcttgaaagattgtaacacctctggcatggctattgaggatggaagggggaaggagggaaagaaccaggctgtgagagcggtggtggatttctttatgtctctagggtttatagtcaacgctcctttggcagcagtgagatgaggatttctgtggtagggctgggcaagtagcagccagactccttaccttggggagagccctggatctacagtccctgggcaaggctgctgcattgcgcctcagactagctgctccgaaaaccaaggcagggctttagcttctcaccccctcatgaaggcagcagaatacagcggttggagtgctgttctggaataccacagacctgagttgtcttggctccagtatttagcatctgcgaccttggcggggtgatatttactgcctagtcttcagttatttttcagatttaaaatggggataataataatgcctgtcttataaagaggttgtaagaatttaaaaagttatgtgtgaagtgtattgctgttgttactatgcagcagggccctagaaaacctttctttctccattcagccaactgattactcattttgttttcagatcataaatattcacatcataaatgttaatgtgttctataccatgattgaaaatgtgtgtgttagtattgtagtaatactgtcttttggacccctttcttcaaaatatttgcaaatgtgtggtattttattctggcctcatgtggtacatataatgcatataattggattttcctgttataaaaagtcacttttacttagaaattgtcaggtgccaaaggttatacagctagtttagtgacaggtttggggctgggatgtaggttttctcacttggcttgcagtaaaccttctcagtcaggttgtgaagaaagagtaactggaaattgcacaagatagtaaagtagaagcaacatttcagtaatgtttaaagttttctggcattcaggatgtttttcttcttaaccttaaaagcatccattagttcttgttttgtagtaactttttttcgtaccacgacagtggtgtgtattttagaaaaaaggaaaataattttttaaattgcctttaagttattattttaaataacttgagtatatgctgctagtcttttatctgtgaacacaatatctacagaatttttttctttgacttttatttttggttcaggggtatgtgtgtatgtttgttacatgagtaaattgcgtgtcactggggttttgtgtgtgaatattcatgtcacccaaataataagcacagtaggtgatagtttttcaatctttacccacctcttacgctcctccctctagtagtctccagtgtttgttgttctcaactttgtgtctatatacactcaatgtttagctctcactgataaacgagaacagtgggatttggtttctgttcctgtgttaattcgcttagaatgatggcctccagctgcctccgtgttgctgcaaaggacatgattttgttctttttatgactgtgtagtgttccatggtgtatatgcatcacgttttctttatccattccactgttgttggatatctaggttgattctgtgtctttgctatcatgactagtgttatgataaaacgtacatgtgtctttttggtagattagtttattttcctttgggtatatacccaataatggaattgctgggtcaaatggtagttctgttttaagttctttgagaaatctccaaactgctgtgcacagtggctaaactaatttacattctcagcaacaatgtgtaaatattccccttgctctgtaacctcacaaacatcttttttttttttttttttgggacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcaggtaatctaccctcctcggcctcccaaagcgctgggattacaggcgtgagccactgcgcctggccagcctcaccgatgtctatctacagaatatttaataacaaaactagaactacatttttcctacccacaacaatacattgtgaacatttattgtacagtgttccacctttttaatggctacagtattgtagggacaggccacctctgtaggcttctatattattcccctgccatatattcactcttttgattgtgttgggatgaacatccttatttgtatatttttctcattttttttttcttagactaaattcttgaaagtagaatggatttttcaggggaagctgaaattcatttctttttgaaatactaaatttttaaatgttgcccaaattgtttaaaaactttatatctacaggatgatttgggggccattcatttgcaacagtagtaagtgtttctgttccttggggctgagtttgctgttttcattttacattttgtccctttactattgtctatatgcccaagactcccaatgcttatttttagccctgatgtatgagtcttatgtctagtttcctatttgacattttcacttgtccatgaccatctcaagtttcgtatgtccaaaattaaatccttaagttccattcttttaaaaaagtaatagatccttaaagattttcttttgatagagatgcctgtttatttcttaaaggagttcagttgttgattgtacataatcatttttattccaaaaatcatttgctagtttaaaaaaaattttaatgtgtagttgattggccagagtcatcaaaatggggtgttctgatgaactcagtgattggtgttaataaggactcagtttaaaaagtaaagtttaccccctgtttaaagtccatgctcttaaaatatttatttacttaagcaacaagtttctttaaaacagtaaacaaaattgagtttaaaagactgtgaacatttgtaatcagtattagtattaaattggtctgaatatgagtgctagattctatgatatcttttaaattaagacagtagagcccatattgggaatgtttttaaaaatctggttcctgattttttaaaaacatgacacatttttttcagttacctgagtattcagtttaaagtaattttttcctgcattcctgttgcctgaataacagatataggacttgggatttaattggagagattcttttttccctcctaggaaaagataacattagtttatgggagaaatgcccatctgttttctaaaggtagattttaaatgttgccattttgagtaaaactcctttagctttaccatattgaaaaatcagtacttgcatgatttaaaaagttagtggttagcttgaattaataaaatctgactcctggaattatttgaaagatatatgcatttttttcagtatttgaatattttgaaattgtacataaattttttgaaattgtttgaaatttgtaaaacatacttaacatagaatttaccactttaacccttttaaagtatataggttagtggcattaaataaatagacattattgctgtacagccatcaccaccatccttctttaggatgttttcttttctttttttttttcttttttgagatggagtctcgctctgtcacccaggctggagtgcagtggcgtgatcttggctcactgcaagctccgcctcccgggttcatgccattctcctgcctcagcctccctagtagctgggactacaggcgccgccaccatgcccggctaatttttttttgtatttttagtagagacggggtttcaccgtgttaggatggtctcgatctcctgacctcatgatccacccgcctcggcctcccaaagtgttgggattacaggcgtgagccaccacgcccggcccggatgttttcatcttctcaaactgaaactctgtactcattacacagtgacaccctcctcttgaccctccctgcaacccctagcaactaactaccattctactctatgtctctgaatttgactactttacgtacttcataccaatggactcattagtagattggtccttttgtgattggtttatttcccttacctaatgtcttcaaggttcatctctgttgtagcatgtgacaggatttccttcttttttaatgctgaataatattctattgtatgtatgtaccaccttttagtttattctcccacaggtggacattcaggttgcttccaccttttgactattgtgaataatgcttctatgaacattggtgtacggatatctgagttcctgctttaagtttttttgattatatgtctaaaagtggaattcttggatcagatggcaattctatatttaattttctgagcaaacgccatactgttttccatagcagctgtactattttacattcccaagaacagtgcacaagtgttccagttttccacacccatgctagtgcttgctgttctgtttcttaatagccatttgaatggatgtgaaatggcatctcattgtggttttgacttgcatttcctaatgattagtgatgttgagcatcttttcataggcttattgaacattggtttatcttctttggtgcaatgtctattcaagtcctttgcccatttttaaattgggttatgtttttgttgagtttttaaatatattctggatattaatcttgtatcaaatatatgatctgccgtttttttttttttttaattgagacggggtttcgcccttgttgcccaggctggagtgcaatggtgcgatcatggctcactgcaatctccgcttcccgggttcaagtgattctactgcctcagcctcccaagtagctgggattacaggcatgcaccaccaacccggctaattttttgtatataatagagattgggtttcactatgttggtcagtctgatcttgaactcctgacctcaggtaatccacccacctcgacctcccaaagcgttgggattacaggcatgagcatggcgcccggccgtgatctgcagttattatctttcatttggggttgctgttttactctgttgatagtgccgtttgatgcacagaagtttttaattttgataaaatgtagttttttttgttgttgttgttgatggtgcttttggtgttgtgactaagaaattattgccaaatccaacatcttgaagcttttgctgtatgttttctaagagtttatagttttagcagttgggtttaaatctttgatctattgtgatttaatttttgtatatggtgttagataaacatccaactttattcttttccaggtagatataccattttaccagcatcatttgttgaaaagactgtcccgcattgaatggtcttagcatcctttttgaaaatcatttgaccatatgtgagggtttatttgcgggttctctattctattccactggtctttatgtctgtctttatgccagtaccacactgttttgattactgtagcattatagtaaattttgaaatcaggtgtgagtccttcaactttgttctttttcaagattattttggctatttggagtcccttgagatttcatacgagttttagggtgaccttttctatttctgcaaaaataccattgggatttagtagagattgcattgagtttgtagatccctttgtgcagtattgatatcttaataacatgatcttgaatctattaatataaaacatctttccatttgtttatgtctttattctttcatcagtgttttttagtttttagtgtgcaagcttttcaccttcacctccttgtttcattttctaagttcagacgatacccaacttacagtggtttgacttacgatttttcgactttacagtgttgtgaaagtgttgaattaattacatgaggtagtcaacactttattttaaaatagctttgtattagatggttttgctgaactagactaatgtaagtgttctgagcacgtttaagataggataggctaagctgtgatgtttggtacgttaggtgtattaagtgcatttttgacttaggatattttcaatttatggtgggtttatagggatttaaccccatcgtaagtcaagtagcatctgtattctctttgattccattgtaaattgaattttcttgtttcatattgttcattgttaatgtatagaattgcagctggtttgtgtgttgattttgtattttgctactttactaaatttattagttctaccatttcttttgtagaatctttaagagttttctacgtgtaagatcatgcttgctcatgaaaggattctaggggacaaaagacatcatgtcatcttaaaacagatatttatactcctttttttctaatttggatgcctttatttctttttcttgtctaattgctctagctagagcttccattacagtgttgaatagaagtggtgaaagtggtcatccgtatctcatccctgatcttagtggaaaggctttcagtctttgatcattgaatatgaagttagctgtggaatttttatatatagtatttattatgatgaagtagtttccttcttttcctagtttggttgagtgtttttatcataaagggtgttgtattttgtcaaatcctttttcagtactaatttagatgatcatgttttttttccctctttattctcttatgtggtgtgtcacattgattttagtatgttgaaacatccttgcgttgcaggaataaatcccacttgatcaccattataatccttttaatattcggtagaattcagtttgctagtattttattgagggttttcgtgtctattcatagggtatattggtctatagttttcttgttgtatctttgattttggtattagggcaataggacctcatagaatgagttagaagatgttcctcttcagttttttggaagagtttgaggaggattggtgttagttctttaattgtttggtagaattcatcaatgaagccattgagtctaaagcttttctttgtcaggaggtttttaattaccaattcaatctccttactagttattgctctattcagctcttttttgtttctttgcaattcagtcttggtagttctagaagccttttgtgtttctaggaatttgtccattttatctaggttatcccagttgttggtatatagctgtttataagtaccctcttacagtctcatttatttctatagagtaagttgtaatgcccccactttcatttctgattttagtaattttgagtcttctctttttcttcctagtcagtctagctaaaggtttgtcaattttgttaatcgttttgaagaatcaacttttggcttcgttgattttttttttccgttgtttttctgttatctatttcatttatctctgctctcaaatttgttatttcctgctttctgctagctttgagttttcctttgggggaaaatcacagcatcttaatttttatggctttatatagtatgtgtgtcttttagctttatcattcaaggttttcttggctattctttaacctttgtatttccaaatgaattttagaatcagcttatcaatttccacatacaataagagagaacccgctgatatgttgatagggtttgcattcagtctgtacatgaatttggggagaattaacatctttataaagttgaaatttctgaaattctgcaaatatagatttgcttattattttctacattttaaatttctctcaggatcaagacaagcaaagtcatctaaccgaaagcgaagatgactgatgcatgttggagatgtaagcagagagaatatggcataaaataatcaacaaggaattgggaaatggaaggtttctggaaatggaagattgtaatatgaagggaatatttgaggtttaaggttcatgaccttcatgaacttaaagtgagattaattggcttgattggcatgctaattttttttcacctagccatatttagctacatggaagctggtcttcaggggtcagattttgcaacaaaatggaggcaaggggttggagccaaaaggaggtgagggtgtgaatatgtaactggataaggaagatagtaaggaacacgaagtgggttagggccagtgaaaaagtgggagtttgagatcagcctggccaacatggtgaaccccgcctctactaaaaatacaaaaattagctgaacatgatgatggatgcctatagtcccaggtactcgggaggctgaggcaggagaatcacttgaacccaggaggtagaggtttcagtgagccgagatcacgccactgcactccagcctgggcgacagagtgagactttatctcaaaaaaaaaaaaaaaaaaaaaaaaaaaaaaagacttgctataattgtagacttgacttagtttttttggtgttggctttatatataggcataccctgtttcttagctgaagtttatttaggaaaagtgtatttttacatcacaaaactcagtagtctaacaaactggtatatgtgaaaagtcacaaattatattccaagtatagtttgtagaatattagaattacatttaggcattttgaagcatgtaaagggaatgtgcatctctgatgttgctggcaataagctagacattacaatattagaagcctttgagccattgtcttccatgtgtgtttgtgctaaacatttttctaattgcctttcatatttagcccttatttttgcttagatttgtagaatgcacaaaaaagttgaggaagtgttaaattgtggagaaggaaaaaaagccagtgagaaagtaactgcatatgaagtcatgtagtaagcattttacatcccttagccatggtaatttactataaaaggggatttttttgtgtgctgaattttaaaagagaaatgattggggattatggttgatgtgtaacgtattataatttttccctacttgaaataatgggaaataaatttctggttatggtttttgcacagaatatctgattttcaggagcagattcctaactgtaagtgttgttaggtacactcagatttagaactgatatgtcttcctggtgaattgaacttttattgttttgaagtatccttctatatctatccatgcaatccatgtatatgtatctagtgtctgcctcctgcattcaagtttactatgatagccacacaactttcttttggtttgtgttttacatggtgtgtctttcactatgcttttactttttttctgtatccccatatttaagatgtgtcctctgtaatcatcatataattgggatttttaaaaatccacttctattatcttcttttaaaaattgaggtttagtttaatcctatttaatgtaattacttacatatttggattaaatctgtcatctctgtttgctttctatttgtctttcctttcttgccttcttttgggttatttattaatccatttttccccctcttagctgtttgtgcttttactgttcttgccatagttacccaagagattaccacatgcatccctgactttaaggtctaaagtaaatgagcattttttctacttcctaatcaatgaaaggattttaggacacttttatttcattttgctatcctcccctattatgtactattactgttatgtattgtaacatttgaaatcccacaaagtattattgtttagtcagtattcctttattcctttggagttactcagtgaaccctctcaaccctgttcattgcacttcatcttttgtgcatatccaagctgtatatagggttcttttttctttatacttgaaaagtcccttcaatatttcctgataacagactctgtttgtttgccttaaagttgcctctctattttgccttcatttcagaaggatttttttttttttttttgtcagatacaaaattttggtttggcatttccccaccagcattttgaagataccatttcactgtcttctggcttttattatttgggaaaagtcagctagctataactcttattgttgcttcttgaagttaatctttttaaatttttctggctgcttttaagatctctctggctggctgaacgcggtggctcatgcctgtaatcccaacactttgggaggccgaggcgggtggatcatgaggtcaggagatcgagaccgtcctggtgttaggaataacactcaaaatcctaaggaaattgaacactcgaacaaaggattcttagcaaagcaatttacttctgcacagaggggtgcctcattggccagtcgccatgagagcacacctgaacaaaggggcacgagagcctttattcctgacgcaagtcctgcccctgtacctttttcccattgtctggggtcgggtcgtacaatctaaactaatcccggttggctaaacatttgatttttttttagataaggtgggcatgtaaaagaaagcggagaggaaaggggaaggggtgtctgtaatgagctagaaagttagtcctctttccaaataaggaaaggaatgtgagctggtactgataacgcctggtactgtggcgtgcctgggcatctaacaaaggcaaaaggagaaaaagggaaaaaggccggggtgggggtactatgagttaaagaataaaagattgatcatgttatttgaagagaaacttcattgtatcccatcctggctaacacagtgaaaccctgtctctactaaaaatacaaaaaattagccgggcgtggtggcacgtgcctgtagccccagctacttgggaggctgaggcaggagaatcgcttgaaccgtggaagcggaagttgcagtgagccgagatcacgccactgcactccagcctgggtgacagagcaagtctctgtctcaaaaaaaaaaaatctctctttgggggtgggggacctccttctccctcccccactcttgcccccgtccctctcttctccctcccctctttctttccttctccccctctctcccctttgatgttcctaagtgtggttttctttgtatttattttgcttgaggattgatagagcttcttgaatctgtggctcgatgtctcattggtcagttttgaaagttcttagctattatgtcttcagatatttttttcttgcctatatgttttctcctcccctctgagactccagttacatgtactttgtatccgttttccatgtgctgtaatttctcattcttttctatatttctcattctctttttgtgcttcagtctaggtgttttattgtttcctgtcttctgggttgattctttcttcagctgtgtctaaagtattattaaaaccatccatcacttctttttcaaaattgtattttttgatttcatgttttccactttttgtttatgaaaattcttcattttactttttaattccttgaacatttaacttgttttaaacttttttctgataacaccattatctggatctactgtgaatctgtttctattgccattttaaaaatcttggtttcagttgggttttgaccggttatattttgatttccagacatttatatgaaacgtgaaaaaatgtgaatttctagatgatgttatctttctgctgagaattacttttgctactggtatgcagctaggccaataagagtagttggcccggattgccttaatcgaatgagggattgagatgatttaaagctgtgcttctcttcctgcgtgggctagtctgttgctagttcacctttatacctagagtatagttctttggagtctgtccctatgcctgatgtgtttgccagggctgctcctccttggcagaccctaaatccaagttttgtatgtccgcccacaggtctcttgaaagctctgttaactttctcagtctctcgggcagtagttttggaatctacaggcagatgagtccagagactggtctcacctatttcttccagatctccgccctgcagattctctagttttgaaagttctctagtgtataaaacagattatcttgtgtttttcttttctagttgttctcaaaggaaggttggtttgaagcaaactactccaccattgtcaaaagcaaaaaatgcccaaatatgttctggaattaagaattttttaggtgatataaggtagtacactgtatccatcttacagccattaaaatatcttgcatgccttagcgatactgtctctgtagtaaaatgtattaatatttctcttgcctactacagtacaagtgtttatattgggaattggatacaatgtgatctgttaaaagaaatattctacaacacagcctgtttgattgggccccacgagtgactagccatctttcagttcctctaatgtttcctgttcccttttgtcatggggcttttgtacatgttgttctccctgcctaatatgtatatctcatactcgagtttgagtatgagacacatcctcaggggagcctttcctgaaccataaatttaattcagataaatgaactttctagtttggaattatgcaaactcatttgcattatggtttgattaatgtctttttcttctactagactctgaactctgctagattaggaatcatatccttttttttttttctgaccatgttatcctctgtgcatagttcagtgtttggaagtacatttattagaagtaggtgaacaattaataggttatcagttaatagatgatcaactactgtttgtatcaatgaagaaataaaataatgagggaagataaataagaaatgctgtgctgatgttagtgctggaaatgataagaaacgaaaggcttatagcttttgagcaaaagccagatttaatcacacactggatttgcacagtacaattgaagttttattgatacacatgtacagtattgaaaatacttgcataaaattcccatgggaatgtattattatgactgttgtattatagcattcatgcccccatctcctcgtatttttattatgtaagtctgaaagcactaggtttttaaaatgacacagccatcattcagaacatgacaaactatatcatttccagtcatcctactacacagaataaatggaataaaaaacgcttgaaagattttttaagtcttgaaggaaagcagacttaaaatttatacacacacacacgaaggtgctgtggtttattctaccaagggaaattgattttcacttcatctggaagtgcaaactgaatcttgactgataaggaggtgttcattaaatggccaaaggaatgtttcatttaaatgcatatttttacgaaagtatatagtggctttgtgaattgacaaatagtgatttggctggaggctagggcaatttgcaagaatttgaaaagacagattggggctatccagattagttcattgtttggtatggaggtcatcagaagtttttaaggatattctgtgttgtgaagaacagaagtgctggaaccagattccctgagtttataaccccaagctctgccccttactacgtgaccttgggcgtattgcttaatttttctgtgtctcagtgtctctatttataaaatggaggtaataattatagattgctattaggattgaatgagttaagacatgtccatgcttaggaaaatgtctagtacatagaagaatctcagtaaggcttggctcttgttgctattattgtatacattgagaaaacctcaaacattattgttgcattagtttaaccagaactagagacacaaagagattcaagaggtattttaggggtaaagttaacaagacttcaacttatttactaattttgtataaccagaaatttcaactaataatgctgtgtgcagtgtaaaagcaaatttgaaatttgtataacacttacatgatttgtaaacttacagattttaaatcttctaatttgtgttttcttttagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtaaatgaaaattttaatttatttaattgatatgaatattcttttaaaaaaagaacataggacagaatggttgggtttttcttaaacttaattttaagtctaaatatttttagttacagactaaatgaaaaattctaacaatcataaaattgtatcttttcatcatctgctttaaagagacttccttattatagatatatgtcaccaaaaatatagatactcaaaagtaaaatcaccacaatccccaccattaccaatccattgtatagatttctcataagatatttagtcttctatgtatttgattatatatttgactgttagtcttttttatattgattatttttaagttatcacatctgtttttataattagctaagttaactataattatcagtgaatgtgttctagtcagttaaattttctggttaaccaatatgtaatgagaattttttatacttattgcaaatatttttaaatttatatatgtacctcagttttaattgataaaatatattgaagttattttatggtaccagtgtgggtaaatccttacagattcaaggtaattataatgatgctggtatatgaagaggccagaagttttaagtgtctaatgttggcttaacaaactatggtccatgggctggccatctgttattgtaaataaagttttattagagcactgtcatgctcattcatttacatattgtctatggctgctttcgcattataacaacagaattgagtagttgccccagaaactatatggtccataagcgtaaaatgtttactctctgacacttttagaaaaagtttaccaactccttagttcagaagaaagaaggaaaaataatttcatagcatattataaaggaactactggagagatgctatctctgggaaagttgcgtatcaggagaagtttcaagaacaagtggtttcagaaagtttaccaggaacagaacgaaactgaagatgtgttctgcaaatctgagtagtaattcactggaatatagatataattggagataaaactcaactgagcagcctgtaaggaagttggtgggagagatgagggttgcccatagactgaattaaagaggaggccctggtttcaactcatgaagattgttcaacaaagacataaggcccacacagtatgattcattatgaaggttggtacaatagggaagattggtaaactatccatgctattattccaaaggaatcattccaagcaaggctgcaaattatcttcccttcacaatctgaggattatgaagtgtagaggaggcatagggacctgcttcatggatatatgcagtataaatataaaatagggtttattggggaataacatacaagcaaagaactggaggacacataaaattttcgagcccttattattccatagatagtcgtgtttaaattggacatagctaaactggacctacctatggaagggattcacatttgtagagagaaagagcagctaggaatgtgtaggtgacggtaatggaactttctgagttgaggaaatgaccttgttgaaaagatagatactgccactaagcaactagaatgaggctgttcttacgttggacttagctgctgtgtcagcttcttgcctagctgccaaatggggcaaggactatctgaatttctgtctcagataattttggcaaagattggagaaaagacataaaagaaataattggacagtttatttttcaggttaaattagacacagaaacaatttgtcacaaactaaaagagtatctttattgattttagaatttgattctgatttaaaagtttcatgtttcttcatgaaagggagaaaaactgtatctttgcagaagaaaagagatgtcatttatttgtccagattcagatatatactatatcccaagagactgtgttaggtcctggaaactcactaaaaatatatagcctacataggagatctaaatatgtggcaaatagaaataatatcagatactgggagagtttatagaagaaaccgctaacttctgatggagtggtttagggactattggttggaggaggtagtagcaaataagagttttgaattacaggtgtgaactagcaagataaaaatcacacttcattattggaacagtacacaaataatcttgcaggtggtggaggggtgacagtatcatagacttaaagagctgcttcactttacttccacttagaagcctctggtgaaaccttatgtttgttcttccttatctagaacacttttaaaaaagtaaaccgtattaaagtataagattaagaaaaattcagaaatcctaagagtgtggttcagtgaatttttgcacaaagaagaagaccgtgtagccagcatatcccagagcaccacccgagaggcactctatcctgtctcccagttgtttccccctgccccaaggaaggtcattatcctgacttctaacactatagattaattacacctgttgttgagtttatatgaacagtgtgtcttctttcgcacaatattacatttgtgaaatttatcagtggtattgttgcatgtagatatatgtaagtatatcttgtacattttcattgatgtataatctattgtgtcagtagaatacaatttatgtatttacttttttctattgtaaatggacatttggattgttttctactttggtactattatgaagactgtaattttgaatattctcgatagtatacgtgaacacttgggtaaataggagtgcggttgctgagtcataagggtatgcatttggttagtagttgacggaagttttctaaagtagttctactggtttacactctgctggcagagtgtaagagttctagctgctccggtcttgagcaatactgggtactgtccttttcattttagtcattctggtaggtgaacaatagtaatttaatgttaagtttccatgatgtctaatgaaggtgctcactttttcatatttttattggccatttagatatatatcttctgtgactagtctgttcacttcattttgttttcttctaatgggctgcctgcttttttcttattaatatgcattctatataatcaggtgagtgttttgtccatgatatgcattataaatattagctctaaaactatggcttgccttttcactttcttttttaaaaattttattttagagacagggtcttgctgtgatgcccaggctggagtgcagtggtgcgatcataggtcactgtaactcaaacttttgggctcaagtgatcctctcatcttcacctcttgagtaggttggactacgggcatgtaccactagggccgacccattcttttatttttttgtagagatggtgtctcgcctagactggtcaggaactcctggccttaagtgatcctcctgccttggcttcccaaagcactaggattacaggcatgagccaccacaccaggcctacactttcttaatgttttaaaaaatcaataatattttaatggtttcccatttacctttttttccctttcctttatgagtagtgccttttgtgtcacgtttaagaaatctttacttaccataaggccataaagatattcttctatgctttcttctgtaaggactctttttttttaacctttcatgttttagacctgttatccatttggtgtttatttttgtgtttggtttgaggtgtaggggtcaggatttgttattttccagatggatatttagttgtcccagtacaatttattgcataaaaccatcctttcctcactatatgacagggttgcctttatcatgagtcgagtaaccatatgtgtgtgaaactgtttctaaattctctgttttgttccatttgattatttgtatatccttgcttaattctgcactgttttaattactataatttgatatctggtggtgtagttctgcaccttttttttttttttctcagaaccagctgactattcttgccctttttcagaatatccaaatgaaaccaagtgtcattgttcacttaagaaaacaaaaaacctactggaatttagatattttttttccactggatgtagggatctatttagggagaattgaaatctttacagtgtcaagtcttgtaatctatgaacatgtttgtatttcatttggttttcattaattctctccataatggctgatagttttcaaaataagtcttctacatttttgttatatttattagtagatatttgattttctaaagcattattaacatttcttctcaaattttattttctgcatatttgctgctaagtatataaaagtatacttaagaattgctagatgacatggtaactcttaagtttaacattttgggaaatgccagactgccaaagtggctgcaccattttgctttctgcctgccatgtgtcagcattctaagttttccacatcccagccaacacttgttattgtctgtctttttttttttttctgtgtaagacggagtctcgctctgtcgcccaggatggagtgcagtggcacgctgtcggctcactgcaagctccgcctcccgggttcgtgccattcttctgcctcagcctcctgagtagctgggattacaggcgcctgccaccacgcccggctaatttttttgtatttttagtagagacggggtttcatggtgtcagccaggatggtcttgatctcctgacctcgtgatctgcccgcctcggcctcccaaagtgttggaatcacaggcgtgagccaccgcccccagccctgtcttttttattgtagccatcctgatgggtataaactggtatcttgtggttttagtttgcatttctctgatggctaatgatgttgaacatcttttcatgtgcttattggacatttgtatatcttccttggaaaaatgtctattcaaatcctttgcataatttttaattgttttttagttgtatgatcattttgaaagctgtttttattggttgtagaattctagattggcagttttattctcttagtactttgaagcagttgtcttccaacttccattcatttctgttaagaggccagcttttgatcttaaaaaaaattttttttttaaagataatgtgtctttcttttcttttgttgctttaaagccttttgcttttcctttgttaatatacatttttactgtgatggacccacaaggggcatgtgtcttcagatattgcttgtgtcccatttttttccttctctgggattctagttacatataacggttttgtatcccatacatttcttatgtattttgtcctcctgtattttttactctttttttctctgtacttcagtttgaatgttttctagttattttctagcaatctattttctagtaagcctttctcctgctttttaaaattaactgataaaacagcctagtacgttcttaatttctgataatatagtttcaattctagaattttttgatttttcatttttatggaaatggcccatcttgtcatccattttctccatttttaagcttttttttaaatattagccatagttatctttaagttcatgtctgtgaatagctatatctggattacctgtaagtccatatctgatccctttttctctttgttctcaattatacgatgcagtcttttgacatgtctagtggtttttaatgagccttcagaccttgtatgtgaaagagattatagaatcttagcatctccagtcttcctgctttagcagctttctgatgtctttaaagaggtatttgttgtatttcatcctgttttactagttgatttcagtgggttctttggtcttccaacaactactccctctaacctaaaagcagacatcctcatatacttaaaaaaaagaaagaaagcagtttaaaaataaaagttttttccaaaggttccaaaggtagagtacagagaacgatacttcaaggtttgctatattcattatccagaagtaacatatgtcagtgctgacacatttgttatatgtatttttatttttattcataaagtgaaaaaaattagagatttactgtcctctttataatttttcctggtctcttcctactttccttctcataaccactatcatgaatttacattgtgttttctttatattttttaacaggtattatttaatattgtttcaacatgggtttaaagttttacatagtgacgttttcatttgcacttgctttttcactcagtgtagtgttttgagatccatctgctctcattcaatacagctagttttaggaataaatattcttaattcatcaatacttctatcaaagaacaactatgttgtttctaattttttactgttataaatggtgttgcagtatacatctgttgacctgtctcattatacatgggtaaaagttgctctgtgatagtttcagaaggaattgctaggctgagtatgtccatcatcagctttaccatgttttcaagttgctttccaaagtgattgtactagctacactgcagtaagtttgtatgataattcctatttgcccatatactttgcctttccttctttctgtcttgtctgcctttcttttctattttttctgtctttgtccctttttaaattttattttattcttttttctggtcttaggaaagtgaaatgcaacctgtttttgtggtttgcttattttgtgctgggttgttggttttggtttttttctcttagaagttctttacatattctggatattaattctgtatgtattgtctctgtttcagatagtatctttcagtctttaccaaaacactttgtaaacacttttatgacgggacttaccatagtgttgtatattgcccttatttcagtagattgtgagcctttttaagtgtgttaagacttgctttatttcctaaatcaagattggtttttttaaatgttccgaatggagttgggtaaatatgtattctttgattgttggatgcatgcatctccatatatctttcagataactctcattgttgtgttctaaccttccgtattctttgtgactttttgttttttgttcattgagacttatcaataattgtatgtaccacaatggtggatttgtcaatttctctgtatattttattgatttaataatactgttttatacattttgggactatttcgttaggcttgcacatatttagaggtgatgtaccttcttggcaaattttgcaatacatattgaccatctttatcctcagtaaggcatgtttgtcttaaatctaccttacctcaccttgatatagctacatatttcttcctttccttttctttttttcttttccttccttcctccctctctccctccttcactccctttctcccctcccctcttttctttcttttctttttttttttttttgagacagggtcttgctctgtcacccaggccagagtgcattggcatgatcatggctcactgcagccttgacctcctgtgctcaagcaatcctcctgcttcagcctccagagtaacatgggtatgcgcaccatgcctggctaatttttgtactttttgcagaggtgaggtctcaccatgttgcccagactggtcttgaactcctgagctcaagtgatcctcccacctggccctcccaaagtgctgggattatagtgtgagccacggcgcccagccagtgttttcttggaggtctgaaactctgtgttatctttcaaccttactgtttccttatgttttaggtatgtcttttatagatagtatgagaggctgcatattggttttttatctagtttgatccatctcttaacccaccagtctagttgatgtttattccctgtgatctcgcacgtatttgcactagtttgcgtgatcccagtcgatcatataaatgggttagcgggtcccagccgtcgaaaaagccatagtgtccgcaaagaactctgattgcagctccacacagagccccccagggaagaggacatcggaagaagatatttcatctacctggcaatccaccaaacgtggaggttctgagtaagaatggttgagaagtcaccctgccagaggttagtcagtttctacctgatgtcttcaactcctatctccagcagagcttttgtactgcccaggtttcattctggagggcgtctgtctgcatcagcatggctgccagttctcttgtgatgtagcaggcattgagtgttccaggcagcggaggtgagaagcacaagctgaacccaaactgctgttttaaaaatttgtcttctcggccgggcgcgttggctcacacctgtaatcccagcactttgggaggccgaggcgggcggatcacgaggtcaggagatcgagaccatcctggctaacacggtgaaacctgtctctactaaaaaatacaaaaaattagccaggcgtggtggcaggtgcctgtagtcccagctactcgggaggctgaggcaggagaacggcatgaactcgggaggcggagcttgcagtgagtcgagatcgtgccacttgcactccagcctgggcgacagagtgagactctgtcttaaaaaatttgtcttctcataatcccactggccgatttcttctccaggctacaagcctccacatccctgaccccgtacattttccagcataccctctggggtttctcactttttcttcattattcctttacagatttattcaacaaatttgtttagcaccgcctcactgccacacagtagctttgttttagaagctgagcgtgcagcattgaacttttttcaacttatgttctactcagatgactggttttttttgtttgtttgtttttgttttttcagcaagtaatgcttgttggtttttttgcccctaacaagggcttgtaggtgttatacttcctgagtttttttatgtttgaaaatgtttattgtctttatacttgaagtctgacttggctaggtctaacgttctaggtataggccctatttcttttccccagaacatcgtagagatttggtcttctgactttgaatgttgccagaattctaacaccagactgagttttttcccttcttaaaagtcactcacttccttccttggtgtacatggtattctttctttgaccttgacattcagtaacttaatctgaatatgccatgaatttgattattccttatcacttttttgagagattgtatgcctttctgtattttattttttaataaatatttttcctttgctaaatgctctgggcttttttggtatcttcattatctgtcaacaatacaaacaacttttttctattcattttagttttctgttttgattctttgattttcattattgtgctaaaaatctctgttatgatttgattttttttctcttctcattcatttccgagccataccagctcacattttagatctgttatctctgacagtttttggcaattatattaagtatgagttaacagaaatagctttcctataaaattattttctttatttattttggtttcaccttccctggcattctacatttagaacaagattcttcacttatttcatgggcttctgatacttgtgaatcttgtagcactaatcagaggatcctctcagaggacactgccacttttgtgaagaactcagtgtgaattctctgaatccactttcattttcttctaaatttcaccaaatctggcagatgaaaatttgtagttagggattcttactttccttgaagaaaacccagtctcttttttagtattatgtatgtgtatgtatgtatgtgtccatgtttttagaggagtagagaggagtaaacatgactttattccattttgaatttaaaactaacttttgtgatttcttttgaagttaatataaagaatttacatcattttaatgtaattgaaatcagtttaaaaatattgtcttagaataataaagttgagtcttgagttttaattatgtagttagtattctgtagcctaattttagattacgttacctctttcatgtcaaatttatgaactgaaacgtggctgtattgtaaaatactaattaacactctactaattagttggcttttactgatttttcacttttagatgtcttagaaagctagtatgtagaaggaaaatctctgtatgacaaccaaaaacttactttgaactgaaaacactaaaatcaagggaaaatgtactcttaacagcttgttttcttgctttgtgacttgttatattttgttataatctaatcttctaggcatatactcatgtcataagtgatagtatttttcattcctttccttattgctttcctccattgtattctattttgtttttgtttgttcccaaatgtatttgtaaaaacaagtacatcaacagatgcggaggtttttctacttgtaatttctgttttatattgagaatttttttttttttttttgagatggagtctcgctctgtcgcccaggctggagtgcagtggtgcgatctcggctcactgcaagctctgcctccagtgttcatgccattctcctgcctcagcctgccgagtaggtgggactacaggcgcccaccaccacgcccggctaattttttgtgtttttagtagagacggggtttcgtagtgttagccaagatggtctccatctcctgagctcgtgattcgcctgcctcagcctcccaaagtgctgggattacgggcgtgagccaccgtgccctgctgagaattttaaagtatcaaatatagaccagtattcaaagatgattcataaaaggtgatttgggtatatgacacaatttacatgtaaatatgtatcatgaacagactagatggtattggctagttaaattttcttgttaaatgaatatttaaagaaccttctcaactctattttcattcagtttactagctaacagaatatttgagcggtcatataatacgtggagtattgtgctttgtgcacttgacaaatacagagaaaacataaggttttgagactgttaaagagattagatctacataaaattaagagggattaaggtgattaaatgctaagatgagtagatgttaaatgcatttggtgttactatagggagaaaacagatactctgcttaaatttagtgaaaaccattgaactactataccactgtttaattttatcatgctacataggaaatagactgaaaaaatacagaaacatcattgaattgtacatgtgaaatgaattttgttgttgttttgcttttacatgtacgtattgtatctgtaatgaaagaggatattaaagtcatgcccgtgaaaaaaatttctagtggtagtaattgcttttcatgatactggagatcctctacttctttaatagctactgcaataactgattttaagtctaggccagtagttaaagtttataggaagaaaatcgtatgataggtatccatggggaaaattgctgaactttatgttgttgcacaattccaaagattattcaaaagtatattcttactgacctttcaaaaactgttttttaaacagactttatgttttagagaagttttaggttcacaacagcattgagcagaaagtaaagagagttcccttgcattcctttcccatcccgtattagaagaagagggatcaagggtaactcttgctcaccccaaggagggttgttgggtggtataatttttgtatggcatgagcttcagagtatttgaagtttttgaaggggagggaaagaaaagtagtgtcgaagagagaatacagagcataaaaagacatctcttttagggccttcagtcaatataaagggtgtaaataaaaaaattttttgggggggtctctgttagagaggatttcaggtaacaggtttcagttaaagaaagaaacagttaaagaagaatttgaggactttggggaatttgctgatcccagactgtgaatttcagtgggtacaatagagaagggcttgagagggaggagaaatacttcagattagtggatgtatttagttgtttagggatcaaagtctggctgatgctacattacctggctgggatttggggtttctgatggtaacaattttaactgaatgataagggaacactgatcaactgttccttctgtggtgcttcaccctctgtagtggagtggcagccaaggataaggaaatacttccccaggagacagctctgtcggagaacttggcatatacaaaacaaatgtaggactgtagcacaacaggagagggaaggctcatatggaggacaaagctgggaaccttttccatctttgaaatctggctcagtattaagaagaagattcatcttcagatagcccatattcaagtactactaatgcttttaataaaaatataccttttttattgtttaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggtaacacatatctagtaatacgtgaattgcaagtaatactgaaatattttgtttaatagcattaactgtcagaatgacttgtacatctaaaacataaattaggtgtatatgtatcttttctctaaatcatttcttagaagagtgattgctgtatggcgactcacttgtgttataaacatactctattcattcagacaaagtaaactatgttgttttaccatgtataccagcataatcttaacatttcatctatgattacttattttgtatgagttttaaaattaatattgtaagagactatcatttttggacagtatgaagttacagttttggtatgtcttaatcatttcattatgtcattgacagctcacaactttaaacacttaagaaaacaatgacaattatgtaaataatatttgctttgttaatagtgttttagttgggcaacaggagaaagtcctcattttctttgtttatctgctgcctatttgatagctctcatagttctcccaacctaattaagtgaaaaagaaaaggatttattattagaatgatcttctcagaaatagtgttttacaataaaaccttcaaaatggaaaccagtatgcttccccctttttatcttctctctttcaagatcttccataagataacttttccatgtgtatttctaatcacattttaaattagcttcatagttacttttgtctcttttgtttatatttggaggttttatatttattcagtggaggaattttttattacttgaaagatgcatattttggcttagtttgtaatagaaaagtattaggcatttctttggtgaaagtactgaaaccatgtgaggattatgtagaacaattgaaaaagaacaaatggagtcctaatctagatggtatttctaatatttaaaattaaagataatttagctgttttgttgtataggaatctaatttatttgcctcctcaagttgttattgttccgaaaatgcattttaaatttcccctatacttctttgccttaactgtccctcttcaggcagtgattgataccattactacacacataaaaactattacttgtattttaaaaacagcttttgttactttttagtcattttttcaaatgagaagtaaaggtatagcataattacagctaggactcatctctgttgcttgacttatccatagttttatttatggggctcactgctgttaacctcccctgaattgtatatgaaattttttattttgcttttgttgataactttgattaaactacatggttatatctttagctaaaccccttaatgcagttatatttatgtcatttataaattatattatttagcagttatgttatatgttatcatttatttataatactgtatagtagacctttcccctattacatgtcatgaatacattttgtattgtaatattgtaaattagggtatcattcaggtaagctttgttaagagacttcataactggatttccttgaaatggagagtaaccctgttgtgtttaaaatagcttcttatcttataaatctatatgtctcatcaaaagttacactgcctcaactcaaaccaatggagctgactttgataatgtcagcaaataagtattctagctaatttcattatagaggcaaccacctccttaaccctaactacactgctctttcattgcagcagttgttattcttggtccgtggaggttgagggtacttcacactgcctaaagcttacttccctagagaatacggagaatgtagtctgatttaatcctcatagaattttcagactacctcaatcttcatctctgttgtggacagcaaagtgtaagagagcagatcccaaacatttttttaagcagtctcctatattacagtctgtttcaatatgaaggaaaacttttgcggctcaattacatattgggattttgatgttttctttttaattgcatttcctcaaaataagttaaaatgaatcgtgttaatagttccttgtgaagttctaaattatataaatacagtagatagaagacacattagattattagggattaatttattgtggtaggataaattacaaggcttaattcacacttcttgtatattaatgtcttactgagtcaacttttattaagagagtggttgttaagcttgtgagataggccttttttcacatatgaagatgatgcagcctacatcttcactagtagtgcaattcacatacgagttctttttgccagtagtgtaatggcttacgctaatgcatctatacagtttgctatggttcaaattaaatttacaggataacagtaatgaagttacttacatagagcttcctatgggtcttagtttttacaaagtactttacagttgcctcattgaaggatatttttggaataccattttttccttttcacagtttcctttcaggcagttgtattgatgggaagcaggctttttgatgcccatttactcatttgacaaagatttgagggggttctatgtgctttgcaagttgatcttatttagagattcctaattcaggccagaagaatattcttcctacccatatttttataaaccattgaggtatacttttaccaactgaagattttatgtatatttataagaactttgaacaagttggtgataagcttctggactccttagccatctcatgtggttgaaaacatcaggataaaatagaggcatgaacagttataagtgatctactttagagtgatttctaaagtatatgaccaatatacttaagagtttgtgtcattatgtaagcaataatgacacaaactctgaaaacaacaacttccataaggcctataacctgactccacatatttccgtttgcatatatgttagtctttaaaaaatcagcaggattttactttccctatattactgaaatatgctttgacagagtcttgagtatattaacatggcgtcttcattagatgtgttcctcttctgttgcatccaatacacaagccctttgaggatgtgctgtgaggatgtgctgtcagcctcacctgtgtagtctgtagtacaggacgcacgtgtattaggtctgcggagttagatatagtgtgttttgtgggagtactgtaagattaatataatgtattaaaagtagttggtatttgaatattgttgattataaataggtagaaatggtgctcttatttttctgtgtttcaattttatgtataaacttaaatccatctatctttgttctgcctcattttatattaattatgtttttaaactagttcttaaatttaaaattttaatcaattttttaaactttggttagagttgataaaatttaaaaaattctatacaggtttatttttttaatttgtacttacatattttaaattgcatttaggtattttaaattaaggtctgcagtgtcttgaggatgtatatatcccctacattaagaaagctgaatatatgataaagcagacttacacattagtaaattaagagattgccattagggtaagattcataagagacttcataactcaatttctctgaaatgaagaatatcattgctgtgtttaaaatgtttccacactgcttttcagtagtatatttcttacaaaacatgagttttataactttatttcccatatttcattaggtgacattccacaaagaatgttgtcaaaaacacacattttatcttttcaagttattaagcattgatacaaaaataggtggcagacttttgtttggtcctataaaatgtagtaatttaatttaaatgtatgaagaaaatgttataactccttagtttttcttttcagtaaaattaagattaaaaattatgaactatattatataattttacaggaatactaggtatgtcctagagtgtaggaaactacagatggaaattaccaacacaagcagttgccattgttcatacacatgcatatgtgtgtaatttgaatttatactaaataaaagcctagagccaatagaggctttgggattctgcatcaaaagaacaattatgctaaaaggcaacaaatgatacctaaaaaacacctgagaatacttttgtatccatgttttttcctgtcatttggcagaaatattgaaaatactaaatatttctgcttataattttttaaaaatagccgtgacttggtaacattcagaaatcatttgtatggcaattcagattattgtgctgtcatttaaggatgtaaataaaagggtcatggccgtttgtctctcttgttaatatctggtgcactattcccaaagagaggaggttttcaccacaggcatactacggtacttaaaaaaaaaattcttctcgcagtatctcatttaagcttcatattcaaggtaagctttttcagaagcaaaaattgggatgcacattaaaatgacttgcccagagtcatgtagcaatgtagtggcagaaccaggattaggacccaggtctgtgacattaacctttccccttgctccttagttcactgcatccaggggagctctggagcattttaccgtaagtagataagattttatacatacaccaatcatgtacgatctatagcagtcacgaataagttttcctcagtaatgaacagaaaactagtgaggataatagcagtaagaatgataggtattattaagcacttaacatggtctagtaaagacttcatttgaattatcttattgaatccttactgttgcccttatttcacattgaggcaatggagacacagtgataaattaagtcagatgttgataatttggattctgaagaaagagaaaatctgtttgagtcttaaaaatcccttcctattttcaaattacaaaagaatttggaagtaacatctgaaagaaaggaagatagggaatcagtataagatccatctatcaattagaaaataaaagcagatggtagtgaaagtgattatacttgagagtaccttatttaaaatcactggtcctcacaatgtgtagtgccctgaccagcagcagcagcagccccagaggcttcctagaaatgcaagttcttggtcccaccttagaccttctgaatctgcagcttttgagatgaagccaaagcagtcatgaattaatttgaattaacttgccttaagtgcagttatagactaaaagtttccagttaacagtttcttgggagtggttatccagctttttaaacatttttatccccaagaatatcccctgaaataatttcaaacaaagagcaagcacaaactgtaattttttaaaccctctaaaaagtaattcaaactatgcagtatttgtgtgaattgcacctaaggaatacatttctaatgggttacatttcagttcgattccacatggttataagagcttgtgtgagtgtggtttctttgaggggtgcttctttgagaggtgtggtggggatgagtcggaggtggaatctggctcttcagatgaacaaaaaagaaagttaaatgacctatctcctgagatcatctagtgcttgaccttacaaaagtagaagcatgattatgcttggattttctgacagtatcatgatattctcaaagaggctttttgagccagtcctcttttctccccatgttatagacgaggaatggaacagacagggagtatttaagaggcttgcctaatgttttacagggctgcagtggagcatcagggaaagggaaaaaataatgagacatctgaagacaagacaaagctttcctccacctccagtcccctgccctgctcttttattcctaacagagcctgaagcagcaggatgatgattcacagggtgaggcacatagtcctcatggctctcctccgcttcccacatgtcactgcaccatcgcctcacacagcagtcaccatagctcttgtaatttcagttttactacttttattttgctgtgcatgtgaatattatttaatcatacaattattggttttcatttatgtgctttgtataagggactacacgtctctaagtgtggtttttcttgaggtcatattattctccattagaggttcatgtcattgatacacaaatgagagttcatgtggggaggaaaagatgatagatatcacttgtatatataactgaacttttttctgtaatacatttcttgtgattattgatggatacctccctatgtgttctttttatgtcatatgtgtcagggattgaatattttattaatagtacttaccatcagataaagtgttcctttttctccagaagatatttgatgctttggtcaaatttttgaccaataagaagaggagataaagaggatggagataaagttgctctagaggtgatgctatcaccagagttctttaaagcagcagtccccaaccttgttggcaccagggatgggggttgggggtgggaggaatgtggacagggagatggttttgagatgaaattgttccacctcagatcatcaggcattagattctcataaggaatgggcagcctagatcccttgctcgtgcagttcgcagtaggtttcattctcttacgagaatccaatgctgctgctgatgtgacgggaggcagagctcaggcagtaatgctcacttgcccaccacttacttcctgctgtgcaacctggttcctaacagggtctgtggccccgggggttagggacccttgctttaaaggttatggtaggtggaaaacaaagatgctctaggtcagaggggcagcttatatggaaattaggaaatgagacactgcagttagtgtacgaagttgaaatcagccaagtgtcactgtagtatactgtgaagagtggaatagctaagacctgagaagtaaaccaggtccacatgagctatataaggcccttcactttatcctgcaggtttggatagccactgaaagagctgaataaaatagctgcttaggtttctccttgcatttcccaagcagtaagttgtgttagaactgcgtggtaattttttgaagggagttgaagaaaaaggaaaagaggtaaaaatattgaatgtaatagttctacattttaaatttattgtactgatgtttgtcgtactatgtaccaggcattttgctaaacactgggaatatagtggtaactggccctattgctgcctttttcctaataagatgatatgctggctattttattatcttatggcagaagtgcttttgttagatacacttcaatatcgacttaagacccttagaatgccaagatttttatgtttctcatcagatattaatcattaagcatataactattataagataagatattatactgctattcaagccagaagttcatttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaaacacacaatttaaaattaaagagacagctgtatagttttcatatttattttgaagttatttttgtggctctgttctcagagagagactagggatctagattctacagaaagacaccttcttgcatagattagtcataactcaactttttaatttacaattatgcaatcagtgctgtactggtaaaagaaattccaaatgatagtatgaattatattttagaaaatgagacataccttataattttctaggtttttgtttagttggttgattttcaaatttctaacgtgtttcactgattgtgtatgctaagggtattttataaagaaaatttgatatgggattatggttttttcctcaaataatgtttcttgtagttctcattttaattcattagcagtaaaacatgagaaggtaaaccttccatattgtttttaaaatgttagtgatttttaagacttggtaaataggcactacatgcttaagccttctagaataacccaaagctttattatgcacgttggactttatctcctgtaactcagtggagaatatttttctgtcatgctttgtttttatataaattttcttttcaaatatctggtttattttgtggtaatttctgggcttaagtgttatttccagaatgtatctcgaaaactttaaaaatgtttatgctctgaaaaaagaacgtagaagtagcaactagtatttgtagaggaattcaagacattagcttgctttttttgcgccacccacgttcatataggattatcccataatattatataattaaaatatttttattgtggttttccacatttatgtagttgaattaagtttttaaaaatggtttcgttactttggtctcttataaacctatcagttttgtgctgtaggacagtataaaataatgttttagatattttgtgaaagttatttgatattagactctcaaatcctacttaatatgtcacttattagtaaagtagatatctgtatttaatattctaactagcatatatttgctatattatccatttatttattgaatggttagtgtactgggttactaagctcaatgtttaatagggcagagagaacagtattaaaattttaaatcttattaagttttgatgatcagttaaaataatgtatgtgaaagcattttgagaactataggttgcttctggatgcaggcaacagaagacctcactgaaattggtcttaaaaataggggtattgggggacagagcgaggctccatctcaaaaaataaataaataaataaataaaaataaattaaaaaaaaaggggggggtattggttatttcatgtaagaaaaattccagcagcatggtagagatttggctgtgttcaagcgggctccaggtctctgcctttgcccatgcatcattgtcttcacactggctttttcatgtcgataaaatggcagtggtagctctaggccttatatgtgaacacagcatcatataaagcagcactatctaatagaatttgttccatatttgtgctgtccaatatagtagccattaactatgtgtagttattgagtgtgtagtgcaactgaaaaacctgagtttttaatctttttaaattttaatttaaccacatgtggcgattggttactatattgttgagcatctatctaaagtatcagagatcagttgtgtcccagaatccacagcagatgttctaaaattaattctaattgtactgtttaaatcgcttgcctctccatctcccactctgaaaacactaaacacagtggtagagaaaggatagaatatcctgattggcttattgtagctagatgttacacccctgggatttactacaaaactaaagtaattcagtgtggtatttgcatagggataggcatgtagttcaatagaacagaatagagagctcagaaatgtacccacatatacatggttaattgatttttgacaaaagagccaaggtaaatcaatgagaaaaggacagtcttttcaataaatggtgctggaaaacctggatatccatatagaaaaaaaataagcctcagtatttaccttacatcatatacaaaatgtttatggaatagcggctttgcataggggagtaatcaaaggtaaggaagagacaaattgaatatagttgatagatggtcttgaatacccagctgtggtatttaatatttgtcctataggcattgggcagcctttagaggggtgtttaaaagttttaagtagtcaagtcattgttacaggaattaatctggcagcagattagcagtattttaaaagaagtgtgtagcttttaaaactaaactaaattatctcacttattactcatgataggctttagtaatgttgagaattatagaaagaggaatgcaattccatttggtttgaatggagaggggagattaaagtggggggttaggccatgttctaaggaatagaatatattgacacatcatgctgtttaaaaattgatttatagaaaatttgcataattgtaaaacatatatattattatagagagagagaattgacctaataatgctgtgaaaagtggtttgtgtgttataaaacagttaggaaactctgatctggctctctctttcatttaactgatgaggaagccgcgtccaaattgagcaagaaagactgtagatcctttgaggcaaagacttcgctaaggaacattagtatttttcacagtgctcagtaaagattcagcacacagcttaataatgacctataaaatggaactaaaggtagtgttgtgtacttccgcattcacttaatcataaattaagagtatttatgatactcagttaaaacttcatcaaatattacaaaatctagtagggacaaaaatataaaatatgtttaagttgaaggaacactcagtgtgtaggaggtgattctttttactctgttaacactggaaatgataactttatttccttatctccccatcctccacatctactaacatatattacttccagcctttagagaagtaaatgtacttaaaaagataagtatagaggcctctgctgtattgcagtgtatgcattcttgaataatctcataaaccgcaaaacctatgcagctttgtattctgcacatgaacataaatgataattggagggatagcttgaaatgctcaatgaggcatcttagtagctagtggccactatggtgggtcctgtaaatacacaaaattacttgaatagaaatgctggcagcacttgaattaggatgggctagtgcatcttaggacaatatgatatgatttccagtgtgataacttcatgattggagtatacattcccagagctttcagtaacctaattaatcaggttaatactgtagtagtactgtcacattaccttgtatctttataaataattgctccagacatccttaactatcatgtgaaattgaatgcatattttaattgcttattgaaatgtggtaggcatacctgagattaacttttttgctcttcttttaaatgagatataattcgtataccataaaattcaccagtgtagattatgcagttcagtggttcttagtccattcacaagttggtacaaccatgaacgctatctaattctagaacattttcatcaatccgaaaagaaacccagtacccattagcaatcacttaccaactcctccttcccctacatcctggcaaccactaatgtactttctgtgtctatggatttacctgttctgggaatttgatatagatggagtcatgcaatatgttcttttgtccagctttttcacttagcataatgttttcaaggtccatccgtatggtagctgtatcagtccttcattctgtgaccaaatagtattccatttgctactgtgaagtttgtatacaagttttggtatgggtataagttttcacttctcttgggtatctagttagtagtagaatttcctggattgtgtggtaagttctgtgtttaactttttgaggaactgccaaaccctgtcctacatctaacttaaaaaaaaaaatagcaaaaacatcaactaaaaccaataactttatggatattattagaaaatggttgattttttttaaaattttgatattgttgggctaggttatctggatcaactcttctgttgaagacatctaaaaactagataaactgtaaaaacagaacaaaaaaacttttttacgttatcaaagagctcaaggaatatgccaggccaaaatttaagagaaggtaagaacataaaggtaaaaaagtatttaaagttctaaccaccctgaatcatttgcccatctggataaagcagtttgtaaaactgagatttgggttctgatagatttgggttctgatagattcagaatcaaggggaaaatgatcacttctaggtttatgagcctaatagatacccccaaaaccctttaaactggggccttaagaaaagaggaaaatccactgccttctcctgctcccaaaggattccaaggagagttatttagtactgagcagataggggaaagaagagaacacgaaaagaaaaatagaacatatctgacagattgtaaaccaagttaccagcattgtgtggaatcgtagttccaagtcatataataccagacattcaagaaaactagtgccctgttaactgggggaagcaaatttatatcctttttgaagaaagtcaccttattctgtgtatcagaaatctctttcaaataacctttcagaactatagagcatcatacaaagatgaccaagcatacaagaaaacaaggcacagtgaggaaaacacagcaggatacagcagaaaatagctcttatatatttcagatgacattgttattatatgtagattatagaacagtttcactttctatgttttaagaaataagcttgaaaatatcagtaggaaacaggaagttatataggaattgacatagcagagttgaatgaaatacttcaagatgtgaaaaaatacgatgaccaaaactaattaatgcagtaaacatggtggaagtagattttccataaccgcagagagaatttgtgaaccaaagatagaagaaattatctagaattcaatgcaaatattaaaaggcagaaaatatcaagaaaggtttaaagaaaaggaggatcatgtttagaagttctagcttatgcttaattggcattgtagaagacggaaacagagaatcgggtagaggcaatatttgatgagataatgacacaattttctaggattgatgaaagcccaccatccttagatttaagaaattcaaatcccatgcagagtaaatgtgtaaaaaaaaaaacaaacaaaaactctatatagacatagtgaaactgtgcagaaaacaaagacaagaaagacgtaaagaaactatcctcaaaagagtgctatttccaaataacaaatgaaatctggagtcaatgaaatgatatcctaagtgtgctgtttaggaagggagtagaatgcaacctagagttctatacccagagaaaatttcgacagggaaagcataacacctgtatatcagtgttacaatcaaaccatctactgctttggaagaaagggccaagaccaagtcaggctgccatggtaagcagtcttcatcgaatgaccagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcaatatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatgtaataaagaaaaaatagaaaaattgaataatcttgtcaagttttccacaaaactacaagtccagatggctgcataagaaaatactagcaaatttttaagaaggaagtaattccagtatttcacaaacccttccaaagaatagtaaaaacaaagagctttcctttcctcgttatctaaaattagcctaactttgatagcaaaaccagctaggagagttgcaaagataataatcagaagccagtctcactgaacataaatgtgaaagtcttcagcaaaatattagtctacttcgtgttcacatctttcttatgggagacttttttgtttgtttgtttttgagatggagtttcgctcttgttgcccaggctggagtgcaatggcgtgatcttggctcaccccgacctccgcctgggagacatttttattttcagaatgacccattttctctactgtttgggcacaaaactagactctgtattagcctcccctgtggttaggagtggccatgtgactgacctctgaccaaggagatgtgagtgaaaatgatgcaggctgcttccaggtgtgaccagtaagatacttcccacataatcttcgtactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaagaaataaactttcattgtgttaagccactgagatttatggatttattaaagcatctagcattacttatactaatacagagattaaatctagtgatatgtagaagagataatatattatgactaagttgaatgtatcctagtagagttataccatattcatagatcagaagtctcaaattatatatatctgtgccacataagataatctctgtagagttgatgaaatatcaatcagaatcccaagaaatactttttgaaagaacttcaacaactgattctaaagttcacagagaaaatagaacagaagacactgaagaagaacaaggtgagagggtttgcactgcaatatattgagactaattttaaagctataataatgaacatacagtggcagtggcacaaataccaaatgccaaacgtaccaatggaataatagctcagaaacaggaccatgcatatttagatacttaatatatgatagagtggcagaacaaactccttaagcagtggtatagggacaattgggtatccatgtagaaaactcatgaaattggacttacctcagattttatacaaaattacctccaggatgcttatagacctaaatgtaaaaggcaaaattataaagctatttgcaggataatataggagaatatcttcataattttggaaaggatttcttatataaggcataaaaatcactatcatatggataactggaaaggaaaaaactgataaatttgactccgtttaagaactctgcatccaaagataagcgtttttttttttttttaatgctacataatgggaagatatttttacaatgtataaaattagccaagggcttacattgactacttataaaataattactataaaaataaataattaaaagaactactataaaacaattatcaaaaggcagtagaaaacttagcaaagtacttgaataggtgcctcacaaaagagaacatccatgtggcctatagatatgaaatgtgcttcatttcattagtagttggtattgcaaattaaatcccacaggtaggaatgcatattgatacaattactttaaaagacagtttggcattatctagtataactgaagatccacatgttttatgaactaatacttctattcctaagaatacatacccaagagaaatgtgtgcacattatgcagtagactatctacagaaatgtccacagcagcatttttatagattcaaaagattgaagccactccaatgtctgtctgttgtagaatggataaagcttttttttcaagccatgtaatacagtatttagtgaaaatgagccagctataattctgtgtaactctatggcggaatctcataaacagtgttaatgctgaatagtgtactgtgtgtggttccatttacatatcattcacaaataggcatagctaaattatatttttagggatatgtatatatgtggtaaatgtataaagaaaatccagataattgtcatcacagagttaggatggtattaactgtaaaggtgggaggagagggttatgggatgaagggagatagggagggttctggccttggtctatttttttgacttgattgaaatgactgatgttcactttataattatttgttgaattttatataaacttgtacataccttacatatttcacaatttttaaaaattgtttttatgtgttgtcagagtagctagaaagaatagtatatgtttcaaaattggaaataattatttacaatgaggaaagacaacttttctcatttttaaaatatcacaataatctagtttcaatttcctgaaacttaagacatgatttcttttttcctcttttttttttttttgagacagagtcttgttctgtcacccaggctggagtgcaatggcaccatctcagctcactgcaacctccacctcctggggttaaagcgattctcctgcctcatcctcctgagtacctggaattacaggtgtctgccactacgcccagctaatttttttgtatttggagtagagacagggtttcaccatgttggccaggctggtttcaaactcctgacctaaagtgatctgcctgtctctgcctcccaaagtgctaggattacaggcatgagccaccgcgcccggcccaagccatgatttctttattttacaagcacttgcttatacttatgctagatttactgactacttagccggtgtttatggagcatgtactgctcagctgtgtcatagcaatgagatttaaggtgggtggtcaaattttttgtgggtttatttaattgatttaaatcagttaactcctcatgcatttaaaaaccatgcatttataccttttgagtagttttaattccatagtttcacttgtaagtgctatgattctattagcttggaatggaatttggcaataataaagttgagcgtatgttaattttttttttcagttcttggtaggcaggagttaaaagtgcaggcatgggctctagcagatactccagcagtataggctcttcgatccaaaatgtagtgtcatatgtcaagattccagaaaatgcaagtcccttgggatatttataagttcttatttaagagcccatatgctttaaatatttattaaacatatttagaaagataatcctgatttatttactctgtaaacagatgccaaagattatagtaatatgcatttgtgcacgtatatatatgcacacattatatacggaaatggactgcacttttaactcctgactaccaagaactgaaaacacttttaacatatgctcaactgtataattgtcaaattccattccaaacaaatagaatcacatatatatatttaaaattttagacaagcttattttccatggaagtttttatgtatataaaactttttatattttatgtataaaagttttatatttaactattttttatatatgtataacatttccatggaaaatgtggctaaaattttaaatatagaatttcttgctgagtatttaacatgaaagagcataagctaaaagaaacgcattttaaatgagttgccctgcctaattagtaattcattttgaaataaatttttgtaagtttattatgtaaaagaaaacctcaacatacttaaaaaaaagtttatacagtattgtttttgtcctctcaagtatcttttttctttcttttttcacctcttcccttaatcctttccatctctagtttcaccaagaggtttagtatataaaccagaaaatgagaggcagatgtacagggtcagccaagtggtaacatatacccagaattctgtaaatgtttccttgaatttgaaaggtaaggttgtcagtactctataagtagaatgataggacgtatgactttaaagatttttgttggggtagataccattgtttcaatcagttatctttgaccaacaacagtaattaatcatcacttctaggtttgagactctttctggattctatgttgtagaggtactagccagacttattttgagaaatatgtgacttgggtaaagagactaataatgtgttacctaaaggatcactaacagttttcttcctcatgcttctttgattataagggatagaaacccatttaaagtagctccaactaaagaaagaatttgttgaaagaatgcagacagatagcactcaaaggcaagaggcaggagtagctggcttcctgaaggccggacaccaggaacttcatattaagggctccatggtctctcatctctgccaccaaggctggtttgcaaaataactctccttgcaagcacaactgataatcttcatgtagaaatgaattgatttaaaacaggtgagaaattcaaaatgatattgaggggaactgaattggtaacaatttatggaacagatagaatggagagagagaaaagtggaaaaaagatataagagtctagacataagatagtgcaggcttgagtgagtatggggacagtagaaatggaaataatatataaaatttggtattccatgtgaatgtagagagagaacaaagggaataaggtcgactaggttggtaagtcccaaggagagaccggtttaataaaagataatgaattctatggcagttaagttgaaatagaaatgttagtaaaatatccaaatgaaagtgtgcagcaggcagttgggattataaatcttccaagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactctagaagaaaatctaagtagtaccgttcaggacataggcatgggcaaagatttcatgactaaaacatcaaaaacaatggcaacaaaagccaaaatagataaataggatctgattaaactaaagagcttctgcacagcaaaagaaactttatcatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctcaaaagaagacatttatgcagccaacaaacatatgaaaaaaagctcatcatcactggtcattagagaaatgcaaatcaaaaccatcatgagataccatctcaagccagttagaatggtgatcattaaaaagtcaggaaacaacaggtgctagagaggatgtggagaaatgggaacacttttatactgctggtgggagtgtaaattagttcaaccatggtggaagacagtgtggtgattcctcaaggatctagaactagaaataccatttgacccagtaatgccattactgaatatatacccaaaggattataaatcattctactgtaaagacacgtgcacacatacgtttactgcggcactgttcacaatagcaaagactgggaatcaacccaaatgcccatcagtgatagactggataaagaaaatgtggcacatatacaccatggaatactatgcagccataaaaaaaagaatgagttcatgtcctttgcaaggacatggttgacactggaaaccatcattctcagcaaactaacacaaaaacagaaaactaaacaccgcatgttctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataataaaaagatcagcaaagaaaaaaaaggaaggcttttaaagttcctcttcttttaggtaaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatataaataacaatttatgaattaccacaagaagattttgaagatgagtattgaaaggccacaggccctgtcttgtcatatttcatcgatacttgatattataacgaatacagattaatcaaatatttttagaaaattttaaagaacagcatactacttcttccttttaaaaaccaatacttgctccaataataagttctatcgagggttactaggaatctcttcctgagtttagatctgaaatcagtgagttgggtggtttcacactcgtaagtggtaaaatagttttgttttttggtttttggtttttatttatttatttatttatttgagacagagtcttgctctgtcgcccaggctggagtgcagtggcacgatctcgctcactgcaagctccgcctcccgggtttacgccattctcctgcctcagcctcccgagtagctgggactacaggtgcccgccaccacgcccagctaactttgtttttgtatttttagtagagacggggtttcaccgtgttagcaggatggtctcaatctcctgacctcgtgatccgcccgcctcggcctcccaaagtgctgggattacaggcgtcagccaccgcgcccggccgtaacatagttttttataaaggtgattatatcaagtgaacatgagtcaaaaattttaagtaattaattagtgagggagcctgaaaaaaatgttgcctttgtaaattcaaagatcagacaaatgtataagcccaccaagaaggccaaatgaatttgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaattgattaataattactcattaatattgatctttatagcagcctgtaatgtatgttgtagaagacatttctttaagaaaagcaactaggataagtcaacttaaatgggtacacaccattgaaatttgaaattattttggcacaattgagttttctccttaagtttgttggaatggcattgaaaaactcaatcacgttatttacaaggagtaaaatatctttgaagttttatttactttagaatggattataatgactagtaatagctatagagagtactcagtgctagcactcttgatgcatttttctactttttctttatgaggaataagcagatctctcatagtggtgacctttcacactgtgttttcctcattgagcaagtgtctttattgtggctaacttgtgtgtgagaaaactgaagctggccaggatcgtatgtacctgggcctggccttcttaatagattacggcattccacttgataataccagtggcacaggagaaacttctactgttgtgctatttggtaatgtgaagacagaaaaagtctttttatggtagttgggtcctcaaaacaactcttcatggtttagtgataaggagacacaagttgcctatcaaacagaggtacattagcttattatctacaaagctgatagagcctcttaaattctctcatggtgacagaaaccccatctgaagtgaaggcttgcagagctggagataccagagcactttccttcctcataaatacaagtagagttaaccctactcttgtagaataaaaattgcatgtaattgttgaacaaaagctgccttcttttttctctggcaattaaaatgtggtcaaagagatatatacttggtgattgccatttgtgaaaatttcagtgataagcattacagcttactaagaagagcaagactaattaactagtcttaaaatagatgaaaattgaggggaaatatcagagatttaggactagaataagtcaacaactttatgataagatctgtgtgtaggcacctactatatttgttctgtttctagtgctgtgtaggttttaagagttcaatgtgttccagtgttctgagtgtctacattttcactcctcatagctacttggaaagatttggcaagtaaacttgctaccatggttgggggaggataaatgcctttatcctttagtgctcccaacaacaggaccttttatggccaagcacacataaaagtccatgtgattacttaggctcatagagcctagtgccatggagaaaatgttggagaaatagatgttgtgtttgctatatgcacatgccaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccctgtaactctactttaaaatacgacccactaggattttttaaaaaagaagaaagaaagaaataagacattctgaaagtaaaggaatattccatatatcttcaagctcttggtttttaatttatccttttaagtactggacaagttatttcatgatgaatttaagttaaaaataaaaatcagaaaaccaactgttttttgcattatactaagaaaaaaaaagtcagtataatccaggagatattttaatggcactcaagaatattctccagaaagggctgggcacagtggctcacgcctgtaatcccagcactttgggaggctgaggtgggtggatcacgaggtcaggagatccagaccatcctggctaacatggtgaaaccccatctctactaaaaatacaaaaaaaattagccgggcgtggtggcgggcgcttgtagtcccagctactcgggaggctgaggcaggagaatggcatgaacccaggaggcggagcttgcagtgagccaacatcgtgccactgcactccatcctgggcgacagaacgagactccgtctcaaaaaagaaaaaaaaaaagaaaagacagttctccagaaagtcaaatcagtggattaaatcaaaccatgaaatacactctgaataacttttgagtgcaaattttaaaaatatgtaaagtcactgataatttgtacattctacataggagtcattgcagacataaataattatcaagtttgttgtatttcaaagttatacaggaaagtgaataataggaatgaaattattgggatattgtgctgattctttctgttgagtaggataaaaactccgataggcagaaaggaagaatacgtgaagttgctgaaatgttcaatttataaaggtacgataacttctcaaagcatcatttttatagatttctatcttagttctttcatgcattggttatatcatataaattgatcaggctttaatcagatttgagttttaactgtgagagcagtgagtcatttagtattttgagaagtttagaaaggaagaatccaaacaaatattccttttctcttaacatacaatgggagaattaattttacttatatttaatgtttatcttatttgaagaagtaagtacatttgtgatcatttagaaaccgtttcagtggctcttgtataattcagttcattccgtctgtgctctcttaataaattttacagaaaaactcatggcaagttagcattatttgtgtgtgaattttccaattgtatttcagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctctgaacaagaaggaacacagagggtgcgacagcccagaccctgatacttcatatgtgctaactccacatacagaagaaaaatataaaaaaattaatgaggaatttgataatatgatgcggaatcataaaatcgcagtgagtactaaagtatggtttgtgcttttatcttgtgcatgaagagattgaccaaacatcttgttgcttatttttatagtgggtgatgacaacaataagtagaagggaagaaatgcattttattagtattttttataaaacttcaaaataaaattgctgaaatcttatacatgttcagtatcttaaatgtagaagtgaagagaaaacatgccgatccagactttgctacttcttaccccaatacctttggatagggcacctaaacattttgaattctttctccatctatagtgagttggctctcatgatttttaaggtatcttccagctctaaaattctatgatttatagtatagagtatgtataaaactttccctctactcccatgacttaaaaacatatgtgttcttaaatagatcttgagaaagcaaaatgtaaggtagttaggtttgttgcgaaacttgtttttttcctaaattatcttcaattattttgtatagttgctataatagcagagctaagcttactgctttgcagtttgtaaatgtccccaaatcacttagcaacaataccaccagacttttgttcttttcttatgctgtagatactaaggaagagcagcttggcttaattttaatttagggcaacaatgttcttaaactgattgcaaaacaaatagtgactttacagtttctgtatactcattcatctaaccatagtgaaagagtatttttctttgagctcatgctcctagacttgatagtttttcaaagaattctcactggaagctccattggcaagagctacttaaaacagttattctggatctgatttcctaattctgtatatgtaggtcagccgcccttgaacaaattagtttcaatgctgatatttattttagcatcagagttaattctttcaaaactgtgccctaaagtatgcatgatggatcatttcttcagagtagtcctgtattacaggttgggtattccttattggaaatgcttgggactagaaagtgtttcagatttgggatttttttcaaaatttggaatatttgcatatgtatagtatcttggggatgggacccaagtctaaacattaaatttattaatgtttcatacataccttacatactcatggactgaaggaagttttatacaatatttttcataattttgtacatgaaacaaggtttgtgtacatggaaccatcagaaagcaaagatgtctctgtctcagctacccatgtcataggtcttggctccatgtggagcatcattgggaacctgctgttagcatgtgtagcctacacacgtgccattttattaccctttgtggatgtgcttgtgtgagggaatctgggtgtgcacagaaaagatatattgaagctgatggcagactggaacggtccttttccccttggagacactgaataaactgtgtattgtatgcctgcatttccacatgtcaggtttggaattctctatggcatcatgttggtgctcagaaagttttggattttggattttcagattagggatgctcaacctgtataagaagccagctcacaaaaaaatagccttaaggagttacttttgggcaaataccattattattcttaaaaacaatacagtagcaaataaagggatgttgctgaccttgcagttaatgttaaagctgcaaagatatcgcacaaataaaagtgttttacttttgaaaaaaattgtcatatacccactgtttttatatttgttgatgtataatttttctacatgaaataaactactattgaataaagtacaataaaatatattcttccaactttgaattagcagtgttaccttatttttgtatgttagtcttttaaaatgagggcagagtaaagttgttttattttctcccactttaaattgtaaagagcaacatatatttatcgtggttaacaagcatattgtaaatggtgtgtggaggaaatgcaagatgaaaatagaaaatagaaaaaaggggatatggaataatttggagggagggaaggttagcatttataatatttgtaatttaatctttatacaatttaaagaagataccaaaaactttattacttttattactggcttggttagtagttaattttgttgtttagattagatttctttgcattttcattaaactcaaattgcattgttatgtatataattactttttttttttcttagttttgccctttagaaagttagtcaattaaatcagaatggggaatatttatgatttatcagatttgacatattaagttaataatatgtgtacacacttttctccttccgttatatttgggatctctcagtagaaatgtaatgttattaaggtttacattgaagtgccaatttatgcttacttggtgacagtgatatattttgtaatgtctaaatatgacaacactacttgattatcaggtttatcctcttaaatttgtctttatgaatatttgaaatatagaatatagacattagtatatattaatgtataaagttgaaattgaaaaggctcatgtcagtcatattcatgttcaaacataattctaaagaaaatagctttaatctgtaaattggttaagaacctatccctatcctctacttttagtaacttgagttaccttgccaaattaaagttcaaaagttactttgtagatgaatacgaaaccaacagttttttccttctttttctttatttacagcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtatgtagtgatacctattatgctggttctttaataaagagggtgaaaaaattcattgctaacataagcagtttcttattttgctattcttttattgctttgatgagcaagaatcactgatacataattggcctcattttaaagtatttttttgaaaatcaattgtgggtgtagcattgtgtcatgcaaagtagaacagtactgagaacctgccatttatatgctttccttctcatgggaaagccatactttgacaggcagaaaatttagttagatatcagaagcaaggatttaaagtagagtgtgagccattcatgttagaaatatgggtgatagactacctgattggagttagagtatcttttacatctcctcctgcctgaattacttcattaattcagcaaaatttatgttacatttattgtattagtctatgaaatgcagtgtctcctctctcttaagtcctagatttaatttagtgatttaatcatactccttacacactgcccccgtttttatcagtatgtactattttggtattgatgcaataccactatttggtattgaaggcgacatcaagcttgaaaggtaaactcatatatatgagatataataactacatcagattacatgttaatgccaacttcagactgagctagtttttatttttgtgtctttttaggattagagtgagagttatctctattcagttcacgttcagttaggtaaagagagctaattcatattcattctctgccctctgtcttctctccgtaacgttgttaggtgggatgttgagcactacagacctcacagtgccaaatggagctggaagcagtccagtgggtgagtgaattcctactcttctgttttgtaggtatctatcctatatgagatcaaaggaatgttgttcctgaaataaagctttctgggaaatttccttctgaagggtactttcactaatacatcaagataatttcttaaggggagactttctctaacttccctgcttaccaaagttagactgttaccaaactactctatcttacaacagcatgaaatgttttcagagagactagaatgaaaagaaatggtgggtctatctacttctacagatagaaagataattaacatatttgtcttggccgggcgtcgtggctcacacctgtaatcccagcactttgggaggacgaggtgggcagattgcctgagctgaagagtttgtgaccagcctgggcaacactgtgaaaccctgtctctactaaaatacaaaaaaatttagctgggcgtggcagtgtgcacctgtagtcccagctattcgggaggccgagggaggagaattgcttgaatccgggaggcggtggttgcagtgagctgagatcgcatcactgcactccagcctgggcgatagagtgagactccttctcaaaaaaaaaaaaattatggagatgattgaatgacttaataaaaatgatgaggaagaaataaacaaacatcaataaagatattattaagacaagttacaaaatatttaatgacaaagtaggaataaatgcctaattatatctgccacagtattaaatattttaatggaattaaacagataagacctattgtggagtcttacttaacagaaaacaattaaatgtgggaaaatacataaaggttgtaccagttaaacactagggctgctactcttgtatgtgtatttccaaatatttatggttttttttcagctcttgttttagttgtttgtatgcctacatactgtttttgtgtccctttttttttttattcccccaacagaataataagttcagggcccaccaagaattgtgagagcctaatatgcttctctcacattgggttgacaccccaaaaggctggactctagaagtaaagtaaaccagagataaacagttcttctcagtagtgacatcttacagatgcatcatacagttttgtttttttttttttgagacggagtctcgctcttgtcgcccaggctggagtgcagtggcgccatctccgctcactgcaaacttcacctcccgggttcacgccattctgcctcagcctcccgagtagctgggactacaggtgcccgccaccacgccgggctaatttttttgtatttttagtagagacggagtttcaccgtgttagccaggatggtctcaatctcccgacctggtgatctgcctgccttgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggacgtggtggcaagtgcctgtaatcccagctactcaggaggctgaggcaggagcatcacttgatcccaggaggcggaggttgcagtgagccgagatcatgccactgcactccagcctgtgcgacaagagcaaaacgctgtctcaaaaataaataaataaataaataaataaaataaaacaccatctcagaccttattatttctaacttggcacataagctgaactaggcacacacacaaataaagcaaatgaaaacttgcagaaataaacaaacaatggaatcagcctcctgggaactccagaatttggagttactaggcacagactttgactttaatataacagtgtttactgtgttcaagggtatttaaaaaacaaaaagattgagaattttagcagagaactgaaatttatttaaaaaatggaaattttagaacaaaaaaaccccgtaatgttaagaacttaacagatgggcttaaaaacagattggacaaagcaaatacaagaattaagaaactaaaagataagatagaagaaaattatccagaattttggagacacaaagggatggaaaattaaaaagaagacccagagcatgcaataaaaaggactagcatacgttaaattgaagtcccaggaagcaaagtcagagaaaattgggcagaagcagtatttgaagagataatcactgagaattttccaaaactaacaacaacaaaaaagccacaaattgggaaggcctataaaactcaacgtggaatacagataatgctgtgctttatgagaaatttaaacctttatgaacaaaagactggagatggtgagctaaacctccttctcaggaagtcagaaaaggacagcaaattaaacataaagtaggtagaaccaaataacaaagatacaagcattgaaatagaaaatagaaaattttctatttcaggcatggtgaaacagatgatctcatacgtgcttttgtggtattgtaaatcagtaacaatctttctggaaaggttttggcaagatgtttcagtggtcataaaaatacaagtattgatactgaaatagaaaaacaaattgaattaacaaaacaaatactgattatttaaaagactaataaaatggaatgttttcactaatattcaattcgaaatattttctaatttccattatatctttttctttaacccaacttgtaagttatttagaattatatttcttaatttcaaatacatggagattttccagttatctttgagatattattttctagccagattgttttgttaccagagaacttacctctatatgattaagttctctgaaatttgctgatacttttttataggccagcatgtgctcaatttttgtctgtgttgtgtactggaaaggaatgtttattctgtattataagcatggattgcaaattctacttgttttaaatacgttttatctgtatatatgtcataacttactgtatcagctccagtttagaaactcgtgataggtcagttccagatagttttgcgttacctttaaaccatatcatttttaccaatattgtcattttcaaatacgtaatttgtttataggcgagtcttccatttgccttgttcgtattttaatttttgttgcatcttctgcctgcttccctaaaattggaatacttcaggcccatgtactgctaaaagaagaggcatccttgagacttttaaagcactgaacgaactcaggaaaggcaaagacttcttaaataagaaaccaaagaaagtctaatggaaagactgattgatttgcttgtgtgaaaattggaaactttgtgaatcaaaagcactgtaaagagagtaaaaaggcaagacagaatgggagaatatatatagtatgtatacaatcaatagagaggtttttttttaagaatacctacaaatcagtaagaaaaagaaaactcgacttttgaaaatgtgcatgagaacacatcacttcacaaaagaaatgtctgataaatgtgaagaaatgctcagtctcagtagtcatggaaatgcaaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgcagatacgtgtattgtgtgacccagcattttcactcatccttatgtactgtagagaaatgcatttgtgcatcacgagtaccaagagatatgtaaaagaatgtgtacaacattatgttaaagtcattgtctagaaatagtacagatctctgtcaacagtagaatggataaatataagagtacattcatatgaaagaatattatactgcagtgaaaatgaaatcacagcagttctcaacatggatgaatgtcaccaaacattatgaattaaagaagatagatacatactcaagattctaactatataaagtttgaaaagcaggccaaaaaaactatagtgtttgggatgcttgtgtagatagatggcagagccataaagaaaaaccaagaaattactgtaaaattcacaatagtggttactttgggtaggtgggactctcggaatattttagggggcccaattatggaaacttctggggttctggcagtattcttaatctgaatggtggttacgtggatcttcactttatgataaatccttaacctatacgtttttgttttgtacattttctgtttatgtgttacattagcaagaaaacagttttgaaaataaaagaatacactagatataataataaaggaactataacaacaaatataaaggcactttttaaattataagagaaaataatgtacattttgtggtatttatactattccaaaattcagagagaaaatgtatagacactcaacactcacattcatgcacaaactagaggtagcctttgagtctttggacattgttgtctgcatgtggcagctggaactcagcacccatcttaagatcatgagacaagtcagtttaagatgacaggtcaaaatgccaaggttgatgaagtgaaaagctggtggccctcagtgttgagctgctgaagcagctgagtctgggaccactcttcccctagtctttttatgtgagataatacgtgttgctcattctccagaggaaaaaagcaagataaaatccaagcaacagataggggaatgtttagtaatgggcatttaattgtaccaaaatacacaattcaaaaaagaaacctaactagtattttaaaaactgaaaaggttgttcatcattggtagtattcatgaaattcaaattaaaatgacaaaaaaaaatactactcttacttactaattcccaactattagcactttttattgtgatattcagtgctaatgaaggcatggtgaaactgatgatctcatgcatgcttttgtggcattgtaaattagtaacaatctttctggaaaggttttggcaagaggttttagttgtcataaaaatgtttatacctccaagcccactaatcccatttttgggaatctctcctgaagaggtaagttagaataagcaaagcttcattgcaactttatttgtagtaatgaataataggaagaaatcaacatattcaacaatatgaaaatgaagtaaatgaaatttcaactgaatttctttttagttgtgatttaaaacgagcaaaaaatatgagcatggaaaacaaaaagggaaaaatccaaagagattataatacttaagatggtgggactgtgtttttcactctttttctagtttcagtgatgctgtattaatacagttacctctacagtcataacatctttattgtagtaaattagaatatttctttatttattacttataacttgttttccattgtcatctgtgcaaataaaacttggcagctttgtacatattgtaatttgtatagatctttcatagaggtaatttgcttatttgtttatgatttactaggtatatttctctatggggagtttaatactgggtttatactatagttcaaatgactttggggactttttactttgggcacactttaaaatatcaagcataaaataaagtcagatatccaacaacttcactttttaaaaacacgttgagaaagagaaaaaacatatatggtactagacatagaaaggctcaagatgctcttggaattatttggggttaaatgaaggtaaaataagggtttgcattgtagcaggcacattggcagttaaaaagaagagatggaagaggtgaaagatatcatgaagaaagcttgattgctctgaaggtggggatgggatggcggaggacagcagtagttgaagtctttagaacaagctgagttgagatgacagcagcatgtctgggtgaaagtggccaccagattattgaatatgtactggaaattaggaaagataaagcagaaacccagttttcagtcattcacatggaggtgatagttgaagttgtatatgcttcagcattcatgcttcatgaagatgctgaagtttctgaaagagaagaagatatgttgccttttgggggctgcccacatgggatagagatggggaatacagtattcagaaagaaaagaagcagaccccatgagcattgcctatttttgttataaatttttattggacaggatccatgttgtccatcttacaagacatttcattgaatcaagtacacatgcattcaattatttcaaaacctgtgatctttattattttattttattttagactagtcaggtgcagtagtgagaagggggtaaagagtagaacaaggagttggataagttgagataactcactgccttcgaaccagccctgtaatcttttctactttcagaaacctcaaacagttctttgtacaaatgacataattttataactgttagaatgtatttttgtttattgaataatcagctgaatgtcaaattttatgaaaattttgccaaatatgattgaactttgctttggatgagtttttcagaatcctttgaagtttgcacatcagttggacttctgaaatgaattcatagtgaaatattagtgacatcattgtctgcagtttaaccctagaagagtagtatctaaggacacagagtacttgccagctacttgaatgcattatttcagctgatgtgatttatattttgaaatatgagccagactgatggaattgactgacctatcttacagctataggactgtaattgagatcaagttctgttaagtttctgaaggcatgggtatgcggtttgctcaagagcattttttcacatttgtgttaggatagtaaattaccttgaaaactggaaacacattttaacaacattaaattggatttattcatttagtgtagatactgtagttcctaggtttgtaaactgtggcaagatgagttatatactgaaagtatttacctcaaaagtctatctgaaaaatatcttcatttttgtaataaaaattgagctggaggtaagaaggtacatattagggtatatatcactgcactctacaaaataacaagtcgtgcataggagattctcttagcttcagcctggcaagttaccaaacacttacatcatcctttaatcatcatctgctactgactcctgactttacatcaagaaatactgtgcttttaagtcccctcttactcttgaaatttggttctcatgagttaccatcatgtcatatctatctaaagcaccatagactgcacatgggaaaatagtatttgtgcttcttgatgatgtgtggctctgaattatatatttttgtctttgagaggaaattctactttcttcttcagatttgagtataaatcaagtaaagaagaatcttctaaataatatcagaatcagaacacatattcatgccattgtatatttaaaaaattattaatctgacattctcatactgttaacgcaaaatgaagtttctatttaaccttcctatttttgaataaaattatttaataaacatttttaattcttcaactgtctggcttagcggttacctctgtccaagtcatatatgatctctactcgacaggatggcctggtgaagtggttgttttttaaactgcactgctttctgaagcttaacaggatgcaggaaattactctatggggtgtggaaaggatttaattcataccccttcaagataatgaaagcagaatgcaggaaataacctcatgaggttaactgaaataccagtccccacagcaaaattagatcatacatatgaattaaaactgagtgggtcacttggtaaacgttttggaggaaacaagaggaattgggtgagggtaaggaagaaaaaaccacactaatcatctggaactcagaaattcttttgtttgtttgagacaggatctcactctgttgcccaggctggactacagtggcacgatctcggctcactgcagcctccacctctgcggctcaggcaattcttctgcgtcagcctccctagtagccaggattacagacatgcaccaccatgccctgctaatttagcatttttttttagtggggtttcgccatgttggccaggctggtctccaactcctgacctcaggtgatctacccatctcggcctcccaaagtgctgggattatacttgcgagccaccatgcctgggccttttattaaaaaaaaaaaaaaaaaaaattatttcaatagttttgggggaacaagtggtgttttgttgcatggaaaaattctttagtggtgattttggagttcaccagagcagtgtaccctgtacccaatatgtagtcttttatgcctcactccctcccagccttcctccttgagtccccaaagtccattgtatcattcttatgccgttgcatcctcatagcttagctcccacttataagtgaaaacatgtgatgtttggttttccattcctgagttacttctcttagaataatggtctccagttccatccaggttgctgcaaatgccattattttgttcccttttatggcttagtagtattccatggtgtacatatatgtatatatatatattacgttttctgtatccacttgttggttgatgggcatttgggctggttccatattttcgcaattgcaaaatgtgctgctataaacatgtgtgcgcaagtgtctttcatatactgacttcttttcctctgacccagtagtgggattgctagatcaaaccatagttctacttttagttctttaagcaatctctgtactgttttctttagtggttatactagtgtacattcccaccagcagtgtatgagtgtttgcttttcaccatatccatgccaacatctattattttttgattttttaaatatagctattcttgcaggagtaaggtggtatctcattgtgattttgatttgcatttcactgataattagtgatgttgagcatttttcgtatgtcttttggcaatttgtgtatctgcttttgagaattgtctattcatggcctttgcccactttttgatgggattgtttttttcttgctgatttgagttccttgtagattctggatattagtcctttgtcagatgcatagtttgcgaagattttctcccactctctgggttgtctgctgattatttcttttgctgtgcagaaggtttttagtttaattaggtcccatctatttatttttgtctttgtcatatttgcttttgggttcttgatcatgaaccctttgtctaagccaatgtctagaagagtttttccagtgttctagaatttttgtgatttcaggtcttatatttaagtctttgattcatcttgaattgatttttgtgtaagatgagaaatgaggatccagtttctttcttctacatgtggcttgcctattatgccagcaccatttgctgaatagggtgtcttttccctactttatgtttttgtttgctttgttgaagatcagttggctgtaagtatttggctttacttctgggttttctattctgttccattggtctgtgtgcctgtatttatgccagtaccttgcttttctggtaactatagtcttgtagtatagtttgaaatggaaataatgtgatgcctccagatttgttctttttgcttagtcttgctttggctatgcaggctcttttggttccataggaattttaggatttttttcccccctagttctgtgaagaatgatggtggtattttgatgggaattgcattgaatttgtagattgcttttggcagtatggccattttcacaatatttattctacccatccgtgagcatgagatgtgtttccatttgtttgtgtcatctgtgatttctttcagcagtggttcatagttttccttgtagaaatttttcacctccttggttagttatgttcctaagtattttttttttttgcacctgttgcaaaaagcgttgagttcttgatttgattctcagcttggtcattgttggtgtatagcagtgctgttgattttgtgtcctgaaactttactgaatccagtaaagatgtcatagatggcttttattactttaagatatgccccttctgtgccagttttgcttattgacttgtgtatgttaaaccatccctgcatccctagtatgaaacccacttgatcatggtgtattatcttttgatatgctgttggattcggtcacctgttattttgttgaggatttctgcacctgtgctcatcatgggtattggtctgtagtttacttttgttatatcctttcctggttttggtattagggtgatactggcttcatagaatgatttaggaaggattctttcttactctgtcatttggaatggtaaaataagattggtactagttcttctttgaatgcttgatagaattcggctctgaattcatctggtcttggactttttttttattagcagtttttaaaattactgtttcagtctcgctgcttgttattggtccatgcagagtttttatttcttcctcatttaacctaggcgggttgtatatttccaggaatttatccatctcctctagattttctagtatatttttccacccctttactttatgtgagtccttacatgttaggtgagtgtgttgaagacagcagatacttggtggatttttaaccattctgccattctgtatattttaagtggaacatttaggccatttatattcaacgttaatattgagatgtgaggtactattttattaatcattgtgttagttgttgcctgaatactttttttttcattgtgctgttgttttatgggccctgtgagatttatgatttaaggagggtgtattttcaggttttgtttcaagatttagaactccttttagcatttcttggttgtgctggcttagtagtggtgaattctctcagcatttgtttgtctgaaaaagactctctcttcttcattcatgaaggttagttttgctgggtacagaactcttgaccggcaattattttgtttgaggaagctaaagataggaccccaatctcttctggcttgtagggtttctggagagaaatctgctgttaatctgttaagttttcctttgttggttacctgatgcttttgcctctcagctcttaagattcttccctttgtcttcactttagataatctgattactgtgtgcctgggtgacaatctttttgcaatgaatttcccaggtctttgagctttttgtatttggatttctagatctctagtgaggccagggaagttttcctcaattattttctcaaatatgttttccagacttttagatttctcttcttcctcaagaacaccacttattcttaggtttggctgtttagcgtaatctcaaattttttggaggctttgttcatttttgttttttgattttttttttaatttgtctttgttcgattggattaattctgtcacctaggctggaatgtggtggcgtggtcttggctcactgcaacctctgcctcctgggctcacctcagcctccttagtttctgggactacaggtgcacaccaccatgtcctattaatttttctttttttttttttttttttttttttgtagagacggggtttcaccatgttgcccaggctggttttgaactgggctcaagcgatctgcccacctcagcctcccaaagttctgggattacaggcatcagctaccacatctgacccagaggcaaaccattttacgtctcagaatgcagtcttgtcaggatgagattattaggacgaattttagaccagtgttaagcacacagcagacactcagtttttgttagtccttgcacgtgtattaatacaggggtgtgtgggtgtgtgtgtgtatttgtaacacctagtgtctgcttatttttcgtgaattctgaagttttctttttggctttatactagaatgaaaggagcagaacaaatacagctactttttccttctgatggtccctgaagctgtggattatccaggcttatctgctctgccattcctcactcacaccttgttcattcgtgctttaacgtgtttttctcacatttatccataatgcctgccttctcttttcttctgttcttctctcatttcagactgctcagtagttaatcccacaaaggctttcctaattaagctgatagatttgttatcagtgctttctatttcattgtaaattttgtgtggttacctctagtttgcccatattgtgagtataattttggtatattcatgcctatgtgatatgcctgctcttgctaactagatgaaaagctacttgaagacctgtaggctttttatggtttctctacatataccctcccaggggcacagtactgtatacataatagatatttgaatttttttaatttccaaatagtaaaggtacttctatgatttccaattttaggcagttgctagtcttaatgacatgtgaatgctgagtcctccccagagaacttaagaggcctgtttggctcatcaggaacctctggttcactattctgaatattttgttctttgccagctttgtaataaacacttatcttttattcttctctgctttatttgtgatttactttgaaattgaaataccacactgtaatctctgttttataaatgcacattatatgtttctgtacactggttacttatctactttttacttgtcattatctctgctgttggactgcaagctggtgaataatagctgtttctattaggatagtatcagttgcaactaacagaaaactacctcaggcttaaattgtataggggatgtattaacttacatgtaaccgaaagatccagaagtggtacagactacaagcatggtttaatcagggattttacatcatttgtttgctgttctcctttttgtatcagctttttcctcattctggccttcttctgagtctcaaaatgacttaataaaatgctggccggacacgttggctcatgcctgtaatcccagcactttgggaggccgaggcgggcagatcatgaggtcaggagatcaagaccatcctggctaacacggtgaaaccctgtctctggtaataccacaaaaaattagccgggcgtggtggcgggcgcctgtagtcccagctactcaggaggctgaggcaggagaatggcgtgaacccaggaggtggagcttgcagtgagccgagatcgcgctgctgcactccagcctgggcaacagggcaagtctccgtctgaaaagtaaataaataaataaataaaaataaaatgcttcctcaggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaaaacaggatggtttcatacgtattttatatctcaactagtacccaaaagtattatatacatagagcatatatcacaatgtgcatttttcctcatttcattaagggagatggaaggttctgttagggaaagtttaggaataagatgattaaagtgagataaatcagaaatatttaataaggacctcagtgaagctgaagaaacagactcagtagaagtagagccataaggaagaagtacgtggtgaaaacggggcattagaaatgagtgctgaataagctgcagttaagaagctgctctgatacctagttcactactcagaacttagtggtagcagtgcctttgctctcacaagagtgaatgaataggctggtctcagacatttttctataatacctccattattttagtccccagtatgagatgccctcttagaaatgtggtcttttgcttgtttgtttctttgagacacagtttcactctgtcacccacgctgtagtgcaggggcatgatctcagctcacggcaacctccgtctcccgggttcaagtgattctcctgcctcagcctcctgagtagctgggatcacaggcgggcgccaccacatccagctaatttttgtattattagtagagacggggtttcaacatgttggccaagctggtctcaaacacctgacctcaagtgattcaccctcctcggcataccgaagtgctgggattacaggcgtgagccactgcacctggccagaaatgtgttgtgtgttaaatctctttcagcaggtccaaggagtaatgctgtacaagtatcattagtcttaagctttatatgtatttcagactttgcttgtcttcctttgcttatttttaagatatcccaaggtacttcattagttaccacaggttgagtatcccaaatacaaaatgctctaaaatctgaaacattttgagcactgacgtgattctcagaagtgtcaattggaggattttggattttcaggtttagggatgctcagccaataagtatacaagtattccaaaatcagaaacacttctggtcccaagcatttcggacaagggatactcaaacctgtagtgagttttgttataaaatttatttgcaactcagactggggaaaacttgatttgtttgtgccaaagtattttaataactcttctcactttattgaatgatatttttccccccagggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctatttcaaatacacaaaaatcagattatggaaatttgcttaacagttacttaaaattaaagctaaatacgaacgtggttggaactggaggttattgtgttaagtgaaataagccaggcatagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatatacccctgtatttgataggagagaagggtgactatagttagcaacattgcagatggagtatatttcagagtagctagaaaagaggacttgaaatgttcccaacaaatagaaaggataaatactcaaggtaatagatgccccaaacaccctgacctggatcattacgcattctatgaatgtaacaaatattcacatgtaccccattaatatgtaacacctttcgaatcaggtttttttttttttttttgagtcgttttaaggagtgaaatttagtagccaagaaagaaggaaggaaggaaggagaaaacagctccctccaacagagacagagggaggggggattcaaacaaagaggaaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggcgcgtgcctgtaatcccagctactcaggaggctgaggcaggagaatcgtttgaacccaagaggtggaggttgcagtgagccgagatcacaccactgcactccagcctgggtgacagagcaagactctgtctcaagaaaaaaaaaagaaaaaattctgcataccacagaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatactaaatgatatgccaggtgttctctctgctgagcagttgctaaactcaccattagagtttttgctaagtgaaagtgatgctgtcaggcttagataataattccactttggtataatgctttatagattccatagcaccttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtacttttttatctggttatacagaaatctggaaacagtcactcccagcctcacaattaaaaaaacttggatatacagaaagttcatagttttccttgaactcattatagtgctgagatttcacggcaaccaactggcccagatactccagagtcaaagacactgtaaggagagttgacatttgagcattagacaagacacagatggtaagagttaagctagggtgattggtgaattgctggaggccaggtgtacactgacagaactgtgtgaaactcctgggggccgcagtataacacagggtgagtctgtgttctcttgtatacttttttactccgtgaatcccatggggtgctcagaagctcctgaaaaggtctcgctgtggtacacaactgggagaggggaagagtagccactacactaggggcaaaaagttttgccaggatctttttgtcttctttctctaatatgaaacaaaagctttaatctctgagaagacgaacaacaaacattatcactcttagggcactgttgaaatcctgtttaatggaaaaggcaaaatatctcaaccagtggtgaaggaacaggaagacatgctcggtatggagcgatgccaggagagtggcaggatgactgagaaggccacagcctgaggcacaacaagagaggggatgacttaaagctgagagtggagcaggcactaggggaaaacctggcatgcagatccccacccccagagggatatgaagcttgtggtaggtgccctgatggtaaccagagcaacagtaaggctcaaacccagtccagcttctaatgaaattaactcgattcttgcactaatagcttagcaggagggaaaaacctgtaggtctattagtaggaattacccatgctgaaatacaaagagaaagaagagtgaaaacaagacaaaataaacagaattaagtatccaagagctatgcaccattatcaaatggtataacatatttataattggacttccaaaaagagaagagagaacagattaggagtaatattttaaataataaccagtaccaagtaggataattactactgccaacacacacatgcacgcatgcacacacacacacagatgtatgcacgcacacacactctcactcctagactgctaaaagcaaaagatcaagagaaaaatcttagagatacattacagaaaaacaaagataaggattagtaacatacttttttcttcacaaactaaactattcaagcgagaaaaagggagtaacattatttaatgtgctgaaattttttaaaaattcctcaccccaaaattctctacccaccaaaaatatctttgagaaatgaagatttcctcaaacaaaagtcatgggaatttattgccagcagacctgctctacaagaaatgttaaaggaagcccttcagcaggactgtgatcccagcaaaaactcgagtctacacaaagaaatgaacagtggaaatggaataaatgaagataaaataagtaaactctggttttccctgcattttataaacgttttatttttagaacaattttagatttatagaaagattgcaaacatagtacaggaagttttcatacaccccacacatcattttttctattaacattagtatggtgtatttgtcacaactattgaaccactactgatacgttattattaactgaaattcgcaatttattcagatttacttatttttaaccttgtgtctttttctattctaggatccaatccaggataccacattatatttagcaatcatgtctctttagcctcctcttgactgtgagagtttctaagactttccttgctttaatgaccttgacagttttgaggagtactagtcaggtatttttatagaatgtctctagttaagatttgtctgatgtttttctcatgcttatactgtggttgttggtttgactgaggtaggccatagaattaagatgccgttttcatcacatcatatcaagagtgcctactacatttattatcccttatctgatactcaggaccagaagtattccagatttcagattttttcaagttttggaatatttcccttatactaataagtagaacatcccaaatccaaaaatctgaaatccaaaatgatccaatgagtactacatgcgagtgtcatgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccatgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggttttttttttttcagggggagcaggcgcttttttattttccggcactataatatattctaggcttatcttgtgtattttctgccccagtcctagaatcaggcatttctccaaggaacattatttttatggagaatgaaagaaaccaagatccgagtgctttccctctttttaattgctccaaaaggtatctgactatgtaaggcaaaaatagtaactgtattttgtttctgtagcacatgtaaaaataaaatatatgacaacaaaagatgggagggaggaattgactctacacatgatgtaaatattatttgaagatgaactcaaggtaactaaaggtgtatattataaaccctagtgcaactacagaagaaaattttaaagaagtataaataagtcagtagaagagataaaatagaaatataaaaaatgctctactaagtagcccaagaaatgggagaaaagaagacaaaaagcaagataatggtagcttttaatccagtcatataagtaatcacattgaatgtggtgagaaagcgtcagttaaaagattgtcagatttgtgtgtgtgtgtgtgtgtgtgtgtgtgtttcttaaaaagcaatgtggtggctcatgcctgtaatcccagcactttgggaggctgagacaggcagatcacctgaggtcgagagttcgagaccagcctgaccaacatggagaaaccctgtctctactaaaaatacagaattagctgggcatggtagcacacgtctgtaatcccagctacttggtaggctgaggcaggagaatcacttgaacccgggaggcggaggttgcagtgagccaagatcatgctattgcgctccagcctgggcaacaagagtgaaactccgtctcaaaaaaaaaaaaaagaaaaatgctgcttacaagaaatccactttaaatataaagacatagataaaagaagggagaaaatttaccattgcaaacaccaaaaagaaagctaaagcagacctattaatttcagacaatataagcttcacaacaaggaagagtatcagcgataaggagggacgtgacatagtccactttccaagaaataactgtctttaatgtgtatgcacctaacagcaaccttcaaaatacataaagtgaagactgatagaactaaaaggtgagtagaaaaatccacaattgtagttggagacttctatatccctctcagtaactgatagaacaagtaggcagaaaaatcagtaaggatctagatgatttgagcaacactcgaccaacatgacctaagagacatttatagaacacatcactcgacaacagcagaacacacacttttcacaagtgcacatggaacattcaccaagatcacatcctgtgccaggaaacaaactggcaaatttcagtgaattgaaatcaggcatattatattctctggccataaggaaatcaaactagaaatcagtaacagaaaggtagtaggaaaatggccatatatttagacattaaacaacatattttaacccaaggaccagagaagaaatctcaaaggaaatttaaaaatacatatagccaaatgaaaatggaaatacagcatcaaaattttgaggcccaactagagtagtgatgaggtgagatttatagcaacaaatgcctatatttgaaaagagggatcccaaatcagtaatctaagctcttaccttaagaaactcaaaaaagaagagcaaacttaaccccaatcaagcagaagaaaggaaaatgtaaagtgataccaattctacacagtctctttcagaaaaaattaggagagaacactttccaacttatttttttaggtcagcattaccccgctgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaattcattagtataatcagtatattaacaattgaacatctattcatcatttaaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattacaaaaaaaactcctcggaccaatcagtgagtttagcaaggttgcagggtacaaagttaatatataaaaatcgattatatgccagcagtgaacaattggagtttgaaatttaaaaaaaaaaatgataacaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaatagctagaatgattttaagaaggaacaaaattttaaaaaaatactactactacccgatttcaagacctactacaaagctatagtaatccagaaagtgtgatattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacaggaaactgaaatttagaggagaaaatccaacacaaaaagcaggatccataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacacatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggctgggcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgcctgtaatcccagctactcaggaggctgaggcaggagaatcgcttgaacccaggaggcaaaggttgcagtgagccaagatcataccattgcactccagcctgggcaacaagagtgaaactctgtctcaaaaaaaaaaacaaaaacgcaaaaactagaaatgctggtgaggatgcaaagcagaaaatctctcccatatctttggaatgcaaaatggtacagccactttgaagagttggtcagttcttatgaatttaaatatacacttgctggccaggcagggtggctcatgcctataatccctgcactttgggaggccaaggcaggaagactgcttgagcccaggagttcaagaccagcctgggcaacacagcaagaccctgtcttaaaaattaaaaaaaaaaaaacaaaaaaaacttgctgtacaatccggtaatgccactctttgagtatttacgcacatgaattgaaaactatacttataagaaacccgtatctttcataattgtgaaacactgaaactagcctagatgtccttcaacagatgaatggataaacacactgtacatccatataaagaaatgctactcagcaataaactgtttattcacccagcaatacagatgaatcctaagtgaattttgctaagtaaaagaagcagtagtgtatgattccatttatatttcattctggaaaatgcaaaactcactggctgccatgggttgggagtggagagaggagttgactataaagggttaatagggaatttttgaggtgatggaactaatctgtgtgatgctgttttgttagatgcatgggtctgtgtttgttgaaactcatgaaactgtacctacaaagagtgacttttactaaatgcaatttagtaaaaaaagattccgggggagcccaagatggaatgcatattgtcacacatgaatataactttattacagataagtaacatgatattgaaggggtgaggaagcaagaacctggtctaagtaactttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtgtgtgtgtgtgtgtgtgtatatatatatatataatttttgtatttttagtggagactaatttttgtatttttagtagagacggggtttcgccatgttggccaggctggtctcaaactcctgagctcaacatctgcccgcctcagcctcccgaagtgctgggattacaggcatgagccactgtgcccagccagacacatacgtatatatgtgtgtatatatacacacacacacacacacacacacacatatgtacgtatgtgtctggctgggcacagtggctcgtgcctgtaatcccagcacttcgggaggctgaggcgggcagatgttgagctcaggagtttgagaccagcctggccaacatggcgaaaccccgtctctactaaaaatacaaaaattagtcgagtgtggtaggatgcccccatagtcccagctacttgggaggctgaggtgagaggatcgcttgagcccaggaagtcgaggctgcagtggcctatgattgtaccactgcactccagcctggctgacacagcgagaccctgtcacacacacacaaaaaaggtacagttgtgtgtacatatgaattagtatacatcatatatttcctagctctgtttgctgagaggtctgtgaggcaatagcatccagtaactgaacatacctggtgctcagattttagtttcagaacaccattttctaatacaaggactcagggctgcttggaaaaaaatggtttgttgtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcattagaacaccacagtacaatggtaattgttgcaggcaaagtcagtggataaatgctaacataagtgggcaaaaagtttaagtaaaaagctattttgctttgtctcagaatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgacatgctaagaaagccatgtctctttgtggtattcttgcaaaaatccatgcccttctatctgattatgaatgaaaatcagacccaaattgagagacattctataagataactgatcagcactctttcaaaacaagttgtcaaggtcatgcaaaacaagttgtcaaggtcatgaaaaggaaagactgaggaactgtcacagagcagaggagacgaaggagatgtgagaactaaaggcttgtgggatccaggatctgatcctgggtcaggaaaaaggacatcagttgaaagactggtgaaatccaagtaaagtccaaagctttaattggtgctgtattatttttattagtttcgacaactgcattgtatttccttgtgatgttaacaatgtggaaagctgagtgagatgtgagggagctctctttgtaaatgctgtctaaaattatttcagaataaatagtttaaaatatatacatacatacataacaaagaaatacaccccaaaagggagccaagaaaaaatggcatttaggatggtcccatagctcacctttcaggtactggatatgcaatacttgctactgtctttcagaaataaactctacaaaatgtcatgtagggtacagaaatgtttacaagaattgttagtaaactgccaatttagagacaaactccatttaagcattttagcaattgcttaataaagttatgtctgattgttaggagagcatgaaggatctccatggaaaactcaaaatgtgtcgtatgaactatttacacgcttattcctgtatattaaagtgaaaaccatatgttttacacatacacagctataatgttagacagtatattttggtgtgtaccttgtgtttggagatatgtaaagatatctataacaaaacagttgaatagcatcttgcccacattggagatagcagttgtagatcaagtgattgtttttcagagtaagtaatcggtcccacctactttacacacaccatttacagagaaaccttcttccagattagggcttcatgtatcagtggcacttacaatgacacttttcacagactgacagagaagcttaacttactcaagtaaaacaagtaaaaactgattagactgtttctagcatgttaatattttctaaatgttatggagaaaaggagcaaaaatgtttctttttttttttttttttggacggagtctcactctgtcacccaggctggagtgcagtggcgtgatctcagctcactgtaacctctgccgcccgggttcaagcaattctcctgcctcagtctcctgagtagctgggattataggcacctgccaccgcacctggctaatttttgtagttttagtagagacaaggtttcaccatcttggccaggctggtcttgaactcctgacgtgagccaccgtgcccagccttatttcttttctttacatgacttatgaattcatttctccttcagtctcattttcttcaaatatgtggtttttctccattgaagtcattttattcacatgaaaatatatttgcaaatgataaacatatataaaactggtatttaaaactcatgtatttattaacaaatgtttgtgttcctgttgttttataactgctagctcctgcgggaaataaaacatacagcagtttctttctgccaagaagcagaattcagtaggagatagataacatgtatcaccaggtggggtaatagtagggtgattaagatacagagttacaagtacagagttgatattctcacagttccaaatacagatcgatagcatgatgaggaaccccttttaaatactgttgcagtagcatgactatgtataagaggccagcatgagagcagaccaagttggggtaggagggtgtctttgaatactggccctagagaatttaaaataatttttctagtcttttgaaaactcaacaagtagagacaagtaatttatatttctatctgttgtgtatataatcgtctctttagagttccagacagctgctagtgtccaaatatgttttttctaaagaaatattttgtttgtgagtaccaacagtcttagtaactctcttatccctcttatgtgctgagtacagtcggaggaagaggaattggagttggtgagtgtgggtttctgcttgaaggaagttgaaaaagatgtagaaagtactaattctcttacgtgttgttatctaaccaatgttccctttgttacacaaatttttttaaacactattcaaacactttgaataaagcaatctactggtactacagactctagtttttctatttataattgtatgtgttgacccattttatttgttggagggaacattggaatagagcctttaaaaacagtagctgtccatgagcataggatacttgttaattttttttttaaggaaagatacaaaataccttatatagctctccaaattattgaaatatttttagaaaatgacttcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcagcttgcagttgatctatttcttctttaggaactaaaaccaaaacctcacaggagtcatcatataatttcaaagtcagctgctaattaaaggactttaaggggaataaaaacttgaaaatgtttcttagcatggacaaaggttaagagtgcatgaaagcatgggggaggaaggcatccgttggttttaatattccatgtttatgcatgctggtgtgttttgcacagtttgttttcttttcaaagaaggttatctgttccccttaaaatacgagattgttctttatttagctttgtgatcactcacagttttgggtgtagttttgtattggccaactgaaatattctagtcagctgtaaatgttttgaattatattatgaatatcttttggagaaacactttacttaatgataccataatgatcagtaaatgagagtttataattcaagctaaaataattcaccttaggttagacctcactgttcaaggagttgtgaatgcgtccatgaattatctagcactatactgccctcttgtggttctgaaaatcactcactcttgtagaactcagtgccgttgagatgaggagcttagatgagtggaactagtgtttgaagtcttcactgcttttgaagacatgccaggagattgcatgaagatgatgccatggagtaggtagggtccaggccaaactatgtcatactgtattctttcacctagtgattggacttatgaagttccagactaaatattaaagaagaaattaagtccaaagtagatctctatctcgaaaagtcattaaatttataaacttgatgctgagactaaaatatattccgaactggcatacattgattttccacattcctcagagtacatctgtaattacagaacctcagagataaatatattaggtccttgaagactttaaaatacatacctaaaaacttataaacagccatttatattatttaaaacttaatcaattaaaaatgcagaactttatgtgccagaaccaaaatataatcagaagcacagtccgttacaacttagaaagttgttcagcttgccttgagctctaaagtataattgtggatgactctgatccgaagtgcagaaggacaggtgccctggggcctgcactaaagactgtactgttaagaccagcgacagattcctttagaagccgagcaatactagaacaacttgacttcatgaaagctgcagtagactaggctatggattagaaggaataaaaatatgtatcttttttcccaccagttatatagaaatttgggacagagggtttcttaggacaataaggatattatcttatatttgtgtagtacttcagttatgaaagcacttctgacatagtaacctcatttgattctcacagtagctgtgcaaggcagccaggacaaagattgctatatcttctttatttgacaatgaagaagttcagagaggtcaaattattttcccaatgcctaggaaatggtgaatctgggacagaaactcaggcaatacatccacatccacatgatctttctcacatcttctaacctaggttagaaagtagaaattaaaaagaaataaactgagatcaggatcctcatcgaatgtttgtaagtgtctacatctagccaaaggcctttttgtctgatgtacccttttgaaaattgtgatagagaaaatggaatcacattctaactcttcataatctcaaaggcactgaattatactttactgatttggctcagacccccgaatgtcagttatcaggctgtaacataatttataaaaaacaaatagagttgtgctgtggctttcttatgtgctagtgacacagagtctgttgtgttcctctgatctttgattttcaaaaaccgttaccttaagccagtttggcgagaaactgcttctgtcgtactcctacacgttaaggacaatgactgtcttagactaactggattatttaatagttgaattttttttatccattcccagcatggataggatgctacacagatgcatccagttggcaaaaagcatttaatattgctcttccactgccctgtcggcagtacttgattcaaaattctctactcaaagcctctgctacagaaggccaggggactatgaagggatacatgtccgaatctgttgttaaaaaataggtcaactgcatgattggagagaaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaatacccagaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgattttttttaagtatatttattgaaataaactatttccagttttttagatttaaattaggatgtatttttcaatgtgctagccttgaaaaaattacaaacaaaatggatagtgtggatagtgcgatgagtaagttattccggcttctccagtgtgaactttcacttaacccctgacacaaagccacgtggatgatagcaaaatggtgacatgcatcaagccaagaggggagcagcctgttgcttgagtattgctgatgtagtttctcttcatacagtatcacgcttttccaggcttttaaaataagatgtttgtctttatgctgtgttaacctgctttgggaaagacatgaatccctttggacctgagacttcaggaggtggccgacgtttggctgtgtcgaacaggctgttttcctccctgtaaccactagcttggtccatgtcatgtgcacctgaggggcaaaacaagggctgttctgatttctcctcggagccagtcactctgcctttgaggggagcttttccttcatttatgtttatttaggcatttcatcttaaaatgccctaatttggggttgtattaggaaagtttaagaatattacagtgatcgtaggagtgcttttagccaagcagactgtatggagaatcgagggcagctggtttcatttaaatttaccaatctaagaaggagtggaaaacacatgtggtttcgctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagtctcttaggaaatatccattacttttccaaccgttagtatgaaaaataatgcccaaatttgtcaactgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggcaaagctatactgttcaaaggtgtattggctgagaagagggagcttgaactgggtgtcagattatggtttactgaccgtttcattacaggtttttcagtatacttagaaattccactatacttatttttagaaatgccattgaattgggaatttattttttaaaagtataaaagaaattaccaaagcatataaaaatggaggcaggctctcaaaatcatcagtcgcttagcgtcagtctcatgccaccttttgaccgactttatctttcttctctttctcgtaacacttactctgtttgaagtttaccatgttgtttttaacttatttccacatctattcagcaaatatttatcaggcagctgctgtgtggcaggcactgtgccaggcactggaaatgcaggagtgcagtcagcagtgaagcctggggggaaggcacaagacacacagctctagggataagctgctgcagttgtgtcaagggctgtgtctcagctcggacaggaaggaacatgcgtgactcagccaggcagaggaggcagagtgctcttgggagagggtgtgcctgtacaaaggctaggagtttgcgggcgggacggggctgaaggaatggggacagagcgtgggtggttagaattgagactagagaggtaagtaatgatttgtagactatgtcaaggattttggaaactgtccggagagcattggggagccataaaaaacttttgaagtagaggagtgccatgaccatatttgttattttaaaaagatgtctttgctgtatatagggttaaaaggcaatgccaggaagccacatcagaggctactgtagtggtccaagcaatgggtgctgatagcatagactagagaggtggcagtagagatggtgagacctgggcaggcttgagagagagcagatagaattgctcagacctggaaattgatgttgggagtgagagggaagggaagtagcaaggataacacccatgggcttctgcacgagctgctgggtgcatgttggtgccatgtactaagagtacttaaggaggaacaggtttgcaggaaaggatgggccatgtcagatgtgtggcgtttggagtggcgtccaaatggacatggcactaggtcgtttaaaagatctagaggtcgaaggagactgtgggccggagggagcactggggaaggcgtcagtgtgacgggtccttgccccagcccatgggagtgtatagaatgacaagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatgagctgggtatactctaggacaccgagttttttcatgaagttgaaactcttgcatgctgtcagggagtttgcgacagtctaggtactttaaacaaatgcgcttactaattgtgtaatgatgtcactgagcttggcaccccatgtagggattctgtctttcctgtcccctattccctgtcccccaaccccttgcttcattaagacttgctgattcaaactcactctggttgaggttgagtgtttctctttgttccaaagggtagtggcaggcatatttaaagtaacaattgtacagaacactctttaatgatggcctcttatttgaatcatcccagacaaagaaatattgctagatcctgtaaatcttccaagaaaagattttgcggattttagacccacatgtatgttgttttgttgtgaagtatctggcttctctcaatgtaggaactttttattttatttttttttgagaggaagtctgttgcccaggctggatggagtgcagtggtgctacctcggctcactgcagcctctgcctcccgggttcaagcagttctcctgcctcagcctcccaagtagctgggactacaggcatgcgccaccacgcctggataatttttgtatttttagcagatacggggtttcaccatgttgtccaggctggtctcaaactcctgacctcaagtgatccgcccatcttggcctcccaaagtgctgggattactggcatgagccagcatggctggcctcaatgtaggaacttttgcagtagctacgtaaaaaatagattccgtatggaccttccatcatatgcagagccctcttgtcttcctttgtagattattcactgaccagcgctgacctgtcagcccttcaaggcttcaactcgccaggaatgctgtcgctgggacaggtgtcggcctggcagcagcaccacctaggacaagcagccctcagctctcttgtgtgagtaactagaagttttccctgcatctttactcctggcctacacactctcttttcctatcagtgacagccttttgctctgttgagtttcgtgtgaggaatcctgtaatgattccttttcaggtagatacaagtgtcgggagaaaatattttcttacatggctctagacagtagcttggatactgacaaactaggcattccttgaagggatttggggagcaaggcttctcccatagggacatcctgaggtagagagactcaaccaggatctgaaggggtctgaaggcacagataccacccgcatgcaccatccttctgccctctgaccagtgatgaagctgcctactgcacccctgctcccaagcacctgcctctggctgcactgcttgaaaggcagcctgtaggcattcaggcctccctgccacccttgccattgactgctttggtgagtatctgtagacaagaataggaagacaagctggagcttttgctttctccctgggccacagggaaggaaaactggggacagggtgtcttatatatcagtcaggctccataggatttgtgtgactgatcccagcccaatgcacacaccaaacctcattcacaaagagaatgttccgtatgggcagggtgtaaggatataagcaaagaggatttacagtggcgcccagatgaggccagacatccctgacagccgggagaaagaacagggcttttgtggaaccaggatgacagcagacccatggagcagttggaggagagtgtcccaagagaggggacaacatagcagacccagctggcctccatgaagactggctgccttgcctgtgctctgggcagtaggaataccccaggcccctagcctctgcccaggaagtccccagagagcctgagctcagcagtccctttccctcatccattctgaagtaactgcacagtgaggattgttgtcagtggtcttcttaggaattatgtcatggaaaaagcagcagagtatctcagggaaatttgcctacacaggatttggccctcaggcctgtcctgagcatcctaaatgaatgcactaaaaatagtcctggaaaagcaagtggaaagggctcagagcccaggcccggggaacagcctgtttgcgtcctcctctactgctctcagccagcccctcatttcctcatctggaaaatggggatggtgcgacttgcaccttagaggtgttgcgaggatgagcgatgttgtgccctgtcacagggccagagcagatggggagcagatgctgaggaagaagaggcggtgagcagatgaggctgctgttcctctgtctttctggtccctgcacagcattaagacactgacattgttttgtatactttagctgcaaaagtaccaacgttgtgggtaacagaaccaagtaacgtaagggctcaacggtactgttttctttcctcctaggaagatgggatttccttttgtgccaagcactgaaggaaacgacccaaaccagtcttggggaactctgataagatttcagactctgggcccttttccatcaggcagtgtctctactgtatcatcccagttttgcagaggtacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaaaggttgttgtaaactgtttgtctcccgcactcactccagtaa

SEQ ID NO: 381 - DNA, 114012 bp, Homo sapiens
agttttcctaaacacgcctgtgaccagctgactccactcagcgtttccgtgtgaggtatgtttcttcaccggcctttcaagattgttttttggcacgagctcaaatcaggttttcttccgtccgccgttcccgcaggtctgcgcacggatttgtccctggttcccgcaggcaatggggccgcaggggccggccgggggggtccccagcgggctctgcgcgccgacctgcagctgggacccgcgcctggaaccctcccgacgagcgcaggtgagcgcctcctgccaagtggggcggcgccacacgggcgtcctgggtgtccccctgagctccttccgcagctcaggccaacccccgccctgacccggtggagccccgggacagggtgcggaccccgttccttcgcgctccgaaccggacggacccgcaggaggaccccacgcccgctccgctccgaccccgccgtcccgcgcaggctgcggtgacccaggccggcaggtagccaggggctctctgcctgggaggacaccttcggcggctggcgtggggaaaggggccgcccggccggggatgccccgccaggaggagggagcggccggggccgcggccgggagggaggagcgccgggaggaagaggccgagccgggagagcccccgccccgggaggaaggggaggaggccgagtgtttcctggcgcattcccggccagcccgagtgactcactcggccaaggaaactcccagggcccgcccaggacccccaagccgccgcggacgcaggtgaggaaccccgctcgcccgcgcctgccctgcggcctccgcggggtccgggtccccctcggaacctgggccggccagggcggcggcggggccgggacggacccccccctcccccccaaccccggcggcgcggcctccccggcggcgcggcctccgggatcgtcctggtccccgcgtcccccaggtcccggccccgggctcccgcgcctcccgggctccaggtccccgcactccctgcactggcttcccggtccctgcgcccccggcctttcggcctcggccccgagctccccgcccccgcgttcaccgcctcgcgcccccggatcccggattccgcgccccggcacatggcacagctccagtggcgaaggaataccttagtgtttgacgtttttgttggaaagtaaggagcaggcagattgttaatgttgcactaaggtcgcgcagcaagatctgaacccgtttttgtttcgtgcccctgtgaggagcggagggagcctggtccgcggagccattccgggcattcttggagagaggagttttgggctttgttaaggaggcgcgatcgttacggaggcagcactgtttcgcacaagcatctgaattgtgtattttaaggctgaaatgcgtgagcttaatttgcagcacattgtgggtgtgacaagaagggtgcaagaataatcgggaaacggggttgatggaacgtgttttaagctgagaggggcgtctggacggtgtcagctccgctattaagtccagtcagggagcggctgctgattgagcccagcgccgcgtggtcgccgctggggactgaggctcgggagcgtttgttttctggcggcggagggcaccgtggctgcgccgggagcggtggtgtttcttgcagtcgtccgtcggactccggaatgaggcgtggtcggagccgcggtgatgcctggtgcagtgcgcacattgctatgcttgacagcttggcggcagagtcccggccaggccgggacccgcgggggccccacgcatgctgccttttccctgcgggtggccagcggttttccaagtgatgtctagatctgcaggcacggagcctggaagaacgagtcacgctgtgagtgggcgcgggccgtagcaggtgtgcactcgtagggccagtagggatatagtgccggtgccctcactgcgaccgaggcgccctggagtcgtggcggaggacgtttcctgcgttaagacaggtgtctgtgctgcgctcaaagaaaatgtaccccctaagtttgtgtgtgtgtttaaatttattttaaacttttagtaagattcactttttggtgttcagttcagtgagctgtagcaggtgcatggactgtagtgacttccaccgcagtcaggatactcaggaaggcagcctctctcctccccgctcttgcagccgcctgtctgttcctcagtcctcctgctttgcccattccagaatgtcacatgtgggcttggagtctggcttgtttcgcttagcataaggcgttggagattcagctatgctctggtttgtccctgaagagtaaagatacaagggtctgaaaagtgtggctctcggatacagcctgagagagagactaaaatgataaagtgatgagaaaaattacaaaactatagttcattaaaaacattaaacagcatagaaccgtgtatactaaaagtgaaattccctcggtacttctaagtagtataatagtcttttctgtgcataagtaattttttaaataacatagtgagatcatattgcatatattatcgtcatacatttttcacttaatgatgtttggttacttaaagatcttagcaatctttacatgttgatatatatagtctgtacacacagatttccctcaatcttttaaataaccgtatagtattccttttttttttttttttttttttttttttttgtgacagagtcttaactctgtggcccagactggagtgcagtgacgcaaactcggctcgccacaacctatgcctcctgggttcaggtggttctcccacctcagccccctgagtagctgggattacaggcacgcaccaccacacccggctaatttttgtctttttagtagagacggggttttgccatgttgcccaggctggtcttgaactcctgacctcaagtgatctgcccgcctcagcctcccaaagtgctggtattacaggcatgagccactgtgcccggccaaatcactatagtattctgtagtgtggatgtttcataattttatcagcctcctgttgattgacattatagttatttactgtttttcaccactacagtcaatgcttgtgtctgtatctttgtgcacatactcaagtttataatgctaaaggtgactttgggtttaaataatagctaacatctccctccctcctttgttttcttttcttttatgttatgttattttattttattttttgtgagacagggttttgctcttgttgcccaggctggagtgcaatggtgtgatctcggctcactgcaacttccacctcctgggttcaagcaattctcctgccccagccttccgagtagctgggattacaggcgcctgccaccacacccagctaatttttgtatttttagtagagacagggttttgccatgttggccaggctggtctcaaactcctgacctcaggtgatccacccacctcggcctcccaacgtgctgggattacaggcgtgaaccaccgcgcccacccaaaacatattttatagtgtgaagttttaactaacatgtccaagctattctcattgtttttcctattaaaatttagccaacccttagaggccattgataaagcatggattaattacactgacataatttaaaaaccttattttagccagtgcaatagtatcagacaaagaaagaaaaggcatacaaattggaaagggaaaattgtccctatttgctgacaacatgattatctacatagaaaatccagggaatctatgaaaaagctactagaactaattaatgaggttagcaaggtcacaagatacaaagtcaacacacagaaggcgaccttatttttcttttttttttttgagacagagtttcattcttgttgcccaggctagagtgcaatggtgcgatctcggcccaccgcaacctctgcctcccgggttcaagcgattctcctgcctcagcctcccgagtagctgggattacaggcatgtgccaccatgtctggctaattttgtgtttttagtagagatggggtttctccgtgttggtcaggctggtctggaactcccaacctcaggtgatccgcctgcctcggcctcccaaagtgctaggattataggcgtgagccaccgggcccggcctggcgaccttatttctgcatacagcagtgccccttatccatggggagatacatgcaaagtcaacactatacaagctgaccttatttctgtttacaacagtccttgttatccatggacgatacgttccaatggaagcctgaaacctgagataagacagaaccctccgtgtactgtggtttttttccctatacatctatgcctatgataaagcttaatttacaaattaggcgcagtaagagattaccaacaataactgttcataatatagaataattatatactgaataaaagttatataaatgtgttctctctttcaaaatatctttttgtatgcactcacctatttttggagggcagttgactgtaggcagctataactggggaaacagaaattgcagataatgaaactacaggtaagtggggactactgtactagcaatgtacaattagaaagttaaatttggctgggcgtggttgctcacgcctgtaatcccagcactttgggaggccgaggcgggcggatcacaagggcaggagttcgagaccagcctggccaacatagtgaaaccctgtctctactaaaaatacaaaaattagttgggcatggtggcgtgcgcctgtagtcccagctactcaggaggctgaagcaggagaatcgcctgaacccgggaggcggaggttgtggtgagccgagatcgcgccactgcagtccagcctgggcaacagagcgagactccgtctcaaaaaaaaaaaaagaaaattaaatttaaaaacacaacatttcgtttgcttcaaaggaatcaaatacttaggtatacattgaataagacttacaggatctgtatgctgaagatgagagaaatcaaagatcatttaagtaaatgggggaacataccatggtcagtggttggaacactcaacatagtaaagacatcagttctcttcatattgatctataaatttaacccaattccaatttaaaaatattagcatgctttaaaaacaaaaattttaaacaaaaattttgtttattgaggtataatatacctactttataaaattcacctacttttaagtatacgtttggctggcctgtgaacgagggggttagggattccaaccccctgtgcagttgaaaatccgagtgtaactttttttgagatggagtttcgctcttattgcccaggatagagtgcaatggcacgatcttggcacactgcaacctctgcctcctgggtttaagccattctcctgcctcagcctcccaagtagcttggattacaggcatgcgccaccactcccactaattttgtatttttagtagagagggggtttcactgtgttggtcaggctgatctcgacctcctgacctcaggtgatctgcccgcctctgcctctgcctcccagagtgctgggattacaggcgttagccaccgagcctggcctttaaccttttttttttttttttttttttttgagacggagtctcgctctgtctcggctcactgcaagctctgcctcccgggttcaagcgattctcctgcctcggcctcctgagtagctgagattacaggcacccgccaccatgcctggctaattttatatttttagtagagatgggatttcaccatgttggccaggctggacaagtataacttttgacttctcaaaagttaaaactacgtgacttcccaaaagttaaaactacgaatagcctgctattgaccagaaaccttactgataacataaacagttgattaacagagattttgtaagttatatgtattacatactgtgttctcataataaagtaagctagagaaaagaaaatgttgttaagaaaatcatgaggaagaggaaataaactgactactcatcacgtggaagtggatcatcagaaaggtctccatcctcaaaaagctcacagtgagcaggccaaggaggaggaagtggatgggttggttttgctgtcttgggggtggcaaaggcagaagtggagggaggtggaaggaggggctagagaggcaggcatacaccgtgtaacttttactggaaaaagtctgcaaataagtggacccgcatggttcaaacacgtgttgtttcagggacaactatacaataatttttagaagatttctggagctgtgcaacaaccatcaccataatccagtttttgtttgtttgttttgagacagggtctcactctgtcacccaggctggagtgcagtggtgtgatctcagcttactgcaacctccgcctcctgggttccagtgattctcatgcctcagcttcccaagtacctgggattacaggaggtgccaccaagcctgactaatttttttgcatttttagtagaggaaggggtttcaccgtgttggccaggctggtctcgaactcctggcctcaagtgattcatctgcctcggcctcccagtactgggattataggcatgagccatcgtgtccggcctgtttttgtttttttaattttaattattttttaaatggagatggggtatcactatgttgcccaggctggtcttgaacttctgggctggagcaatcctcctttcctcctgaaagtgctaggattacagatgtgagccaccaggcccggccttgctcatctgttgatggacagttaggttgattccatgtcttggctgttgtgaaaggtgctgcaataaacatggggtacagcgatctcttggacatacggatttcatttcttttagatatatacccaacagtggtgttgctgggtcatatggtagttctatttttaatattttgaggaacccccggcactgttttctacaatggctatactgatttacatctccaccaacagtgtacaagggtttccctttctccacaccctggacaacacttgttatcttttgcctttttgacaagagccagtctgacaggtgtgaggtgatagctcattgtggttttgatttggattccctgatgattagcgatgttgagcattttttcatacacctgttggccacttgtacaccttcttttgagaaatatccattcagatcttttacaattgagttgtttgaattctttgtatattttcattattaatcccttattagttatatggtttgcagatattttcctgcattctgtagattgtcactttgttgattgattcctttgctgtgcagaacatttttagtttgatgtaatcccatttgtctattttttcttttgtggcctttgcttttgaggctttatttcctcaaaataagccaggcacagaaagacaagtactgcacgatctcactcacatgtggaatctgaaaacgctgatgccacagaagaacagagcagaatggtggttaccagaggctggggtggctggcggaaggggagagaggaagatgttggtcaaaggatacacatttacagttagatacaagggggaaagtccagaataggcaaatatacagagacagagagtagacaggtgattgcctggggccagaaagcaggggagagaggatcagtgaagaacgggtagaaaaagtgagaataactgctaatggttagggagtttcttctcccttttttttttttttttttttttttgacaaggtctcgttctgtcacccaggctggaatgcagtggggcaatcatggcttactgcagccttgcccttttgggcttaagcaattctcccacctcagcctctccagtacctggcactacaggtgtgcaccatcatgcctggctaaattttggttggttgttgttttgtttttttgagacggagtctcactctgtcgcccaggttggagagcagtggcgcgatcttggctcactgcaacctctgtctcccaggttcaaacgattctcctgtctcagcctcctgagtagctgggattacaggtgtgcaccaccatgcccggctaatttttgtatttttagtggaggcagggtttcaccatgttggccaggctagtctcaaactccttacctcaagtgatcctcctgcctcagcctcccaaagtgttgggattacaggtgtgagccaccgcctaatttttgtgtttttttgtagaaataaggtttcaccatgttgctcagactggtctcaaactcctgagctcaggtgatccccctgcctgggcttcgcagggattataggctaagccaccgcacctggccacatttaagtctttaattcatttcgggttgatttttgtctatgttgagaagccaaggtctgatattatttttctgtatgtgtgtatctagttttctcaacaccgtttattgaagaacctatccttttctcattgtgtgttcttggcacctttgttaaaaatcagttggctgcaaatgcatgcatttatttccaggctctattctgttccattggtttatgtgtctgtgtttatgacaatagtgtgctgtttgggttactatatctctgtagttttttttgttttgttttgtttttgagacggagtctcactctgtcacccaggctggagtgcaatggcgcaatcttggatcactgcaacctccgcctcccgggttcaagcgattctcctgcctcagcctcctgagtagctggggattacaggcgtgcgccaccacacccagctaatttttttgtttttagcagagacggtgtttcaccatgttggccaggctggtctcgaactcctgccctcaggtgatccgcccacctcagcctcccaaagtgctgggattacaggcgggagccaccatgcccagcctctgtagtatattctgaagtcaggtagtgtgatgcctccagccttgttcttttgctcaggatagcttttgctattccaagtcttttgtggttccacacaaattttaggatttctttttctatttgcatgaagaatatggtaggtattttgatagagactgcattgaatctgtagattgcattgaatctgtagattgctttgaatctgtagattgcattgaacctgtagattgcattgaatttgtagattgctttgggtactatctattgtttatttattttttgagatgagttacctaggctgttacccaggctggagttcagtggtgcagtcatggctcactgcagctttgatatcctgggctcaagcgatcctcccacttcagcctcctgagtgtctgggactacaggtgtgagccaccacgtgcagctactttttattttatttcttttctttttcttttttctttttttttttgagacagagttttggtcttgttgctcaggctagagtgcaatggcgcaatcttggctcaccgcaacctctgcctcccgtgttcaagcagttctcctgcctcagcctcaagctactcaagctgggattacaggcgcccactaccacgcctggctaattttgtatttttagcagagatagggtttctgcatggtggtcaggctggtctggaactcctgacctcaagcgatctgcctgccttggcctcccaaagtgctgggattacaggcatgagccatcacgcccagccttattttattttttagtagagacaaggtctagctgtgttgcccaggctagtcttgaactcttgagctcaagtgatcctcccacctcatcctcacaaagtgttgggattacagatgtgagcaacagcacctggtctattaattctgttgttgccagtgtttttggtgtcatatccaagaaatcattgccaaatctgatgtcatgaagcatttctcctgttttcttctaagagttttatagttttagatccgatgtttaggcgttgatctgttttgaattaacttttcttttttgtgtgtgtgtttggttttttttcgagacagatccttgctctgtcgcccaggctggagtgcggtggcgcaatctcggctcactgcaagctccgcctcccgggttcaagcgattctcctgcctcagcctctctaggagctgggattacaggcccccgccaccacacccagctaattttttgtatttttagtagagacgggatttcaccgtgttagccaggatggtctcgatctcttgaccttgtgatctgcccgactcggcctcccaaagtgctgggattacaggagtgagccaccacgccaggccaaattaacttttctgtatattatataaggtaatggtccaacataattcatgtatgtgtggatattcagttttcctaacacaatttgttgaaaagactattctttttccattgaatgatcttgacatcattgttgaaaattgtttggccacatatgtgaaggtttatgtctgggttctttgttctgtttaattggccagtatgcctttctttatgccagtgccacactgtttcaattactgtagctttatggtaagttttgaaataaaaaggagtgaagtctccaactttgttcatctttttcaagattgctttggctattctgggtccttggagattcctatgaattttaaaatgggttatttttgcaaaaacaaagtgctgttggaattttcaaagggattgcattgagtctttagaaggctttggattgtattgtcatcttaacaatattatgtcttccaatccattaacaaagatgtctttccatttgtttgtatttaatttctttcagcagtgttttatattttttagtgtgtaagtctttcacctccttgattatatttttttaaattgaaacttgtatttagccattttgagactaatatcttgaataagtaaaattcatttacactacattcttcatcttttggatgctgttgtacatggaattaatttccttttgggattgttcattgctaaaatatagaaatgcaactgatttttacatgttgcttttgtatcctgcaacttccctgaattcgtttattagctctaactaataattattatggaatctttgggatttactacatataaaatcatgtcatccagagtttcatgtgttatgaggcacagagggactacctttttatcataatgtttgtagtaatttttgtccgcaggtctgttttgtctaatacttgtctaatgttagtattgccacttccctctcttttggttactctttgcatggtatgtccttttgcgttcttttagtttcaccgtacttgtatttttatatttaaaatttgtttctagtggatagcatatagttggttcatgttttctgtttactctgtaaatctctgccttttgatttgagtatcttgttcatttacatttaatgcaaatatgtatgtagtgggatttacatctgtcattttgttatttgttctctttatgtcttatatccagagagctgatggccacagcagctccggcctgatttctaataggagggttatctaatagaaggatttcagagcattccagggacaagatttgcatttgtatgaatttttttgtgttaaaagcctcttagaacatggtctcaagaaattagggatgtgtttttcaccatcgtgttggtttaagcctgatgtgcatctgtgctattcagcacaagctcactgggcatttgttttcctggtcgctccccctccaactttattacgactgcatttccttcacgcacagcccatgccgtgggctgtggcttggccctccatgggggcagaggtgatgtctgttgaactgtggctcccaggttttttagatgggaataagacagatgtacagtgatagccgctgtgaccttgtcatgccctgttctttgctttccccttcacattcacatttgcatcacaggggagggggaaaaaagcccaaaacactctgaaagcagtgggtttcatcttgaaacctgattccatagccaaaatttgatgctcagagcctgtgtggtcactccttgcagtcatgttttcctggccaggacagtggggatgagtgttgatttgtccttgaagatactcacagaaggagatgtgcttgctctgaagaaccacatagccccacagctgaagtggtgaagttctgcattacatttgaatccctgtccaaagctcaacttctcaagctgttcctagaaggaccagtctccacgaaaccagtgagccttaacaccacctggactcatggctcagtggggccagctgcccccagagatcattgaataactgtatgtgttaaattgagtagacttgtgcatatgaacaaaaacttcactgactcttgagaggtagccttgttcctgtcaaggagaccacagggataaggttttcatatgcacaagttgtgttttcttgtttgtcgtgatgacagggtgtggaggtggtagaggtgatgtattagtcagggttctccagagaaacagaagcagcaggatacgtgtggatgtgcgtctagagagatttattttaaggatctgactcacaattgtagaggctggcaagtccagcgtttgcaaggcaggcccataggctaaagacccggggaaaagctgatgttgaaggcagcctgaaggcaagattccctctttcttaggagaggtcagtcttttttctttcaaggcctgcactggttggatgaggcccacccaaattatggagggtaatttgtttcattcagagtctactggtatagatgttaatctcatctaaaaagtactttcatagcaatgtttagattggagttggaccaaaaactgggtaccatggcctggccaagttgacacataaaagcaaccatcacagggattgatttttattttgtatttaaataatttgcgttttatttttatttatttatttattttttgagatggagtctcgctgtgtcgcccaagctggagtgcagtggcgctatcttggctcactgcaacctccacctccctggttcaagcgattctcctgcctcagcctcttgagtagctgggattacaggcgtgtgccaccacgcctggctaatttttgtgtttttagtagagacggggtttcaccatattggtcaggctgttctcaaactcctgacctcaagtgatctgcctgtgtcagcctcccagagtgctgacttcttttctttttgagatggggtctcactgtgtagcccaggctggtcatgaactcctgggctcaagtgatcctcccacctcaacctcccaaagtgctgggattacaggagccaccatgcccggccttcttgtatttcagtcacacatttcaggctgacctcactggtcacatggaattgactgtgacctgtgatgggcacctgagaagcctctggagctcttggttgccctgattctatcccaggcccaggtggagggcagatgtgctgtgttgtagctgcgggctgtggtggggtgctatgttgtagctgcgggctgtggtggggccgggccctggaagtgtgtgtgaagacacaggccggcacatgtcttcccacacactgtgagcaggaaaggttcaggtgccccgagttcttcctcttcacatatgtcggccgcactcctgtagacttagccaagactacatggtggaaagtgcgattggaactctgtgcttcaggaactttgtgatttcatttagtgagatctgggagcgtgctctgaagtcacctgtcctgagcccctcagccagcagggcttagtcgggccccgtccaggccattgtcacttttgaggaagactctccaagatttataaacaggtggtgggtgacctgcccattgtagtccataacctgttgctgccagcagctcctgggaaggggcgataggagagcactgcctccttgtcccgtgtcccaaccgatgctagagccagtgcttcaggtattcaggtacctcaggttgcttggaaaagtttaaataaattatgcttacttattaagtattctcttttcatcttttatcagctttttttattggctcccctgcagaaaaaaaaaaaggcagaggtgattttgggaactgcggcgtcccctcggcatctctgaacatgcgccaccgtctgtgtgttcatcaacgtaaagctgtctgttctggctgttgctgtctcatacagtgtgtgcaccagatgctagcgagtcttacacagatgctgtcgagatgtaggaggcagcgttgctgtgtctgctgctcatcgtggggtctttccacatgctgccaagcgggttccctttctccacaaacttggagcgagggtctcggtgggctgtcatgggtgcagactcttagttgagaaatcttcaggatggcattgcctttctgcagcctgttgttggccacaactcaggtccttcttcatccccggcaggaacaaacccctcctaagcttttgtgtatttatctgctaaggctgccaaaacacagtaccagcgactgggtggcctcaccacagacatagtatttgctcacagttctggaggctggacatccaagatcacagtgtgggcaggttggttccctctgtggcctgtctccttggcttgcagatggccgtcctctccctgcgtccttgcgtggtcttctctctgtgtgcatctgtgtcctaatcttgtcttttttttttttttttgagacggagttttgcttttgttgcccaggctggagtgcagtggcgtgatctgggcccaccgcaacctctgcctcccgggttcgagcgattctcctgcctcagccttctgagtagctgggatttcagtgtgtagctgggattacaggcccacgccaccacgcctggctaattttgtatttttttttttagtagagacggggtttctccatgttggtcaggctggtctcgaactcctgacctcaggtgatccacccgcctcggcctcccaaagtgttgggattacaggtgtgatccactgcacccgacctaatctccttgtcttataaggacccagtcctattggatgagggcccaccctgatggattcattttaacttaattatctctgtaaagaacggaagcattctgaggtcctgggggttaaggcttcaacacacgaattttgagagcacacagttcagcccataacagtttgttttgttaaaacgtgggctcttcattatcgcctttgatcccctgggccaagcccttgttgatggggcgcccctgaactctcagagccatggactcctgctgctctggggacaccagggcagcgggaaggggctggggcctggtgtgtccgctactagggaagcctaattcgttatccctgttagataaaaatacaggtgctctagtatttgcttctgtcattccaaggaatcacagtcatgcatcacttaccaacagggatatgttctgagaaatgcattgttaggcacttttgtcattgtgtgggcatcataaagggcacttacacacacccagatggtactgcctgctgcacgcctaggctccacgctagagcctgttgctcccaggccacacgcctgtgcagtgtgttactgcagtgaacactgtggttaagagtatttgtgtatccaagtttacgtaaacatagaaatggtacagtgacaccatctcagctcaccacaacctctgccttccaggttcaagcaattctcctgcctcagcctcccaagtagctgggattacaggcgtacgccaccacacctggctaatttttgtatttttagtagagacgaggtttcaccacgttggctgggctggtctcgaactcctgacctcaggtgatccgcctgccttggcctctcaaagtgttgggactataggcgtgagccaccacacccagacagtaatttaggatgtttttaagtaattttaagtttagagtatttttacgtaaaatctagcactttttggttacctgtatgttgatatgtttattaatatatgtgtacacacacacacacacacacacacacacacacacaatggaatactattcagcctttaaaaagaaggaaatcctgtcatttgtgacaaggataaacctggaagacattacgcttagtaaaataagccaggcccagaaagacagatactgcatgacctgatttctatgtggaatctagaaaatttgagctcatagaagcagagagtagaatgagggtcgctgcaaataacccatctgggcaggcagacggggctggggttggcatccatctcctgccgtttctcggctctgtgaatttggacaaatcactttctctggccctcaatttcgccgtctctaaagaaggggttgaatgagctcagacagcccaaggcttcacgaagtgcaagcggctgagatgtgctggtgttgaaggtgattgaggacagggtggggtccctttttcccagagggaacatggagccctgtgtctcaggtgcccgtggcatcttcgccggctgcacttggttcccgactccccggggagctgccgggcaggggaaactgccctgctggcctggggcaccgtggccgaggtcagccaaaggccaagacctgccttcttgctggggctggaggctgcttcctgccttccaggctgcggagtctgctggcagggctgccgggtgtgtgtgtgtgtgtgtgtgtgtgtgtgtgtgtgtgtgtgtgtgtgtgtgtgtgagtgatgaggttgcggagtctgctggtggggccgccagttgtgtgtgtgtgtgtgtgtgtgtgtgtgtgtgtgtgtgtggtgaggaggagtggactcactctgcatgggggtggggtagggttcacatattttaagctcatcatctggctgggaaagtagctgctcttgctccagaaagggaaaaaaaaaaaaaaagtatgtgaagtgatacatatgcgtaatagctcgatttaaccattccacaaggtacacatatatgtaaacctctgattgtatgcagtaaatatatacaatttttatttgtcaacaataccttaatttatataaaaacatgtgaatccatagtttctgtctcataataaattagtttggcccatccacaaaaaacaaaacccagctcttttgcaatgatctgaagcattctgattataacactgatgtttattcccggggctgactgggcctggaaggtcctttctacaagccgtcctcatgaaggcatggtgtccaggcatctctcacaactgggggttaaaagctttctgcccaggagtgcgtgactctgggcaaaaccttcctctaggcagacgcgggcatgttgtggccgtgctctggctggtgagatgggttcagcctgcgatacgtgccagcgtccagcctgcccggggccataggagtgaggggcgaccaaaacacacttccgcttgaagagtcggggcaagtctgtttgagacatttcccattcctttcccttatgttcacaaaaagttttcagggggatatttcattctttcttatgttatgttatgttatgttatgttatgttatgttatgttatgttatgttatgttatgttatttttgaaacagagttttgctcttgttgcccaggctggagtgcaatggcacagtcttggctcactgcaacctccacctcctggattgaagcgattctcctgcctcagcctcttgagtagctgggactacaggcatctgccaccacgcccatctaattctgtatttttagtagggacggggtttctccatattggtcaggctgacctcaggtgatcgcccgcctctgcctcccaaagtgctgagattacaggtgtgagccaccgcgtctggcctttcttactcattttaaataacttcaaacttatacaaaacattgcaaaaataaaaataggacaaagaacacaattcaaacacttctctctccacttgaggccctttacctctagacacatcagtgtctatttcctaagaatgaggatgttctcttgtgtgccacaggacacttgtccactactggccctgtttagaaaatgcttgccgagccctgtgctggagcatgtgttgcccaggtattcatgtgtaagaatgttcctcagaggtcatgacagccaagtgtctgcaaatggcattggttctgagcagcaggagacaggacatgtagcctggtttgttggttgggtggaatagcacgcacacgtcaacatggtgcttcaggagcaccgcctggcagcgtgcatgcgtctcgtaatagcagtgggcacagtatgaataggtcaggtgactatatatagatgatatcccttttataacaactcaactgaaaggtgctttttaagaatatagatgagctatggccgggcgtggtggctcacgtctgtaatctcagcactttgggaggccgaggctggtggatcacctgaggtcgggagttcgagaccagcttgaccaacatggagaaatcctgtctctactaaaaaaaaataacaaaatttagccgggcatggtggcgcacacctgtaatcccagctactcgggaggcttaggcacgagaatagcttgaaccagggaggcggaggtggtggtgagctgagattgtaccattgtattccagcgtgggcaacaagagcaaaactccgtctcaagaaaaaaaaaaagaaaaaaaagaagaatatagatgagatacagtttatgcagaagaaagcaggggatcgatgcctgggggtgcagagcaggggctcactgtggatcacaagcaggactctgcctttcggtgtgggcagtgagttcgcacgtctttgacatcattaaacattactaattatggtgagagcaggtcagagtccaagaattattatgtatctgagtcccagttttaaaaatcctactaccaatcagtttgctgaaatttttattgatctcaagattacttttaaatgaattatctgagattacctatagtagtgctgccttgacactgtttctcacctgagcagctgtttggcttcccatagtggccacagcaatttgcagaaactggggctatgattagaaactgcttccttccctgggcctgggctggcagacttcttcctccttggtaaatttagaagtgaaacaggaaattccaaagggaaaagctaatatgataaaaagttaaaacttagtttcaaagaaaatagtaagtgaaatgaaaaagaaagtagcttgacctggaaaaagttttgtagcaattctcacaaagctttaatatctttaacgttgttagtatagtaagtccatctgtcagttgctgaggaaaataccaagattccaaggattttaaaaaaacaaacaggcaaacaacccaagctggcaagttacaaatgaagaaaaacaggcagggggaagtggctcgttcctgtaatttcagcatctttgggaggctgaggctggaggatctcttgagcttaggagttcaagaccagcctgtgcaacaaggcaagactctgtctctacaaaaaatcaaaaaaattagccagacgtggtggtgcacacctgtagtcccagctacctggggggctgaggtgggaggatcacttgagcctgagaagttgaggctgcagtaagctgttatcacaccactgcacttcagcctggttgacagtgagaccctgtctcaaaaaagaagaaaaacaaactggttaatgcatagaaatatgtttcatctcagtgataatacaagaaatgaaaattaaggccaggcacagtggctcatgcctgcaatctcagcgctttggaaggccaaagccggcggatcacttgaggtcaggagttcgagaccagcctggccaacatggtgaaaccccgtctctactaaaaatacaaacattagcccggcatggtggcgagcccctgtaatcccagcttctcgggaggctgaggcaggagaatcacttgaagacaggaggcggaggttgcagtgagtcgagatcatgccacttgcactccagcctgggtgacagtgagactccatcttaaaaataaataaaatataaataaataaataaataaataaatgaaatacaaattaaaagaacattcagattaaattataaaaacagaagtgacccctggattctgttgggaagcgccatgctactgtccggctccaccttgttcgtgggcccccgtaggagggcacctggcccaaagccacctgcagctttagagacattgtgtgacctaagaaacctcctgggatgtgctgctaggaaagtcatctgcaaacacactccaggcttttccgcccagatgtggtattgtcaggcttgtctcatgcctaagcaggaggagggcgggccgccctgaagcaggctgcggttcatgcatgggccagtggtgtttccttcacatgttctggatgtgcaggtgttgctgtaatggtggaaaagatttatatgacctcagtgaaagagctgctttctgcttttgttcctttgatggacagctaaatggcctggatacctttcccacagttttcgtgaagacccggagctttaagatcaggattctggtttacctgagaagctccccgttaggtccctgctcggttcacagtcactggggatgttctgtggcaccgcctgcttatggagctcctgtctctgcaggacgtctccggcaaggtgcctgggacatcccagagcacgagcccgctgaaatggggcacccgaaggcacagaccaccccactgcgtgggacctgtgaggtgtcttggtgcatgtggaggaagctggtgaggttgatgctggtgtttccagcccaagtgtcttgacagcaggacccttgatagagattggcgagtgaggtgtagtgtaggtggtagctaaggtcatgggcttgacctcaggctggaggcagtaggggatcccaggagacactctgcccacgggctgggcacagtggtggagcccgggagacactcggcccacaggccaggcgcagtaggggagcctgcagctcctcgtgggtgcacttggtgcaggagaagggctgggctgctactgggctatgccagaccctggcagggccaggccacatccaggccagccacgtggggattcggggattcaggtccttacaggggagggagagacaggaaaagaacaggcacatcaggaggtgtggatgctgggtgaagatgatctggtggctgccgtgtagcctttggtcatcaacctgcaccctcctgggccctgagaggagaacctgagaggctggtggggagggggagcacggggctcgatcgcccgtggcgcctgttcctcagccgggcgccgcaggacccagcagatacacggtctgttgggcacagtgataaggtgggggacaaggtgggtggcagccagttccctttccttcaagccgcaggaatcagagcaggctgagagcccccagccagaatggccagcggtggaattgctttgtcaagcgcccgaggtcatgcttggtgcccagccgagcccatggcctcctgagcaggcgggactgcccggccatgcgggccacgccactgaggcacgtgaggcaagccacggggctgcggcagctccctgtccctctgggctcagtgtcggcatctgtgaatggggacccccactcttctcctgagcgtgggagcgccccctctgtggtgtgactgtcctcccggagaccgccatggtgggtctgccctaacagaaagagtaggtggagcgggaaacgctgtcttcttccctttgtgccttttaaacatgcactggattcgggtgaaagatgaaggaatggccgtcgtcgaggagcactccttaattgtttatgctgtctgtgtgttgcccaggtgcacacaggtgggaaagaaacagcccctcccaccagcctgatccctacccaacccaggcatctgccaggtgggctgatggagcttccccgagctcatctgtgtgcctggtagcccagccctgggctgaggtgcatgttctcattgtcctgagggccccacctggggcagtgggactggtggatggcacagcgggtcctccatggcccaggggtgtgggagatggagggaggcccttgggtgttctatgagcgattgagactttattctgtggaatactgggccccatctctgccttttattaattattttagcatccgaatagtttttttcatacaaatttgacagataaagacagaactgctctcccttgccctcctggggcactctggggtttcatggcgcatggtttgaaaaccacagctgtaggcagagagagccagtgaaagcgtgagcaggagagtgacaggaagagaagcagaggtgagtgcaggtttggcggtgcctgggggatcagagggaagcctgggggagggcgatgttaggaggttgtgagaccacttggtcttgggagacccctcccagaggcagcctgaccctggccgaaggggctgcagccccaaggtggggggcggaggccatgtggcgtggagacgtgctctctttcagggttccttggcacactgttttagatgtcagcacctcattgtgattttcaaacttgatttctgtttctctgttgatgaggctgttcttttgagctggttttgagtggccgcttttgaggatggaatttgaagtttttgtgcattaaagaaagcagattacctcacacctgtaatcccagcacttggagaggccgaggcaggcagatcacctgaggtcaggagttcaaaaccagcctgaccaacatggtgaaaccccgtctctattagaaatacaaaaattagccaggtgtggtggcgggtgcctgtaatcccagctacttgagaggctgaggcaggaaaattgcttgaacctgggaggcagaggttgcagtgagccgagattgcgccagcccgggtgacaagaacgagactccatttcaaaaaaaaaaaaaaagcaaattacttcagtaataaagctagtctagaagatgttatattggtttttaactatgcactgtttgccttgctggtcatgacagcctgtttctgtgctgcagccgtgcggtcaggccgtttaacctggggaaaaccagctgcagccatgctggcgcggtcccctgcttccaaatacagaagagcacattctttctacacctgggagagaaagggacagcaaagtatgcttttcttcttcagatgatttattttatgcctattttacatgaacagcttgcacaaaaatattggaagtttctacttttctgggaagtgccatcattttgcatatagaagaggaagaaaatcagctcatgccttgtgcacgtttgcagaaacatttcatagtttgtctttgtttgattatgctgtttagctggacaagtggaatgcttacaagttgtaacattttttgttttttgagatggagtcttgctctgtcgcccaggctggagtgcagtgacacgatctcggctcactgcaagctccgcctcctgggttcacgccattctcctgcctcagcctccctagtagctggcactacaggcgcccgccaccatgcctggctaattttttgtatttttagtagaggtggggtttcaccgtgttagctaggatggtcttgatctcctgacctcgtgatccacctgcctcggcctcccaaagtgctgggattacaggtgtgagccactgcgcccggccaattttttgtatttttagtagagatgaggtttcaccgtgttagccaggattgtctagatctcctgacctcgtgatccgcctgcctcggcctcccagagtgctgggattacaggcgtgagccaccgtgcccggccacaagttgtaaaatttttaaatgactggtttagaaatgctgggaagaccctctttctagcaaagcatctctccacctgtctcagtgcgggctgcagtggcgggagttagcgtcggcgtgccgcctgccacagcactgccgcctgcgtggcaccgacgccttcgcttctgcattttctggattgtggcttctccacattttgcaaccttggtgttgagctgtcttggcagtttctattttaacacctaaagagatgactgttcggtccctgtgaaaagctccctcttgacctagggtggaaagagaagtaaatacatctcaaaagtttatcctctaatgtggtaaaatacaaggtccctccgtggccaggggctggctggagcgggcagtgcacgttgtccctgtgtgtgcagccaccattctgctgtgtgctcgctggcatcttgggagcctgggcccggccagagtggccgcatgcacactgctgtctcggggcggcagtggggccgtggggccatctggatggtgtggccacccgttccccctttaccagcccccacccttcctggccacctgccccgagcctcccctgagatgccccgtctccagagcccctgacttgtttgactcctttgttttgtctggtgtccaaggccggtttcccacggggcctgtgttctcccagggatgctggcttattgaagacacacacactcacacacatacacactcacacatacaaactttttttttccttttcccttttaatctcttggcaccacctctgcttccaggttaaagttagtcttggctgctttaatttccatttgtttttgcagcctagtagtgtcttttttcattttcaagactgttgagttatgccaggactcagggttatgacctactgactgagctgcctgctgagcacgagagacatctctttcttcccagccacctgccctcatgctgctcagacacagggaaaaggaccaaatcatatttatttattttttttgagacagagtctcactctgtcgcccaggctggagtgcagtggcgcgatctcagctcactacaacctccgcctcctgggttcaagtgattctcatgcctcagtttcccaagtagctgggattacaggcacctaccaccatgcccagctgatttttgtatttttagtagaggaagtatttcgccatgttagccaggctggtctcaaactcctgacctcaagcctcggtctcccaaagtgctgggattagagaagtgagccactgtgcccagccccaaatcacatttaaaaaaaattctgttgattcactgttctttgttttgaagcatgtgatgattgtgaggttttacaaaaatcaccctcccatctcctgggatgtctgctgtgtggagaagtgaggtccagggtctctctgggaactgggttccccaagggcagcatggggaggcactggctgatgccctgagcccgtgagcttgcagggggagtgtggcgagggctggccacatctagatgggttaaagaccaggagcctgggcggatctgcccgttttctagttggtggaagcactggtgcatgcctcctttgcctttgccccttggcctgctgtctccaactttctccagcatcttcagggctctgctggggccagcagggtccttgaccctgctcccctgcctccccagcccctgctgcctgcccacgccggggcaactctgtctgtggctccagctccatgctgcctctgtcctgcccctcaggcctaaatcggtctccagcacctcactcgcacttggaaagtggccatctgtacctctgtgcctctggccttgaccccctgggtgggcacccggcactgggtcagggcggttctcaaccttgctctgtggctgtgggccctggggcagctggcgaccccatccagcctccctccactcatttgccaatgtgtcagggtggcctccaccttaaggcagctgtgaggaccacttcttgagactgcatctgtgtggatctgaggctgaggggcagccagtgacatgtggaagaaaggaggtggacccatggagcccccagcatgccctgtaggcactgcccttcaagtgggtggcactgggaacctttgcctcctgcccaccgtgggtcccttgaagcccatctggggttccacgatccagcaggtgagtgaggtgtgcagcatgatgtgagctcagacacggagccagtctgccaccgcccggtggatgttgctcactctgtaaactgccctgcagctgcctagagcagaggtgcatcccgacccatgagacactcagagattgacccgggactctgaggacatcactggaagagcagccaagtatgatgatgtcctcctttgaaatctttatttttaaaaactcttaaatttacaaaataaacgaactgatggcttattaaaacagcagttcccctaccatatttaaattcatttttatatcttgacaagctataggatttggaatcaaacatgagggttgagaactgctgctgatagaaaatcagtcagggaaggaaaaaacatctctttatgttgttcaatgacataaaccgagggtgggcatgttatttttgggtcggttcgccgcctggggaggccgggggcacaggcagctggaactgtggcatggtagcgccttgtgaccgagctcatgcaggtctggctggcttgttttgttcccagcagtgtgctctttctgcatggagcacgtattattttcatgatcagcaaaataccagctcgtgtgggttcttacctggcagacagcgcagggaatctgcgtcccacctgggtgactccgtcctacctgttcttggctctgtgttcatttgccagggctaccattaacaaaacaccacagatcaggcaggaatttctttctctcagttctggagctgggagtctgagatcagggggccagcagggttggcctctcttgtgaatggccaccttctctctgtgtcctctcgtggtcttccctctgtgcctggtcacgcattgccctgctctgatcaggccccaagcagtggacatcaatgtacctgtccacacgagctgaaggagcagagacagaaatgcgatcctattgtttttgtttttgtttttgtttttttgagacagtcttcgctctgtcacccaggctggagtgcagtggcgcgatcttggctcactgcaagctccgcctcccgggttcacgccattttcctgcctcagcctcccgagtagctgggactacaggcgcccgccaccacgcctggctaatttttttgtatttttaatagagacggagtttcactgtattagccaggatggtctcgatctcctgacttcgtgatccacccgcctcggcctcccaaagtgctgggattacaggcgtgagccactgcaccaggccctgatcctattgttaaactctaaagtgctggctagtagcaccggcagaacagtttgtatgccgttccaaatacgtgactttaattatgctgttggatatttgcactgtggcagccacttataaaggctggtcagatacaactgaggctccattccaagggcagtggacactggctttgcagtgaccaggccagacctggtgctgctgcctgggaatgggggcttcttagacacagaaggagactagaggctgtgctggatgctggtgctgggggaaaatccctgtgggacgtggcattcatgggaggacaaaaggagggccggaaaaaatcccagggtgcaggcggctggagtcacgcattgcctttgttctctagcagtggggtgcagggtccgctggtggcagttagagacggagcaaagtaaatgcacttgaaagagctttgggaggtggaactgtgaggagtcagagaacaagatgggatgagacatgagctctgatgtgcctgtgtggagtggacaccgccagggcccccacgctggctctgtaggtggcacccaggccagaccctgcacccacgctgccagggctgagaccttggagacttggatttagagctgattactccaagtccgcctaacagggtgaggcagaagctgtgcagattcgcatctatggaagatgcacggacggagagcccttggaagcgggccgggcccaggccgtgtgcgtgcggtgacagctgcttggcatcacacaccaaggcggatgtgggagggctgcctatgatcatgaaaaacctgaaatatgaaaatgtgaagaataggagagaacagcagtttgccacagcagggccctggccagcactccgcacggtgctctgatgacttgagaaattttgtggaagctgggagaaagaaagagcttacaaagcagtttgtatgacagtatcttgtttttgtaagggacagtgggatgattgatgataggttttctttttccttttccatgttttctgattaatcagcatcaaacattgctatttttgattgtagtaaaatatgcatgcataacataaactttacccccatgtttaccttttttttttttttttgagatggagtctcacctcactctgtcgctggggttggagtgcagtggtgcgatctcagctcactgcaacctccgcctcctgggttcaagtgattctcctgcctcagcctcctgagtagctgggattacaggcacctgtcactatgcccagctaattttttgtatttttagtagagatggcgtttcaccatattgtccaggctggtctcgaactcctgacctcgtgattcgcccgcctcggcctcctgaagtgccaggattataggctggagccaccgcgtcctcccccatcttcaccattttaagtgtacagctcagtggcgttaagtacatttcaccttattctgcaaccaccaccactgtccagctagagcgtttcatctttccaagccgaaactctgtatccactaaacaccaactccccagcccagcacgcagcccctgtcaccactgttctcctttctgtctctgagtttgaccactttaggtaatttatatgagtggaatcatgcggcgttttttcttttgtgactggcgtatttcacttagcctaaggtcgttaaggttcaaccatgttgtaacttgtcagaatttcctttcttttaaggctaacattccactgaccacataaatactgttatttttatacaaagaaagaagtctgcaagcactggcttggaacaagctgcgcatctggcgtttttccatgggttcaacaagctgcgttatctggtgtttttccgtgggttcaacaagctgcgcatctggcgtttttccgtgggttcgacatcagtggtccctgctgtggatcacagctgacgcacgagcagttctcccccgagcctgtctgtggcgcccctccccaccttcctccaccatggggtcatcttggcctctcctgggcagaggccggggaggaaggcgagtccctgtgggtgctgcgcggggtcaggggctgttgccatgtgggatctgtggcttcccagggtgctcggtccgacctgtcttcttgttgacccgcgtggggcccgggcatgactggacacgcccccaggcctctcctggcactatctgggttcaggccgcagaaagggcagactgcgggactctgggctggagtcgcaggacacgggcagcccctatggggccgaagcacgtcctcaggcagcctggcccctccgagcggcatcaccctgaggtgcctgcgtggacaccaagggcaggccccccatgctggctctgcaggcagcgctggggctggaccctgcacccacccggccggggctgccctgcactgctcctttctgaggtgtgtggaacaggaagctgtgatgtggagggaagtggacgagagtttctgctacatgtagatttctagtgaggaacatgcagcagtgaccggctgcggtcgggggcgttcccttacgtgtcggggaggtccaggtggctggcggtgcggccggtgcctctgttctccctcatttccagtcagttcctgagaaaatgggtggcgtctccagccgccattggggattggcctgcaattgtttccatgtatctgtggaaccggcccaacaccccgcgtggatgcctgagcctggagactgtactgaaccctgcgtagtctatgtttttccgtacttgcataccagtgacgaactttaattggtaaattaggcacggtaagagattacaataataatagaacagttgtaacaatatactgtcataaaagttatgtgaacgtggtctctctctctctctcttgccctttggtgcccgccgtgagatggcggtgagatgggcggcgcaggcattgcaatgcagccttaggccgctgctgaccttgaccagcctggccataccgctgcagtcccatgctggcgacccagccggctactgtgtggctcacaggcgggtcgcacatacagcttggacacgctggacaaggggatggtttgtgtcctgggtgggaggagcaggacggtctgagagtttatcatcctactcagaacagcgcacagtttaaaacttacggagtgtttgtgaatggagttttccgtttaatatttttggagtgcagttgacctctggtcattgaaatcgtggaaagtgaaactgagattcgggggtggctatggcatttcttcttccagctctgtcagcttttgcctagtgtaacgtgaaggaagctttttggccgggtgcattcacattgagggttgttctggctccttggggagctgaccccttccttctctctctctgatgagttccttgctcggaggctggctgggtctggtgctgacaaagccaccccagcttccttttggccagcgcttgcctggttcacctttttccccttttgctttcgacttacctacctgtatcagtatatttgaagtaagtttcttgtagatggcatatggttgggttaggattttatttatctgttctgacaacctcttctaattggtgtttttagattattatgatagtgtaattatcaatgtgtttcgattcaggtctaccattttattatctgacttctgttagatcactatctttatcattgctctatttccttttaggtttttaaaaacatagtattctgttttaatttattctaaattatatgttatctattttgctttggatagcttttttaaaaagtatgttaatttttctttttttaaaagaggcaggatttcactgtgttgcccagacaggccttgaactcctggactcaagtgatcctcccttctcagcctcccaagtagctgggactgcagcgcctggctgtacagctttcttcggtggttgctctaaggatttcgaagtccatgcttattaacatttcatattctgctgaggatctgaaaagtctgctttttactacttctagtgggacatagaaatcttaccccatccaggtttcccctcccccttttagattacagttgtcttgtttatatgatttatacaattatatacctagaaatattttataatttacttgttatgtatttgtgtaatttacatttatgtacactgaaaggcccattagacagtactttgatttttgcttttaaccgccaagcactttggaagagctgtggggtcgttgtgtgtcctgcgccctcgccgcttagcctgcctactgcctctgctttgtggttcgtagcccatgcctccttccacctcccttcctgtcagcctgtaccgctggccagcatgctctttgttttcctcctctgcccacgtcctggcttcaccttccttcctggaagacacgttcccatcttgagggaggatcccaagttggcacctccccgctttaggcttaggcgcattgtgcccgccttccggcccgcctggtccccgctttaggcttaggcacattgtgcccgccctccggcctgcctggtccccggggggaatccgcggccctcccactgttgctctgtgctctgctgagcgtcatttctcctgctgttttcaagatctgttttcctttatctttagtgttcagcagtttgaccgtgatgtgtctgggtgtggatttcttgtttgtcttgtttgggatccatagagcttcttgaatctgtagacaaaagactttctccaaatttagggtgttttctgtcatttttttcagctgtttttcatcactgcttggtttccccttttccttttgcactctcatggcacagatgttagaccttctctcttgtcctgaagatccccaaaattttttcaatctttttttctctctggtattcagattagaaaacttaacattgctctatcttcaagttcactgaatctttcctgaggtttttttttttttttacatttcagtagtgtgtcttttagttttgaaatttccatttggttcttctttatatcttgttttgtttgccttttgctgatttccattttttcattcagtttgggagtgttacaatcgttagagcatttcatagcacagtagttgctttaaagtcgggtggataattgcagcacctgtgttattttggcatctgttgattctcttttcctgtaggagcccatacgttcctcgttctttgtgtgctgagtaatctgggctgtaagtggatggttggatgttatgatatgagatctgggtcttgttaaaatcctaggaggatgttgatatttttattttagaaagcaaacaccctgaggagacttgggctgtggttctgacttgccttcagtgggtggcagctccatgtcaattctggcttcacagcctcctgcactgccacttggacctgccccctgtgtgccgctggtggctgtctggctgtggtctcagggtttggggtgtgaagaggatcagatccacacccctgcagcttgaggatgggcttgaagctcatgagcaattttgtcggctggctcttctgagctgcttcctctccacactgccactggggcttcctgggtccctggagagcttcccttctccaccctcagccagtgcagtgggactgactacccgttccactgtgcacctccatgcctgcgccagtgctggaggagggatttggggctccttctgttcagtgtctcctccaggccacctgctgctctttccttcatagaatgtggctcagctgcccctggtcccatcccagggcagagctcctcctgagtacccttgagactggagcagattcagcagaaggcagattgccccctctccctggagctggctctgaaggtgtgtttagacgatgtctgccttcatttctgcacctctgctccagctgcggtgtggcactttctgtcccctgcggcagccccatactccttgcaatctcagcctgtctgtgcagctagacagctggtgttgggcggcagggcgctcgtcttttccatgtcaggccctagtgtgtttggaggcaccacctgggaggtggctgcatttagggaggctctgctgggcagatgtggcattggagaggtgctgcccctccagcactttgagggggtcgtcagaccctcgagagagtcctcagcaccagcaactcaggacggcggcccccatggtgggaaggatggcaggaaccatgtgccccatactgtgaccctcctggaggccaggagagcctgttctcagcgagtgtggaaggataagctgcacagggcctcccagcctgctggcccacgtgccctgagagagacacgcaactcccaaggactgatcatgcccctgtcagccatgtccggtgccctcgggagagcgggaaggggttagaggcctgggtacccaacctcgaagcttgttgggtgtcccctccttctcctcacagaacaggggtccttatgtgttgttccagcccaggatggcggcccaggtgactctggaggacgcgctgtccaacgtggacctcctggaggagctgcccctgcccgaccagcagccctgcatcgagcccccgccatcctcgctgctctaccaggtgggtgcccagcagctgcagggcgtacagcctgtgctccgaccccacatgatgtttttctcttcctttccttcagccaaatttcaacactaactttgaagacagaaatgcatttgttactggcatcgcaagatacattgaacaagccaccgtccactctagcatggtaatgttgcggtgtgtctttgtttctctctgcagagaagggcgtgtttgaaggacagatgtatactttttggtattatcccaatagactatgcagtgaggaaaaagagaagaaaatgaatgaaatgccttatatttttaagacagtctttgcttttcttagtgtaaaaacaatacatgctggttctgaaaattcaatgtctctggcccagagaaaacctttgtcagcgtttcaagggtgcacctgccctgttaatgctcattccctctccagatctgcacccacacacaccaggtatgtgcccatatgagatttagatttataaatgaattgcattgttattatagttctgctttttttttgagacagagtcttgctctgccacccaggctggagtacagtggcgcgatcttggttcactgcaacctccgcctcccaggttcaagcagttcttgtgcctcagcctcccgagtagctgggactactggcgcccaccactacgcccagctaatttgtgcatttttagtagagacagggtttcaccatgttggtcgggctggtctcgaattcctgacctcaagtgatctgcccaccttagcctcccaaagtgctgggattacaggcatgagccaccacacctagctagttctgcattttaatggtctcatcaacaggttttctttctttcttttttttttttgagatggtctcactcaggttgcccaggctagagtgcagtggtgtgattagggctcactgcagcctcaacctcccgggttcaagcaatcctcccacctctgcctcctgagtagctgggactacaggcacacaccaccatgcccatctacttttttgtgttttttgtagaggcgaggtctcaccatgttgcccaggttggtcttgaattcctggactcaaggaatccgcctgcccagcctcccaaagtactgggattacagcctgagccactgcacctggacaagaatattttcatgccatgaaaatgtgctagagaaagcaatccttaatggctacgtaaaccattttgtaaatgtccacaattcaactatttttgcgcattgacttcctcttttatgtcgtgtaataaaaaaatgctgtaggctgggcgcagtggcccacgcctgtaatcccagcattttgggaggccaaagtgggcggatcacctagggtcaggagttcgagaccagcctggccaacatggtgaaaccctgtctctacaaaaaaaaaaaaatacaaaaattaaccaggcatggtggtgcgcacacctgtaatcccagctactcaggaggctgaggcaagagaattgcttgaacccgggaggcagaggttgcagtgagctgagatcgtgccactgcactccagcctgggggacagagcaagactcgtctcaaaaaaaaaaaaaaatactgtgatgaacgtctcactaaataaaggctagatttaagagcatctatttgattttttccaaaggaaacgatgttaaagagtggaaagcaaaagcagttttacagcagtgatgacagtcctcttcccatggactctctacctagattttaagtgctgtgggcgtgctcctaacttttcctcctgcacacccggggctggcagccctgcctctagtcctctctgggaccgggaggccctgtgagccagtgaggaggccatggggatcctgtgtgtgctcacaccgggcagggcgtctgccctgagcccttcctctgtgttcctaactgcaggtctcatggccagcaggttgttgagggctgggtggagccaaggtgtaacgcctgtggcacccctcagagatgcctgcgtgtcactgacacccctctcgcctgcagaagccatggggtgttttgggtggtcattgtggcccccagcgccgcacctcagtgtcactagcttctggcagccgtctcttggcacacaggccacagtgcttaggatagtttgtggcgctttgtctggattttagcaactggcatctgcttttcatgctagttcccccgcctgcctttgatttgccctgtgttccattgcagaacgagatgctggaggagggccaagaatatgctgtcatgctgtacacctggaggagctgctcccgggccatcccacaggtgccacgctcgcctggctcttcccctccagccacaccctgccaggcccctgccacaccacacccctgcccctgccatgcctggcccactctcctcccagttctcaccccacagcagggcgggatcactagctctagaagcccagcggctgcttctggctggatcaaagcctcttatgtcatccttgttcctttattcccaggtgaaatgtaacgagcagcctaacagagtggaaatctacgagaaaaccgtggaggttctggagcctgaggtcacaaaactgatgaatttcatgtacttccaggtaaaatggcaaataatctggggggggtgtaacaccgaggggtgggttgctgaccccttcctacccatcactgtcactgtgaacaccctgaacagagtgcctgcaaattaaagcaaccagtttctgagacaaaagggaccaagcctttgacagtctaaagttcctcatgccctttcggaatcaacgctccttttgtggttcacttctcttctctgagagtgattttatgtttccttcatggagcctgctttctgtcagtttcaagtacaatgctttgactttttgccagtttgtactttttttttttttttttttttttgagacagagtcttgctttgtcgccctggctagagtgcaatggcatgatctcggctcactgcaacctctgcctcccaggttcaagcgattctcctgcctcagcttcctgagtagctgggattacaggtgcccgccaccacgcccagctaatttttgtatttttagtggagacagggtttcaccatgttggccaagctggttttgaactcctgacctcagatgatctgcccatcttggcctcccaaaatgctgagattacaggtgtgagccaccacgcctggccaatttgtacttttgttttcgtctgctctttcaggtattttcttgctgttagcctcaccctgactgtccattcctggtggtcctcgccctggccttggttaggcaagaagtagccacatggaaggggcttgctgctttttaaagaagtattttggaaacatccagattttttatgatgatgtccttcagcaaagggaggagatggaactaactgggagatgaatttttgttttaccttgaaagttaccaagaggaaaaaaatctctcccagttttcacttctgaaagttagaacatctgaattttacaggcgttttattggagcattttgctcagtaattttgctggaataatcagcaagattttgttactttagtgatgtagttggtaaagtgcaagtcaagtaatgatggtgcagagcaggcagtgggagctgctttcaggaaggggtctggttgcccacattgtaaacacttcggcctggagcctcactgggcagatcgtttctcatcgaggagcagtgactgcaggtgcttgaaggagggacatgggcttggctcctcactgacctgcagctttctgccctcctgcttcctctgcacagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagaggtgagcacccacctcgcgcactgcgggccctcccgagagcacccagctcagtggcctgccttgtgcacagcaggtgtgcgtctttgtttgctgaagtcgtcacttctggtaggcagcagctacgtctcagtgtcagggctgtgtgagcacctgcttcgagggataaggtgaggggagccagcagataagtgcatatcgtggctttgcacagctagagcaggctcttcgtgccctggctgtcctcagatgtcacagaggaccttcgagcccctgggaagacagacatgcacaagatgtaggcctagctcacagagcacaggcatctggctcagggagcatcttggcaagggggcaggtggcctctgcagcctaccttgggcgttggggctgcagtcctcggtgccggtcactcgccagcgggggtccccagcacatgagcaccatcccagcaatgtgcagacgtggcccgtgcacagtcacagggtgtctcgtggtcacactgcgcttccagatcctctccctggtggttttctttctggatgtagagagcttctggagaagctagcctctggagaggctggcaagacgagcggaagaggcaggcatggcccagtgtgtgcttctggagcagtgtggggcagtgggtggccgatgggcatttggtgacactcggcgcgctgccgaccggcgttcggtgacacttggcacgctgccgaccggcgtttggtgacacttggcacgctgtctcctgatgctcttgctctgcttcatctgtgctcagtgcttttgaagacatgttttgctggaatgagatgctaatttcaatttcctctgctaagtaaggcatcttagctctaaaattaaattcgaagagaccttactttgcatctgaatatgctctagttatgttgcattttaaatcatacaactgttgctatgtctttattttaaaaacccacttgggacaaaatgaggcagcagtaggagtcaagctaggtcaggcagaattttaagcctcattcatgtgaaataatgcagtgttccatttatcacctaaaatcatcagctctgcacagaagtctagatcttcagaactagagaaaggtctctggagttgacctgtgagcccctcttggggcagaagtctgaagggtccctgtttgataacagcatctgtgggaatctagcatcgagactcactggtcggagtgggctcctggtcccagccgcccaatccagtagctgtgtgattttaagcagccttctcagccgccgttttggctttgtcagggaaatgggggaggtggttttcaatatttaaaagtatttaaaagttgtgtgtgtgtgttgttgttttttttttccttttagcactagcacctttattctaaagcctagtctgtaaaacagtttacagatggggctgctgtgtgcaaagctgggggaaggagggtttcccctctagcgtcttcaccacctccaggttcccctgagcaccaaagagtgggcctggggcagttccgtagctcttactgctgcctcttcctctgacctctatctgggacccctgttggttaaccttcccagaccatcacccccacccctcccaagacccccaccacacacacacgcatctagctcttttggcacctgctcgtggctactagtataacctcttttaagtgtcaatgccaagataactcatatggttatggtgaggcttgaggaaaatagaaaacagtatccttgaccctttccttagtctccccacccgccacctcagcagctactcaaatcaataaagcaaacatggccaggtgcgatggctcacacctgtaatcccagcaccttgagaggctgaggcagaaggatcacttgagcccaggaatttgagaccagtctgggtaacatagcaagaccccatctctaaaaaaacaagagcaaaaaaaactagctgggtgtggtggcatgcacctgtggtcccagctacttgggacgctgaggttggagaatcacttgagcccaggaggtagaggctgcagtgagctgtgattgtaccactgtattccagcctgggtgacagagtgagaccctgtgtctatttaaaaaaaaaggaaacatggttttttctttttgagacagagtctcactggcccaggctggagtgcggtggcacgatcttggctcactgcaacctctgcgtctcctggattcaagcaattctcctgtctcagcctcccgagtagttgggattacaggtgtgagccaccacaccgggctaatttttatatttttagtagagatggggtttcaccatgttggccaggctggtgttgaacgcctgactcaagtgatttgcctgcctccttctcccaaaatgctgggattactggcatgagccaccatgccccgccctggaaacatgtttaaaaaggcaaggaatgttactgtatcagttaatattacgtttaactgtatgcaattatttaaagcccagataaataacagtggctttaaaaagattgcagtttatttctctgtctcctgaaaagtcctgaattgggtggtctgcagctgatcgaggctctacgggacccagggctcctgtggtcctgcggctccgcttcaggtgttgcctcctggtcctaaatggttgcttaagctccagctgtcatttctccattccagtcagcaggcagaaagtggggaaagatgggctccatgcttcctcatgagtaaactttgagtgcttgtcagtatcttgcattatatctcatggcctagtccttggtcacttggccacagctagctgcagggtgggcgaggcacacggaatgtgtggggctccctggaatgtgtgttccacagaaatgcagggctcgttcctaaggaggaaggggaggaagtgaatgttggtgtaggttatcagcctttgccttggtaactcttaaaactaaacccccaaggttctgggttgcacagacctatccttatgtgggccgtttccactgaactttcttgcgggacagtcctagatgatcagaatcctcacacccccaccttcaccctgccctgccagacctcgcaggcttagcatggccttgcagtattgtattgttgggcctcacgtacgggtgtagctacaaattggtggcaggccagggctctgtctcaggaccttggacaccagtggtccctgaggtggcctggggaggtgtggtccagagggttcccagcagagaacctcagcagtgctggccggcttcatggcagggcttgtgggagtcacggagatggcagtggcccttctcagactcggggtccaggagccctgtgccccctagatgaggtgggcgtccaccagtatagggcagagaccagtgtgcagggaccctgcagggagccgtcagctgtgaccagccgggtggagagctgtcccagcctgtgcaagacacgtctaagttggcagaagactgacctggagtgcagggccagagacgcctgaaaaggctgaaatcataggtggcttctgagattgacccacatttctgcagatgactgtaggggaaagggatcccactcgaaccaggcttttttttttttttttttttttttaaatgtggcacgttggtgcattttgggatgaattctttttgttttcaaagggccgctcagtttttacgtaaaatggcagatccacagtccatccaggaatcgcagaatctgtccatgttcctggccaatcataacaagatcacacaggtaaggctggtgtttgcacactcaggttgatgggccaagcagccggccgggcgccgggcccatgcatgagtctcttgctctgtgtttcagtctctgcagcagcagctcgaagtgatttctggctacgaagagctcctggcagatattgtgaatctgtgtgtggattactacgagaacaggatgtatttgacgcccagtgagaaacacatgcttctcaaagtacgtgtgtggggacgctagcccgtggcactgccgagggacagccttactcttgtcaataggctgtgctttatctagaatccttttgacagctgtgtcttatttgcatgctgtcatgtgtgaacagcgtcctgcccttgcacacagcctgcacaacaggctctcaacacaccccatgagtgtgtcacacactgaccctgggagaaggtgctggccaggaggtccgggtcaaggattctcagctttttttttttttttttttttttttaagctgcttttcgttttattctcaaggcagggtgttgctcttgcccaggctggagtgcagtggcacaatcacagcccaatatagcctcaacctcctgggctcaagtgatcctcccacctcagcctcctaagtagctgggactacaggtgcacgccaccatgcctcgctaatttttaaattttttgtagagagagaatcttgccatgttgtacaggctgttctcaaactcctgggctcaagggaccctcctgcctcagcctcccaaagctctgtgaatacaagcttgagccactgccctttttattttttttttatttttgagacagggctttgctctttcacccaggctccagtgcaatggtgcggacacagctcactatagccttgacctccttggctcaagtgatctttctgcctcaggctcctgagtaactgggaccacaggcacttgcaccaatgcccagctaagtttttgaatttttgtagatatgagatctcactttgttgccctggctgaccttgaactcctgggctcaagcaatcttcttgccttgtcccccgcaaagtgctaggattacaggcataagccaccatgccccgccagctttgtgacagaagttatccaagattctacttgtcaagcatgtgattcctaggactttgataccttgtgtcacataattaaagtagccttttgttggttcaccatattctttattattctgttcaaattaggaagctttccatctgtgtttctcatgggaaagatgggcggcagttcggctgttccctttgctctcttctccacctctgcagggtggccttgggggaccctttgctgggtgtcccaccagcccagcccccagactcctcctgagcaggggagcactgtccacggagtgctttgtgacagcagaaacgttgtgtctgcaccggctggtgtgggagccctggccatgagcccctgcggagcactggagcatgcaggtggctagtccacgttaagaatttttagtttgtgactgggcacggtggctcatgcctgtaatcccagcactttgggagttgaggtgggtggatcacttgaggtcaggagttttacaccagcctgaccaacatggtgaaaccccatctctactaaaaatacaaaaaaaattagccaggcgtggtggtcatgggcgcctgtaatcccagctacttgggaggctgaggcaggagaatcgcttgaacctgggaggcagaggttgcagtgagctgagatggcaccactgcactccagcccgggtgacagagccagactccatctcaaaaaaaaaaaacaaaaaaagaatttttagtttgcatacaccgaaacttaactggttacatgtggctgcatattggacattacttttaatggcaaaaaaaacgcaattacttttgcaccagcttagtagctctagaatatccctaccgcttgggttaggctaggggagaggatttgttttttccgcttttagcgactgacctggaagcccagccccgctttgtatcccagtttcactgaggataaaatgatgcatttcaagcaccagacaagcagcctaaagatagatctttgtgatctatttcaaattgtgccttcaaagtcatcagctgtaacagtgtaagtccttatgggtagtgaaattctcagttctgagctttgtcgcatcattcattttgtggcttttcaggtcatgggatttggtctgtacctgatggatgggagtgtcagtaacatctataagttggatgccaagaaaagaataaacttatccaaaatcgacaagtacttcaaggtgagttacatgtttttagatcaatgtttttattgatttgtgtgcactttgaattttggggaagtgagcccctgtgtgactgtgatctatatcaggaaacgctggggctgggtggagtctggggcatgcacgttctcccgtctgcagaggtgaccgcgctttctctttccttttgccctgtgctggttttgcctgggtggagctttatacagatggaattgtgctatttgtactcttctgcgtccagctgctgtcaccagcctcttgtttgtgaggtgcatcctggaggaagcccgtagctacagcttgtagctttcggttgtggtgtagttttctatctgatgactacaccgtaacttatccgttccaatgttggcgggctctcggatgttcccaagttttggcgcgtccaaacagtgcagctctggtcgactgtcctctgttgggtgcatacccaggagagggaccgggggtcacaggcctgatctgttttcagtgtcagtagttacctgcagcctgatgacgctccagcacagctgtcctgatctccgttcccatcagcagtgagagaatgcgccgctggtgccacatcagtacttagcactgcctttttggggtggggggatatcctgaggatgcgtacagcattgagattgtattggctagtgtttcattgtattggctagtgtttcgttcatgtttccctaatggctttccatgttattagcgtgttcccttcgtgatgtgccacttcaagtgttttgctcttttttccctattgatttacagttctttatatattctggatacatgtcctttgttggacacaagtgagtttttttgtttgtttgttttgttttgtttttgagacaggccctcgctctgtcatccaggctggagtgtagcaggccttggtgatttctcccaccccagcctctcaagtagctgggactacaggtgcttaccatcatgcttggctagtttttaaacttttagtagcaacgagatctccctatgttgcccaggctggtctcgaactcctggcctcaagcagtcctccagccctggcctctcaaagtgccaagattacaggcctgagccactgcacctggccttacattttaatatacatgtattctcccctaagaggcctaccctttcactttttcccagctttatcaaggtgtaattgacaagtaaaaattgtatgtttatggtatatgatgtgatgttttgatacacatacacattgtgaaatgatgaattcaagctaatttaacatgtccattacctaacacaccattttttttattttgtgatgagaacacttaagatctactcttttagcatattttaagcattcaatgcattgttattaaccatagctactgtgccatagatgaggtcttcagaacttaactatgctgcggaattgaaactttatacgctttgaccagtatattcccttcctcctcctgcctccagtagccttttcgcgttctcgatggtgtcatttgctgaacagaagtttgtcattttcatgtagtctcatatatgaatcttttcattaatgtccacctaaataaatctttgcagccatccagctcatgagacgtttctgctgtgttagcttctagaagcattctgtctcctttttcacctagatctaatccccctggagctgacttctgcgcgtggtaggaggtaggggtttcgtgtccttggatctttcccagtatggcttcccagttgggcctgcccatttattgcaaagcccattgttctgcagtgctgctaaggtcatgaatctgtctgtggctctgtccaggttctctgtcctgtccacaagcctccatccctgctccagggccacactgccttaattgttggagctttctaacaagactcctaatctggaagggtgtgtcttccagttttgtccttcaggatagtctcagatatcatcccttcacctttggagatgcacgttagaattgatttcctgatttatacacactatccccccaaaaccattttttttcttctggaatattgactgggattgattatagatctattttgagagaatggacatttaaaaaatttgaagccttcctaggcacaaacatgatcatttctccatttactgagaactttttctagaattttcggggtagtacttttgtttagaggtcttgcacattttttgttagatttactgatgcatttttttttggatgctgttgcaaagtatttctctttaagtttttgtattctgattgttgctagtatatagaaatgcagttggctgggcacggtggcttatgcctgtaatcccagcactttgggaggccgaggcgggtggatcacgaggtcaggagatcgagaccatcctggctaacacggtgaaaacccgtctctactaaaaatacaaaaaaattagctgggcatggtggcagttgcctgtagtcccagctcctcgggaggctgaggcaggagaatctcttgaaccctggaggtagaggttgcagtgacccaagatcacgccactgcactgcagcgcagcctagtaacagagtgagactgtctcaaaaaaaaaaaaaaaaaaaaaaaaaaaagggctgggtgcggtggttcacgcctgtaatcccagcactttgggaggctgaggtgggtagatcacgaggtcaggagattgagaccatcctggctaacacagtgaatcccatctctactaaaaatacaaaaaattagctgggtgtggtggcgggcgcctgtagtcccagctactcgggagcctgaggcaggagaatgatgtgaacctgggaggtggagcttgcagtgagccgagatcacgccactgcactccagcctgggcgacagagcgagactctgtctcaaaaaaaaaaaaaaaaaaaaaaaaaaagaaagaaatgcagtgatttttttttttttatgactgtggatctagcaacatggtaggttaattttaacatttgaatagtttttatagatgttggtttttaaattgtattttgttcctctcaaagcgaatgtagaagttacttatagttttttttttgtaatgaatcatttgcagaggtagcattcaagccgaagtaattattagcattagtcagtttccttgtgcttatgtatttggtgactaaatatacataatgactctatttttttgttctttgaatacagcaactccaggtggttccgctatttggggacatgcaaatagaactggcaagatatatcaagaccagcgcccactacgaggaaaataaatctcggtaggaggagaggaaagctgcctggtttgagctttcggcagtgtcctcattgtgcggttttcaaacatcctgcttatttgtctagagataacactgttaacattctcagcctggaattaaatgtccagtattgcagcctttgccacatgcggctatttacatttaagtttattgaaaaatacaattgaggccgggcgcggtggctcacgcctgtaatcccagcactttgggaggccgaggcgggcggatcacgaggtcaggagatcgagaccatcctagctaacacggtgaaaccccgtctctactaaaaatagaaaaaattagccgggcgtggtggtgggcgcctgtagtcccagctacttgggaggctgaggtaggagaatggcatgaacctgggaggcggagcttgcagtgagcagagatcgcgccactgcactccaacctgggcgacagagcaagactccgtctcaaaaaaaaaaaaagaaagaaaaatacaattgaaattttaatttccttacgacagccacgtttgaaatgttcaatagttagtggctactgtgttggacagcacagatacagaacactttcatcatcctagggattcctattggacagtgctgggtgatagtctttatgtttaaaaaggttgtcttaaaaaaaaagaagagggtggggcgcggtggctcatgcctgtaatcccagcactttgggaggccgaggtggatggatctcttgaactcaggagtttgagaccagcctgggcaacacagtgagaccttgactgtatgaaaaaatacaaaaattagccgggcatggtggcacacgcctgtagtcccagctactcaggaggctgaggtgggaggatcacttgagtagtctaggaggtggaggttgcagtgaaccaagattgcaccactgcagtccagcctgggcaagagagcaagaccctacctcaaagaaaaaaagaagagactgacagtgtgtcagatgtgacatctgcagacaatgtggccctaaatcctaaactgtgtaccatcttactctgtgaagaactataaagatcctcagcacagttccagatgctggcaggcactcctccccactgcagactctacagagccatctgagcctcaggggaggctttcattgacttttgccaagcactgtgcccgtagccaacctgcagtcaccattcagccatgattttgacaaacgaagttgcatctcagtctcaggggtcaagaaaccttttcagtaaaggacacataacaagtattttaggctttacaggccacaggtggtctccttcggatatgcttctgtgttgtttttttaaacaaccctttaaaaacataaaagccatttgtgtggctctggtgccaaacaggcgtcctgagctgccccagtgctgtggcctgccggcgcctccgcaggtaacgcgggtgctttctctctgcacagatggacgtgcacatcctccggcagcagccctcagtacaacatctgcgagcagatgatccagatccgcgaggaccacatgcgcttcatttcggagctggcgcgctacagcaacagcgaggtgcgccccgcgacctggagctgcacaggcacccgagggtcgcctgtgtgtgtttgcacccaaatcttaggtttaattgctttgaaaaacagtttactaccagatacgatcatatgtcacataatgacagggacaggttctgacaaatgtgtcattaggcagtttcatcattgtgggaacgtcatcgtgtcctcatgctagcctggatggtacagcctgtggcacagctaggctgcagggtacagcggatggctcctaggccacacacctatggagcacgttgctgtgctgaagactctggatagttgtaacacaatggtatgtatttgtgtatctaaacatatctaaacatagaaaaggtacagtgaaaagatggtattataatcttatgggaccaccgttgtatatgctgtcattgaccaaatgtggtgcatgactgtacttcaaaagcacccattataattgacaaggcagtgaaactagtgttctctctgttcagctgtacaaaaagcttttttttttttttttttttttttcagaaaaacattatagggatcccaagagaaaggacagagatgagataattaattgattaagtggcatttcctagtctagtactgtgattccaagcaactcgaaagatggttggagagaagggaggacactgggaaaggaaagggtgattctgacctggggcccctgtaagcctagaagggaagaagtcctgaggccagaggtgagcaggagcctctgggtggctgtcagaagacgtcccaggggcattgggtccatgtgtccaggaggtgggcctggagttgggtgcagagaacaggtgctttctctttagttccttccagctttgcagctgggtttgccatgttgtcattttggccactcccattctcctcactcacccaggttgactccgagccagcactgctggcatgtctgtgctgcaaattgctggcagggactgcgggttttagggcatatacgcaggctgctttgctgaactggttagtccctcaagggtctcaggaggaccattaaccttagcggggacaactctgtggatgttggccccacccactgcaggacgatgagcaccctgtcccccaccccccatggttaccagtcatcatcatgtaaccaaactgactgacaacccagtagtccaggtatgttggggcacctgctgcttctaacacagacccctggcaagcgtttgggcatgtcagacaaggaggctgtcctgggtgagtcagtgagtgagtggcgagcgagtgggaggcctaggacagtactgtgcactgctgtggcctttatgaacactgtgtgcttaggctgtgctaaattttttaaaaggctttttctttctttaataacgaattagccttagcttactgtaacttttttactttataaactttttacttttaaaaagagctttttggcttttgtaacaacactttgcttaaaacacaaacacactctatacctgtgcaaaaatattttttctttatctccttattctgtaaattatttttctaccaaaaagtttttgtttttttccttttgagctttttcgttaaaaatgaagacccaaacacacacattagcctaggcctacacggggtcaggatcatcaggacatcactaggcagtaggaatttttccactacgttaagattttatgggagcaccatcatgtgtgtggtcttgttgactggagcatccttaggtggcatctgactgtaattgtttctctggcattgtctaaggtaacaaatcagtttttttcggagtacagtttttttttttttttttttttttgggtgagacggagtcttgctgtgtcgcccaggctggagtgcagtggtgcaatctcggctcactgcaagccaaggttcacaccattctccttcctcagcctcccgagtagctgggactacaggcacccaccactacgcccggctaatttttgtgtgtgtgtttttttgtgtttttttttgtgtgtgttttttgtgtgtttttttagtagagacactgttctagccaggatggtctcaatctcctgacctggtgatccacccgtctcggcctcccaaagtgctgggattacaggcatgagccaccgcacccggcctctgagtacaattttaaagtgattcgactttaggtttgttgattttcttttttctgaaagctgaacatcctggtgaatgacgccagcataatttgatttatgtcattatgtcataatctagtcttttttttgtttgtttttgaggtggagtcttgctctgttgcccaggctggagtgcagtggcgcgatctcggctcactgcaagctccgcctcccaggttcacgccattctcctgcctcagccttctgagtagctgggactacaggcgcccgccaccacgcccggctaatttttttgtatttttagtagagatggggtttcactgtgttagccaggatggtcttgatctcctgacctcgtgatccgcccgtctcggcctcccaaagtgctgggattacaggcgtgagccaccgtgcctggccttttttttttttttttttttttgagacagagtctctctctgttgcccaggctggagtgcaatggtgtgatcttggctcattgcaacttccacctcccggattcaagcaattctcctgcctcagcctcccaagtagctgggactacaggcgcacgccaccatgcttagctaatttttgtatttttagtagagacggggtttcaccatgttggccaggatgatctccatctcttgaccttgtgattcgcccacctcagcctcccagagttttgggattacaggcatgagccattgcacccggtcataatctagtcttaaaagagcaatgccagcactactaattacagtgactagaaattgttttatgatttgttttgcaggtgattttgcccttgagcttcttactcagggtacttttttttttttttttgagatggagtttcgctcttgttgcccaggctggatggcgtgtgatggcgggatcttggctcactgcaatcttcgcctcctgggttctagcaattctcctgcctcagcttcccgagtagctgagattacaggcatgcagcaccacgcccagctacttttttatatttttggtagagatggggtttcactatgttggccaggctgatctcgaactcctgacctcaggcaatccacctgccccggcctcccaaagtgctgggattacagcatgagccatcgcaccgggcccctcactcagaggattttaagtcacaccgtggtgtttagagctgctcagggtcctctcagtggtcatgctgtgagctccatgcaggttcccgccattgtttcattttgcttttgacttctaggcattgcatttccgatctcatttaattctgtgtcctaaatatataaaatatttgtgtggttctaatatcacatctataaaaaggtatattcaaagaagcctgccttctccacggtgccccttcctccccataggtcacatgtttaaatttagggggtggttatttgatagaagcaaacccacgtgacttgtgtgttgcccttccccggcctagtggaagtgcgccaagcccacgcgtgtaacagccccgcgcccagcccgcggtcccccaggcggtggctgtggcagcggcctgtcccttgctctgtgctctgcagcacgcccttggccgccattttcccgggaggagggtccagcacccacagcatttcttattttctttttatttatttatttatttatttatttatttatttatttatttattattttttgagacggagtctcgctctgtcgcccaggctggagtgcagtggcgcagtgtcggctcactgcaagctccgcctcccgggctcacgccattctcctgcctcagcctctgaagtagctgggactacaggtgcccgccaccatgcccagctaatttttttgtatttttcagtagagacggggtttcaccgttttaggatggtctggatctcccgaccttgtgatccgcccgccttggcctcctgcatttcttattttcacacgtgtgactttggggtggattctcatggtggatcccgggatggggggagctgggtgggggcgctggtttctcacggggccgtgcccgccttgtgcaggtggtcacgggctcgggccgccaggaggcccagaagacggacgcggagtaccgcaagctcttcgacctggcgctgcagggcctgcagctgttgtcgcagtggagcgcgcacgtgatggaagtggtaggccccgtccccgaccccagccccgctccaaagctgcctcgggcactttattcacattaacttttggtctttgggctttttatctttggccctagaaagacgagaatatctatcagtagatatgtttccaaggtgattttaagtacatctcatttatgtgtgtaataaatgaagggcctcctttttaaaaaaaatcttgatagaattaaatttgtaccattgtgattttctttaagtcgttctttttttgagatagtctcaccctgtcgcttaggctggagtgcggtggtgcaaacataagtccctacagccttgactccccaccccaagcgatccttctgcctcagcctcccaagttgctgggaccacaggtgtgcaccacggctcccggctaattttttttttttttttttttttttgagacggagtttcgctcttgttgcccaggctggagtgcaatggcgtgatctcggctcactgcaacctctgcctcctgggttcaagcgattctcctgcctcagcctcctgagttagctgggattacaggcgcccaccaccacttctggctaatttttttgtgtttttagtagagatggtatttcaccatgttggccacactggtcttgaactcctgacctcaggtgaactacccgcctcagtctcccaaagtgctaggattacaggcttgagccaccgcacctggcctagttttttgttttttggttttttttgtacagacagtctcgccgtgtgggccaggctggtctcaaactcctggcctcaagccatctgcctgcctgggccttccaaagtgctgggattacaggcgtgagccactgtacctggccaagtctcattttttcatttaaattttattttgctttaaatatttacttgtattgatgcataataggggtacatagtttcaggatacatgtgataatttaatacagtcatacagtttgcaaagatctaattggtgtgcttgggatgtccatcgccataaatatttgtccttatgccagaaaaattcgagttcttccctatctattctgaaatgtaccataaattattttaattaatagtcaccctaactgatctatctaacactgtcttatttctaatatcagactgtacatttgtacccattaatgtcgcttcacgccctgcatttttaagataacattttctctttggagctccagccatcaatgtcttttgttgaacattagtaaattatttctggtgccatataaagatttggatacctgtaagcaatgaaagattttcccttttgtgatttattttgatcacataaaaattatcaaattggaagagtacatggtcatttgaaaggcaaaatctttatttacttacttattattttattttttgtagagatgaggcctcactatattgctcaggctgatcttgaactcttgggctcaagtgatcctcctgcctcaacctcccaagtgctggggtcataggcatgagccactgtgcctggcccagaatcctttttaaaatgatgatgaaatgccagagtcttagatactcagcactcactatccaggccattttgccgggtagattttttaaacgagaggttacagggccagggtcttttgcccatctgtggagatggacggtgtgtgcgccctcatgtgtgactttcagaatgcagcaaaggtttgaaggctggcctggctttggccaccatcgtgtgagtcagaccagaagccaggcgttttgcatgcaatatggaacacctctgctctttcggccaccacagtattcctggaagcttgtgcaccccaccgacaagtactccaacaaggactgccccgacagcgctgaagagtacgagcgtgccacgcgctacaactacaccagcgaggagaagtttgccctagtggaggtgaggatgctcggccgctcgctcttcctcatgtcgctctagcttcacaccatcttctctgtcaaaagcaaaaacatgaacaaaactgcctgtttactcattgcttctgtgtgggcacccctttccatctggcagagtagtcagagtagaacgcattagagaaacagtggttgtcggtcctgggtctgcactgaagctccctgggtgcgaatctggactcctggacctgcgtctggatggagagcagtgtcgggtgcggggaagggaggtgaaagagatgtggcccctgctgagagagaagagctgtcttgctctcctgtgaggcaggcgctgcactcccctcgtgagcctttccatgggcagctcttcattccagcatcaactggtatcttttctttcatagctgtgcttttcctgtgctgtttgagaaatctttgcatactctcaggtcgtgaaggtattctgcattgctttctggatacttcactctgctttcacactgagatgcgaaattcacctgaaattcatttttgaaacaattccgtccaaccctcacgctgccacctttgtagctggtcacgtgacaatgcatgtgtggctgtgtttctgctctgctctaacccagtgtcagttgctgtcggtatcccagcaccactctgtagctttgtagtcatctaccgtgtatgagaaagcacgtctttctgtctcctagacttccttggctattcttccccactgtagtttcatattcattttagaatcagcttttcccatcccacagtgaggattttaatcaggatatgaacaatcctatggatcatgacaggagaattgacagaagtctcatacagttggccctcagtgttcttgggttccacctccatgaaccaaccttgggtcaaaaatgttcagaaagaaaaaataacactacaacagtgaaaagtaataaaaatgttaaaaaccactgttttggcctcagcctcctggactcaagcaatcctcccacctcagcctccccattagctgaaactataggtgcatgccaccacacctggctaatttttatatttttggtagagatggggtgtcaccaagttgcccgggttcgtctcaaactcctgagctcaagcaatccacccgcctcagcctccgaaagtgctgggattgcaggtgtgagccactgcgcccagccaaaattttctgattttttgacataaggtttttcatagtaaattctcatcttattttggtagaagcttttttttcacataaccatacagttcacccatttgaagtgtaaaagtcaatgctttcagcacattcacagagttgtacagtcacaatcaaatttagaacaaatataaatgccagcccattatcagccacccttcattcttccctccctcaaccgtatgcagccaccactctgctttctgaccctgtagatttgcctgctctgggcatttcatatgagtagatcataccatatgtggccctttgtgactggctttcacaaagcataattttcacttagcataattttccttttatttttcttaagatggagccttgctctgtcacccaggctagagggcagtggcgtgatctcagcttactgcaacttctccctcccgggttcaagcaattcttgtgcctcagtctccagagtagctgggattacaggcacccaccaccacgcccggctaatttttgtatttatagtagagacaaggtttcaccatgttggccgggctggtctcaaactcctgacctcaggtaatccgcctgccttgggcttccaaagtgccaggattacaggcgtgagctaccgtgccaggccacttagcataattttcaagattcacacaggtatcactgttttgttctgtttattgctgaataatattgcattacatggatatgttacattgtatttatccatccatcagatgatagacatttgggttatttctaccttttcactactatgaagttgctgagaacttctttttcttgtttttttttttttttttttttttggagacaaggtctcactctgtcacccaactggagtgcagtggcaggattatggcttattgcagcctcaatcttctgggctcagacaatcctccctccccagcctcccaagtagctaggaccacaggcacaaaccaccatgcctgactaatttttaaattttttgtagagatggggtctcactgtgttgcctagtctggtcttgaactcctgagctcaagtgatcctcctgctttgacttcccaaagcactgggattagaggtgagccaccatgcccagcctctatgagctttcatgtgcgggtttttgtgtagatgctggttttcatttcttttgattgtatagctagaaatgcaattactggatcataacagcacatttagcttttgaggaactaccagatagtggcagcaccatttctccttcttaccagcagtaagtgagggctccagtttccccacatccacaccaaacttgttattgtatgtctttttgattctagctatcctagtgggtgtgaggtggtatctcatttcattgcgcttttgatttgcggttttctaacaactaaggatgttaaacgtcttcttatgtgcttgttggccatttgtgtgcattatttggagaaatgtctcttcagatcctttgcccatttttaattaggttatcttttttattattgagttgtaacagttccttatacattctaaatatcagttccttacagccataggattttcagtatcttctcccattctatgattgtccttttagtttcttaatggagtcttttgagacacaaagtgtttgaattttgattatgtttgatttatctgtttttctttcgttgcttatgcttttggtgtcatatataagaaatcattgtgtaacccaggtcatgatgatttactcctgtgtttccttctaaaagtcttttttttttttcttttttgagacagagtcttgctctgtcacccaggctggagtgcagtggcatgatctcagctcactgcaacttctgcctcccaggttcaagcaattctcctgcttcagcctcccaagtagctgggattacaggtgtgcgccaccacacccagctaatttttgcatttttagtagagacagggtttcaccatgttggccaggctggtcctgaacccctcacctcaggtgatctacccgcctttgcctcccaaagtggtaggattacaggcatgagccgccacgcccagcctcttctaaaagttttatagttttagctcctaacttaaacctaatttaaatatatgatccattttgagtggatttttatacagcgtttgacaaggttgtgtgaggggccctccagaccaccctccatccccctgactggctgggaggactcacagggcttggtagttgttgcactgaaggttatgactccttgcagccaaaagacagagtcagatcagcaaagggaaaaggcacaggagtggagtccagagaagacaggtgtaaacttccagctgtgcctgctagtggaattgcacgggacgtgcttatttctcccagcgatgatgtgtgacagcacacacaaattgtggctcaccagggcagctccccagagccttggggtcctgggtttttactgggggccagtcacgtggctgaccttggctactcagactctaggtcctcaaaacacacacaggaggtcactattagtcaccttgttagcagagactgatcagactggtacagcagtaggcccggggccccaggcacacaaaaacataatctctaggcaggacactcccaaggttcagagctggttcctgggatgacttcagccagtcctgaagatgggcctttcttggggatgtgcggagtttcattctccccagcctgctgagttaaccctttcctgcacaagggtccaccttgattctctcgcatgtgcagatacagttgtcagtactatttgttgaaaagatgatctttccccatcaaattgttttggtaccctgttgaaaatcaattgtaagttaacttctggactcttaatcctatcccattgacctctgtctatcctatgacagtattttttcataatctcttaatctgtctataaactgctaatgtcccctttttcattcttaatgctggtaactcgtgcttctttttttttttttttttttttgagacagagtctcgcgtgttgcccaggctagagtgcagtggcacaatctcagcttactgcaaccttcacctcccgggttcaagctacttctggccaatttttgtatttttagtagatacagggtttcaccaatgttggcctggctggtcttgaactcctgacctcaagtgatccaccctccttgacctcccaaagtgctgggattacaggcgtgagctactgtgcctggcctgcttctctgtcttttttttctttgttattcttgctaagcatttgtcagttttactgtttatttactgaacagctttgtctttgttgatcacccttgattatacacttgttttctgtttcattgttacatttatttatttatttatttatttatttatttatttttgagacagagtctcgctgtgtcacctaggctggagtgtagtgacgccatctcagctcactgcaacctccacctcccagtttcaagcagttctcctgccttagcctcccaagtagctgggactacaggtgtgcaccaccacaccaggctaatttttgtatttttagtagagacggggtttcaccatattggccaggctggtctcgaactcctgaccttgtgatccgcctgcctcggcctcccaaaatactgggattacaggcatgagccactgcgcccgggtgcttttagttatttttcttcgattttgggggggtttattttgctgttttctataaattagtgatgaatgtttgataagtattatgatttttatcctttttagttttctaatgcgtgcatctaaagctctcagtttgctgttaacttgccttttccttcttcctgtaagtgtgaatatgtaggattgttatgttcacttaaatgggtttttcctcgtttggttttttaaatagaacttttcttttttgttgattggaaaaacaatataaaatcatcagttttccaaagtaagcatgctgaaaacacaagcatggcattaggaaggcacagtgcctgcggcgccatcacagagatggcgctgagcagctgggtgcgttttcttccagactttttcctttctaaaattttcattattttaattgcatatagaccatgagtcttacatgaaagcagtctatttggaaattctttacgttatagaaggatgaattaaaagcagactgtcaacttttccacctgaaaatttcatgaaaaagaaaagcaccaaaatcatataagccatgtttcaagtacttgtcagacacgtcttcatttacccatgaatcaggctgtttataaagccataatgaggaactcaaaaggtgtgaataaaaccagaaagtgatagagggagactgtgtgaagccttggggaaacacatttgtgttcttgctaagtgaacttcaaaccaacagatttaataaaagtaggaagatgcctagccaagcatggtagtgcatgcttatagaactagttacccaggaggctgaggcaggaggatcgattgaccctgggagttcaaggctgcagtgagctatgatcatgccactgcactccagtctgggcaacagagtgagaccctgtctcaaaaaaaaaaaaaaaaaaaaaaagctgccttaattttgaatctgtcaaatacttaatttcaaaaggttttttttgtttgtttgttttttgtttttttttattactgtggactgaagaccattttcagatgttgaagtagggtttttgttttgttttgttttgagacagggtctcgctctgtcacccaggctggagagcagtggcatagtcatggctcactgcagcctcgaactcctaggctcaagtgatcctcctggcttagcctcccgagtagctgggactataggctcatgccaccacacctggctaatttttaaattttttgtagagatggggtctggccattttgttcgggctgatcttgaactctggtctcaagtgattctcccgcctcagcctcccaaagtgccaggattatgggtgtgagccactgtgcctggccaaagaagggttgttaagattttcccaaatgtattagtcttaggtacagcgttctagttaaaagataaaaagaagtgaattatgtttcactggtgctattaaatgttccactttggtgtcttatatgtcagacatccacacggcagggtggacttggggtaagtgtgtcttgctctgcctcacttgctgctttcagagagatttctaggcctcacatagctatcatgaagttggctgtagaaatatttataaacggcaaaagccgtaagaaagctcatgcaattgtaaaggtcatacttggtttgtgaccttcaattgtttattcagaaagtaataaagcacactgtcatgacaaaattactgtctggaaacagggaaataatgagccctggcaccatttttctgtcccaggaattcctttggaagctctttgtcatgtaattatgttccatcagagtcttccaggctttttctgtgaatggtagttcactgcgcctttgttgtgaacaatatgggatttggactacaacctcttgtaacttctttttctagtaatatcatgcctgctttcctgagtctttttcttctttcctatttgaattccatcacaggagggtgtgctggggtggatgcatgtgtgtttcgagtcagatgcatccctgtcctccaggtgctcatggtctgatggggagtcagatgcgggcacagttccattgactatggctttggagaagacgttttggggcagggcagctgcagggcacgaacgcgggagggcgtaaggtgctgtgggcgaggaggagcagcccccggcatgtgccaggcagaggaggcttggtgccatccctaagaagggccgtccctgttgctgtgtcccccgcaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagaggtcagccttccccacgccctgtgcccgctgtgcccacacgtcctcggatgaacttggattcaaacaacaggagcgttaaattctcaaaaatgatttcaatatatttatcttcaaccttcagatgccctcttggtgaattacctctaaaagtaatgcatgggtccaattattaacccaaacaatggacagtaagtcagctgccgagtgtctagggagtctgaggaccccgggacaaggtgcatttatcccaggctcgcggtgcctgtggttcatgcatggtgccttatgggggtctctgcacggtggagccctgttggtgatgaggctgtgttccaaaccagtcgagagacatggccaggctctggtcatgtgggtgacttcacattcctgttggttactggggacagccagctgcgggcaggcggggcccagctctgctccgtgcggaggctgtgttctgccctctccctgcccacagcatgactcagagccacctcactgctgccctgggctaacagatgcgaactggagctcagggcagtcttctgggggtagtaatactctccagaaggcagactcctttttaactttcctgttgagctggtccattaccacatccctccatggcccccagagtaatttgtattttcatgggggctgttctgagagccttgtagttgggtgaggagatggtgtgattgtgaggctggaggtctcggcctctgggccttgctgatcacttggtggggtgttcagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcaggttctcgtcccttgagccccgcctgcaccctctccctggggggacccaccctgagctgtgagcgggtggggctggtgaggcccgggttaaatgaggtcctcgctgcctgctcaggcagagaaagtggcgcctgtggtttctgctgctcctctgtttcccacccaagtgagttgggagcgtgaggagacgtgccttgattgtcagatgtgtcatgtgcactaaaaaggagtctgactccatttcaactcccatcccaaaaatgtgggcacaagtccacgtgtctgtattcattctgtgtttcttgatgggtgtttgaatgtctgtataatttttacgttgggtctgcaaatgactgtagatggggcgtgggaaactgtgaggtgctgcttgcgtgtgtcatggtcctaagctgcccactgtcctctctcctggtgtgttcaggcctccccgaggtgcttctcacgactttcacacccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctgtctgtccgtgtctagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtggtaagacatcatttgtttctcttgacgtttatggcacggaggcgaactgctccgctacaagttgttctttccccaaagcagcagcaacgtggccgcgtagacaggcacccggacccctcggggagctggtgcggggccctcccgaccagggcgtagcggagcagtccttctctcatgggctttttgagtttggcataactaatgtaccatgtatattttctcccccacaaatgtttccttggataatccagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtggtaagagatactgctgagcagcatccggcctggcatgtcctaacaccactaacaccgtctagaatgcttccgcccgcctgaccaccccctaccccgtcccttggtgcacccagacggtgactcgtcctgccctctgtggcggtggctgtacgtccctggcctgagctcgctccacagggcgtggtccctacaagggtataaactgaggagcccgggctggccctgagacatgaacagaaaatcttttcaacccatgcggggttggaaacaggcgaatgtaatctggtgcctgagttgagacacaggcattgataaatactagaaatggcccttgcagaccatgacgtggggggaaggtggcgggtgccctgtgccaggcaagcccatcctgggtgacacccggccaccttgaccggccaccggtgggtgcgctctctgccctccgtgtgtctgtcccgtgttctcatcaagtcctccgttgtccacctcttgctcagaacaggatccctgctgtcttggctggggtgctgcgaggtattggaggaaatagtaccacttttgctgttaactccatgaaaggatggagttcgagtgtgggctcttttaatctgtctcatttttgcgttagacagacctccctgagtgtgcctctaatgctgcagcctggacattggtttttatcctaagtgaaagtgaagaagtcctgtttttttgttttgttttttgttgagacgaagtcttgctctgtcacccaggctagagtacagtggggcgatctcagctcactgcaagctccgcctcccaggttcaagagattctcctccctcagcctcccaagtagctgggattataggtgctcaccactgcgcctggctaatttttgtatttttagtagagatggggttttaccatgttggccaggctggtctcaaactcctgaccttgtgatccacccgcctcggcctcccaaagtgctaggattacaggcgtgagccactgtgcccagccagaagtcctgtttttatgtctccttttgagaagaacatttttaggtaagacacagtggctcatacctgttaatcctaacactttgggaagccaaggcaggagaatcacttgaattcgggagtttgagaccagcctgggcaacatggcgagacccccatctctataaaaaatacaaaatcagttggtggcacgtgcctgtgttctcagctacttgggaggctgaggcaggaggatcgcttgagcccaggagttgaaggctgcagtaagctatgatcgcgccactcacctccagcctgggtgacagagtgagatagactctgtctcaaaaaaaaaaaaaagacactttccccctggatcccactgaagggctcacagggttgatgaggtggctttacctgcagctatgcccagctggtcctgtccctagtgcaaggccccggtgacccctccccactcatgtccatgctgcatggcttggggctgagcgaggaggagcaggcacccagcacacagcccttgtgtcatctctgctaaaggtttttttttgcttgcgggagataacatggagttgtttgaaccctcccagaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtgcgtgtcctgcgggcctgtctccagcctttgtgtgtggtgaccgggggtcctcagaggaggtggcggagaggccgggactgtttttagtattgtatttgaaatcaagtttctgggcctgggcaaaatagcaagaccccagtctctacaaaaatgagaaaacttagcctggtgtggtggctgatgcgggaggattgctttaccacagaaatttgtggctgcattgagctatggattgcaccactgcattccagcctggccacgtagcaagaccctgtctccaaataaaaaaaaaaaaaagagaaatcatgtttcctggggtaaagctttagagattaatacaagtaactaaccagtttcttggtgtcagactggaattgagagctcaggcactagaaccagtcacgttcctactttgcatgggtgctggctgggacccggggactcagcctggaccagggagatggatgaacctggaccttccccaggccttcgtagtgcaggccctgtgaggtggccatgcccgtgagctgccttgcgggagccctgtggcctggccttttgtgtgacacagcctctgacccagatgaagtggggaaaggaagtattgattgaacagctttgttctggggatcaggactgtggacctagatggaagggcagtctttcaaaatataaagttcatggaagggaaagtgtttggaaaagggtgtgtctcatggtgagcgactggggagccgcccagccggtctgtcttctgagcaccgtgagtgggaagcccctgagttccttgtgcgtcagtcctcacacatcccttgtggtgcccaggagatggtaagggcagtcaccttccactctctgtggctgtggcatggccatgccatttgtgtgggcagagcctctgatggctcgttgcacagcattggggtggcgtgaggagctggaaccagcttggaggcctccttcaggcatgggcctccttgcccctggccatggcctttgtccagatatgaggtagtgggagacgggccttcaaccatgggccatgctggacatgctcctggtgagctgtgggatccaggaccttcacctttgttcttttttttttttttttttttttaatgctgtctatgtacttccgttggtgtaattttttcttttttttctttctttcttttttttttttttttttttttttgagacagagccttgctctgttacccaggctggagtgcagtggcacaatctcagctcattgcaacctatgcctcccgggttcaagcaattctccggcctcagcatcccaagtagctgggactacaggcacccaccaccacgcccggctaatttttgtatttttagtagagatgagtttcatcatgttagccaggctggtctcgaactcctgacctcaagtgatccgcccacctcggcctcccaaagtgctgggattacaggcatgagtcaccgcgcccagtccacctttgttcttttccagtcagttcattctttttttttttccccccaacagagacaaggtcttgctctattgcccaggctggagtgcagtggtgcaaagacagctcactgcagcttcaacctcccaggctcaggtgatcctcctgcctcagcctcctgagtagctgggactacaggcatgcgccaccacacctggctaattgttttgtgtttcatggagacggggtcttgctatgttgtccaacctggtctcaaactcctggcctcatgttatcttcctgcctcatccacctaaagtgctggagttcattctctatcattttttttggacagggtctcactctgtcacacaggctagagtgtagtggcacgatctcagctcactgcagcctcaacctctcaggctcaagtgatccttctacctcagcctcccaagtagctgggactcaggcgtgcgccaccacgcccagatagttttttgtagttttgttagagacagtattgccgtattgcccaggctggtcttgaactcctcacctcaatcaagtgatctgcccacctcagccccacaaagtgctgggattacaggcatgaaccaccaagcctggtccttggagttcattctggaaataagaaaataattttcttttgttaaaaatcctatgtacttgtagtgaaatattttaaagtctgctaagtgagaagatgcaggcaggtggaggcccttgtccgtgtgtggccttcagtgagcgtctgctgtccccaagcatcctcgcagcctggtgggtgtggcggccgcctcaggcgcagccaccacgtgctttcacaggaggactggtgtttgaagtgaaagttgtttttccttacgtgagaggtggaaaatggagttgagtttctgaggtggggcgaggctgtcggagctgcgagtgagtggcagaggctgctggtcacactgctgctgtcctctgcaggtacgtgctctactccctggacctgtacaatgacagcgcccactacgcgctcaccaggttcaacaagcagttcctgtacgacgaaattgaggccgaggtgaggcccctgcagctccatttctgttcatttccttcaattaaatctcctttctctttttgttttctcccaagtattcaactttctttaaaatataagacagtataaaccacgaagcaagcatgtgggagcaagcccttcctctgtggatatgcttccacgatgagtgcaggatgcgctttttcacttgaccgtgtgtcactgcggtgtctgtgtcctcatctatttttggttatgagcatgatctttgatgttcaactgaagcaactcctgttttatttctctatttttttggttttggattttataaatagcactctgctgcactccctggcatgttttttatttgcatcgcatgacttctataggacaaattcccacaggtggaattctcaggttagtgtatgcacatttaaggagatgaaccttattctacacatcatctcctctgccttctcacaaagaccacctgaaaatggtgcttcagggagatgtcacaggtccccggccctgcaggatgggaggagggcagagacgcccttcttggccctgtctgctgggcagatgggtcctgggtcccacttgccacgaagcacaggtattctcctcacagttccaggagatagtgcgaatcccatctgcaagtaagggtcttttgagggtacctcctgaccaatctcacacccagaacagccgctttgctccagggaaggccctcggtggtgcctcctggagtgcacagtaggcggagctgccccagggcaggaacccacctgcaatgcacagtagctcctcgtggtcactgcacacagtgaagagagccttgttgattctctcttgcatttcagagaataggaatatttttctccctcagtaagattggttctagcctagttttctgtggcagtgtggtagtcactcctggccacactgcagtttatttagtgtgctgttgttggacagtaagattattgctagtttctttagtttatttttcttttttgaggtggagtcttgctctgtcgccgaggctggagtgcagtggtgtgagttcaagcgattcttgtgcttagcctcccgagtagccaggaccacgggcacgtgccaccacaccaggctaatggtggtgggcacctataatcccagctactcaggaggctgaggcaggagaatcacttgaggcagagattgcagtgagccaagatcgcactactgcgctccagcctgggcaacagagcaagactccgtctcaaaaaaataaaagagcctcagttagttgccttaacgaaacattttgtttttcaccttgttatttgatcttgctttagggaatcaaactgtaacgtgtgctttctttttcttcaggtgaatctatgttttgaccaatttgtttacaagctagcagaccagatatttgcctattataaggttatggcaggaaggtgagtatctggtgtgtgattttgatacaaaacgtttcataatttgatctgacattcccattacaatttatggcgtatgaaaaactttctgtcttccttctacactagtttgcttcttgataaacggttacgatcagaatgcaagaatcagggagccacgatccacctcccgccgtctaaccgctacgagacgctgctgaagcagaggcatgtgcaggtgagctggggccgggctgtggtggggacgtagagtgtgcattgaaaagactgggttttcggctgggtgcggtggctcacgcctgtaatcccaacactgggaggccaaggtgggcggatcacctgaggttaggagttcaagaccagcctggccaacatagcaaaaccccatctctactaaaaatacaaaaattagctgggcgtgctggtgggttcctgtagtcccagccgctctgggatgctgaggcaagagaatcgcctgaacctgggaagtggagcttgcagtgagctgagattgcaccactgcactccagcctgggtgacagagtgagcaagactccgtctcaaaaaaaagaaaaaaaaaatgattgagatttcttatagctagctaggtttagatatcagcatgccttgtgactgtgaacgtccttataaattgttaggcattgaaagacacaccgtttctattgggtcacctcacacacagggaacacctgcagcattctgtatctgccctgcggctcctgggggcaggcatagcccggaggggtcagcccttctccaggagcccaaaagccagagcttaaaaagaatgaaggtgagaagcactcatcagctcagagtatcagagaaaactttctcctggccagcaggaagaatttaaagatatacagtgcttattttttacagcttttaaaaaaagattcacattgcatgcctgtattaaaacatctcatgtaccccataaatatgtacacttactgcgtacccacaaacattaaaaaaagaaaaaaaattaaaaattaaaagtgatgttacattacacacacaaaactagttagtaaaatatggaaaactaaaaaaaattgcatttaattctactctctatacacgaataatcatcatgcacatttttggacattttcaccagggctttgtcatatttttatgtagttagaacaacactgaagtatggatatgttcctagtaggccaaaatagagatggagtaattttatttatcgtcataacacctgtaaaaagacacacacaggctgccatgtatgtggggagatgggtcttgaacgtggttgtaaagggtgtcgttattgacagaccagcttctccagggtctctggtgaggcgtttgttgttttcgagctgctcatgtccactctttacctgccatccttccctgtgtacgccagctcctcggcagatcaatagacctcaatcgtctgatcacccagcgcgtctcagcagccatgtataagtccctagaactggcgattggacgatttgaaagtgaagatttgacctccatagttgtaagtaatttcactttgccctattgataaattggactaagggtaggtccagttcttgtatagatgataaaagagatgcactcatcgggcgtggcctataccaagcctcttgtatagataataaaagagatgcactcactgggcgtggcctataccaagcctcttgtatagataataaaagagatgcactcatcgggcgtggcctataccaagcctacactcagtgttcacaatgctaaattgacttaacaaacacataaccccaatcttgaaaaaatcgccaactatggcaaaaggtagcacaccacttaataacgtgtttacattttagtatgaacgagctaggagataaaaatgtttaactttggctggcacggtggctcatgcctgtaatcccagcactttgggaggcctgcgggggtggatcatttgaggtcaggagtttgagaccagcctggccaacatagtgaaaccccatctccactaaaactacaaaaattaggcgggcgtggtggcaggcacctgtagtccgagctactccggaagctgaggcaggagaatcgcttgaatccaggaggcagggttgcagtgagcccagatcgcgccactgcactccagcctgggcgacagagcaagactctgtctcaaaaaaaaaaaaaaaaaaaaaaaaaaaaagaaatatcttctttagggaccaagagagcccacaagggtcttcctgctaattcttctacccctacatttcgcttggctgtctgaattcatctcatctccaggtaaggtctaatccttctcctgttatctggaccttcaggtttcccagtgaggatgtgtgttcggggccaacgttccccgctcaccctctttgggcgctcacccatttttcggctgtctcacggagcctacagaggcaagccgcttccttcagagggtctttggattctctgctttcctggtatgttcctgtggtatttcttgaagcaaaaatttgcagtgtgagtcttcacacactgctgtgttcgtctgaatgggagctgccagttagtcctaccttctgtctgccatttttccctgtgtctctatcacaatttgaacacaggaagaggcaagactaaggaacaggaaaacagaggttaaaaacatctgaactggggaacagagaaaaataaaaatgaatgagacagaaaagagcataagaaatgtagaaaacagtggaaagacctaacgtgtaactggagtgttagaggagatgagagagagagtggtgtcacggaagacttgtctgaagagaagatggcagaaagaccttaacgtggacagaagacaccggcctgccactcaggtgtgccacccaactacacatgctggagccagggccggagccacagggggacctcagtgagcgggcccccgaaccacagctctgtggatcacctgaccaccccccaactctgaccctcggcctgtggtgcctttgaatctttaggatttaatcagagctagtaggcagtaagcctgaatgggctggttgtcttcccttctccagtgcgtggtcattggtgcatggccacacgtccgtttccactgtgggagcagggggagggtttacagtgtgcattttctaacaaaatgcacaaggtcctttctccccttcacccaaggagctctgggtctgagaactggttgaggagccatgaatttcttttatgatgattcaagttaggctggtattggtcggcctagggcttttccctttatccagatcaatgagacttccgaaggccgatcgtttgtgccagccctggggataccacagtcctttagtcaacactggcacccctgtgccaacgctggcacccctgtgagtcaggcaatttgagtacacatgagttgtgctgcccgccacctggcaccattggagtcaaggagcccaggctggtggcctacagagaataatttagacagagctcttcaaagatgcctgagatgagaacaggtttcagggagctaaaacagtaggccctgctgactctggaattgaataaatcaaaattccctcctaagacaaagctgcccatgggagaagctgctgggaatagcatgtaagctggtaagggttaggatcatggcggaggggagcatgagaggcaggtctcagaaggcttgagccagtgctgttactcttggccctgaccaacccctcttcctcttcagaagcatgagagagcttatttcacttccagtcgagccacaggtaaagatcatggtccaatcccctttagacgtattacactaaaaaagaaaatgtaagtgcacagcagtgtccctacagacagtggaggcacgtcagacagacacccacggaccatggaaactgtaacttcatctttcacagtgagctaaaagaaatgaagaaagtagtagttgctggccgggcgctgtggctcacggctgtaatcccagcactttgggaggacgaggcgggcggatcacgaggtcaggagatcgagaccatcctggctaacatggtgaaaccccgtctctactaaaaatacaaaaaattagccaggcttgatggcggacgcctgtagtcccagctactcaggaggctgaggcaggagaatggcgtgaacccgggaggcggaggttgcagtgagccgagattgtgccactgcactccagcctgggcaacagagcgagactccgtctcaaaaaaaaaaaaaaaaaaaaatagtagttgctgtgaaagaataatataaatgagaatttttagaaatccagaaataggctgggcacggtggctcacacctgtaatcccagcacttttggaggctgaggtgggtggattgcctgaggtcaggagttcaagaccaggctggccaacgtggtgaaaccccatctctactaaaaatacaaaaaattagccgggcgtggtggcacatgcctgtaatctcagctacttgggaggctggggcaggagaattgcttgaacccaggaggcagaggttgcagtgagccaagattgtaccattgcactccagcctaggcaacagagcaagactctgtctcaaagaaaaaaaaaaataaatcgagaaataaggttattggaaaaaagaaagttttgaaaagagaaaaggccgggcacagtggctcatgcctgtaatcccagcactttgggagactgaggcaggcagatcacgaggtcaggagatcaagaccatcctggctaacatggtgaaaccccgtctctactaaaaataaaaaaattagccgggtgtggtggcgggcacctgtagtcccagcttactcgggaggctgaggcaggagaatggcaggaacccgggagacagaggttgcagtgagccgagatcgttccactgtactacagcctgggtgacagagcgagactccgtctcaaaacaaaaacaaaaaaaaaaacagaaataagaatgaaggctgggcactcggtggctcgctcctataattccagcactttgggaggccaaggtggatggatcacgaggtcaggagatcgagaccatcctggccaccatggtaaaccccgtctctactaaaaaatacaataaattaaccaggcatggtggcacacgcttgtagtcccagctactcgggatgctgaggcaggggaatcgcttgaacccaggagtttttgaggctctgtctcaaaaaaaaaaaaaaggaatgaaaagagggaacatttttaaaatcaaaaagaaattaaagcagaaaaaggatttgagaggaaatgatgttctcagatgatcatcatcatggatgatgaagattcagtgtacctgtcatacagcttcctcaagaagaaaaccaaagcaacggaacagggccgactggcatctatttcaagaaaatattgataaaatagaagacaccttgaaagtgtctattaaaagcatacatcatgtatttggtaaaaccgacccaagcttgtcaacacttagaaatactgcatcttaggctggttgaagattagaaaaaataataataatacatttaaaaacggtattgcagtgaaagttttggactttccaggtgaggaagaagtccttgggctgtctgagcagggcaggcagggaaggaaaatccgattgtcctcagaccttcaccagagccaaggaaaggaactgtgaatcgagggtttggtcgccagccaaattgatcttctgagaataaaggctgcagacagatggtaatgaacgtgccagggctccagaggattgttcattcctggagaacagaccttggctggcagacactgggcgctggcgggcacagtgcgtgtccctgtgagcatctctgcacttcagagcagggccctgcgtattcatccttagagtcaaacaggctgggactcagagacagacctgtggcggcctttttctacgagcgtaatttggtacaggccatggtgtttctgttggcattggccaaatatgattttgagtaaaatcattggtcgaggctttgatcgaggccattactgtccaatagaaatagaacacaagtcagatccgtaatttgaaattttcccatagtctcattagaaaaggaaataggtgaagttatttttaataacatacttaatccactgtatccccatattaattcaccacgtcattcctatggcagtatagttgaggtgggtatttgctagtctgttttgtcctactcagtctttgaaatctggtgtctcatgtagtgcgcctcaggtgggagcagctgtgctccggccccggctgccacatcggacagtgcagcctgggcgagctccagagcagcgcacgtgagggcttgcaaggcctgtgggaacaagtgcacctgccctgccacccacacgtgcctttcagtgacttcaggcacctcagagaaagctggctcagctccaacgcccagggagatgcagccgccggctgggttatactgcagggcagggccggggctcagcgggcacatggggggaagggtggcagtagcaggccacacgtgcacgctgccccacagggtgctggacagcaggggtaggtggcgtggaggtgactgcagtggagaaaggcatgacccagtgggggtgactgaaaaggtggggtgccaagaagcaagctcatgtcacctgtcagagcctacgctcactgggggctgcctccgtgcagccctgccagggactgtgaggcctgggtgggatcagaggccactcggcgcctccttcctgcctggaccagctctgtcacccacccctgtctttggtgccacaggagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtgagcgtgcccgccacacaggcgcccacaggcgaggcgctcagggacccatgtccccgcaggcttcctccatgtcaccaggtccctgtctccctgctcttgctgctccccatcacttctcacatgaagagcacgcaggccctccagtgtcttctgtgtgcacaggcagcctcgggtctaccctcgggtggatggtcatggctttgcacgtggggcttgcgtggggctgcatctcctggctttctgtttgcctgatggtggaagtggggtgagtctgcttcttatgcttccgtgctggcatgttggagtgtggggaagccaccctcccacccaccgcccatggacagcatgaagtgatgtgattggtggtgaaacggtggatgctggcagtatcctgaggttcagcctcatagtagggcctgagtcctgggacagccctgccctgggctccgcacaccgggtggcggtcattctggctgaggttccttctctgctcactgagctcagcatctatacagtgtcagcgcgtgccagggacatgtctgtgtcacccaccatgccttcccatagacaccaacagcctggggggatgaccagggcaccaagcaaggtgcctggccactgagctccatccagacgtagaggagtgcaggtgtgtgcacatgcgagtgttaggagcacttttacaaataagtgcttgtgcttgcctctgatctccgcgtcccacccacatgtggctgaattcttactgacttgtaggcccagagttttgtgtctcaggagacaggatgccgagctctgatgagagctctgatgagagagaggagaggcgcagctgccccacggcccagtcctgcctgctgtggctgtcgtctgttcaggacccctgggtgcaggaccgcgtttcctgtggggccgtgggtcaggcccaggtgtgttgcatcactgaggccattctccagggtcatggccacgcgctctgggctgcaggtggcagcacctggcttggcttttcagctcagggggcctccaggccgggctgggagtggtccatggaaaccaaaccgtgaagaccaccgtctctgtttaactcacctttatggtgtccattttcctcaacatttttaaaagatgtttatgcttggaattaattgcaaaaatattcttacacaagtaatatatcaaaattatagaaaaatgggaaatcatggatacataggagagaaaaatgagtgaactccccagaggtttccttggtaaaaatgtatttgtcctctaaagtgaggcatgggcggccctcggcctctccatcccgagtctgcacccctgcagtaccacatacatcacagcagcagggaggggatggccaggcgcctccttccccacaccccgggaggtgacgtgaacacttctgtgtgcagatcagcacggtgcacccagtgccatgcgtgcagctgctcagagccatctgctggggccttacacccaggtagctgcactcgtccccactgtgggcggcaggaggcccctggacccatgggggaccctggacacaggcaggctggttccatcttatctggaaaccaatttcatgtgtgtcacctgtttccccaagagacccagagctgctgcctcgggccatacctgttgggcagaggtcagcatgcagtgacctcagcctcctggtgcctggggacacttgaggtgtgattcacagggaaccctagcttgtcacaggggcattttctgcagaagagctccggtttactcagcaacctccaccttccgtgagtgttggtagaagccattgtgtctgcatttcccacaagtctttggtggaatcaggagagctgtgttatctgggaaaggcattttaaaacaggattttgcgtatccaagttctgtgtcgaatcctgagaagacacataaaccatgctacccggaattttagtcccatgcctgagggttttctgagagctacatggcacaagccaggactttgctcgttgcctggcctaacttccggttagtgagctacgtgtggtggctctaggaggtgacctaggtggtctgcgactggaatttaacctgtacagtgggtaaatgtgtgacagtgctgcagctctggaaagaagctggcagaagggtatttcctcagtccagagttaggcctcttttccagaagaccatagatggagggcgtgtcctcagcggggcgcacctggagcccaaggcggcaactgtcccctcactgctcatggtgacttctgtccctggggtgaggtggtggctgccaggtgttcccactgtcatgttaccatttttctgtttaaaagttataatttgtagggagataatttgagatgatgtaaacaaactccctcattaaaatttgtcccggtcgttttaacatctgtcgacgattcctgtccgaatcagttatcttcacactggtggttgaacagcagtgagttgtttttttggtttttttttttgtttttttgtgacagagtcttactctgttgcccaggctggagtgcagtggtgtgatcttggctcattgcagcctctgccttccgagttcaagcgattctcctgcctcagcctccggagtagctgggattacagatgcatgccaccatgcctggctaatttttataattttaatagagacagggtttcactatgttggccaggctgatctcaaactcctgacctgagatgatctgcccgcctcggctacccaaagtgctgggattacaggtatgagccaccgtgcccagctgagttttaactccttcattccctctgcaggtactagctggaattctgctgtacgtggtagcatttgtttattatttgcttatttgtactaaggattatccattactgtggagttttgaggctggggtgggtgcggtttgggcagtgggagctgcctgcttggtttcagtctcctggggccgtctccaccattctttctgcaccacaagatgttccaggctcggccaggcacggtggctcatgcctgtaatcccagcactttgggaggccgaggcgggcagatcctgaggtaggagaccaagaccattctggctaacacggtgaaaccctgtctctactaaaacaatacaaaaaaattagctgggtgtggtggcgggcgcctgcagtcccagctacttgggaggctgaggcaggagaatggcgtgaacccgggcagcggaggttgcagtgagccgagattgcaccactgcactccaccctgggcgacagagtgagactccgtctcaaaaaaaaaaaaaaaaagaacagaaatttattctcttacggttctggagtccagaagtctggaatcaaggtgtcagcaggaccacgccccctctgagacactgggtagagctgttacttctggcggtgacctcagttctgggtgttcttggcttgcagtggcatcactccagtctcctctctgtcttcacttgccactgtccctgtgtgtctctgtctcttctcttctcgcaaggacttcagtcatattgggtcaaggacctaccctgctactccagtatgaccttgtcttagccagacacatatgtggtgaccctctttccagcagacttcacattctgaggtactaggagtgaggattgaacatatctttttcgacggagtctcgttctgccacccaggctggagtgcagttgtacagtctcggctcactgcaacctccagtaggttcaagcgattctcctgccacagcctcctgagcagctgggattacaggtgcctgccaccatgcccggctaatttttgtatttttagtagaaatggggtttcaccatgttagccaggctggtcttgaattcccaacctcaggtgatccacctgcctcagccttccaaagtgctgggattacacgcatgagccactgcacctggacgaacatactgttttcagagacagtacaacccatagcccacatgtgcatgtgtattagtccattttcacactgccgataaagacatacctgaggctgggcgatttacaaaagaaagaggtttaatggacttatggttctacatagctggcgaggcctcacaatcatggcggaaggtgagagggatgtctcacatggcagcagacgagagagagcttgtgcagggaaactcaccttttaaaaccatgagatgtcatgagactcactcacaatcatgaaaaaagcatgggaaagacctgcccccattattcagttacctcctaacgagtcccactcatgagacgtgggaattatgggagttataattcaagatgagatttgggtggggacacagccaaaccatatcaatgtgcatgtttatttctatatagttacctacgtattaaaactataagtttatactgatatttccaattccatttcagcactgcagagttcattctagtcttctctctttccctttttctgacttcattaaacactgaggatccttgcttcattattcttagtatattactcatttgctcatttccaaaaaaacacagaaagtagtttcagaattgctaatcctggctgggtgcagtggctcacacctgtaatcctagcactttgagaggccaaggcaggaagatctcttgagtccaggagttcaagaccagcctaggcaacataaggagacctcgtctctacaaatttttttttttttttagacagagtctcatgctgtcacccaggctggagtgcagtggcacagtctcggctcactgcaacctctgcctcccggattcaagcaattcccctgccttagcctcccgattagctggactatagtcgcccgccaccacgcccggctaattttttgtatttttagtagagacggggtttcaccattttagccaggatggtcttgatctcctgacctcataatccgcccacctcagcctcccaaagtgctgggattacaggcatgagccaccgtgcctggtctacaaaaaggtttttaaaattagctgggtatggtagcacacccctgtagtctcagctacttggaaggctgacatgggaggatcacttgagcctggggaggtctaggctgtagtgagctgtgatcatgccgctgcacgcccgcctgagtgacaaagcaagaccttgtctcaaaataagaaagaattgctcatttttaccaccgtaaaacacaaacctgccaactctagttcaatatttgttatcaaatttttatctttagattgagaatatatagtaaaatattatgtttaaaattcattagccgagcatggtggcacacatctgtagtcccagctactcaggaggcccaggcaggagaattgcttgaacccaggacatggaggttgcagtgagctgagattgtgccactgcactcccctgggtgacagagtgagactctgtctcaaaataaataaataaataaaattaaattaaattatttggaatgatagagtaacagggtttagatttattcttactccttaagtgaaaaactggacaggacgtatggatcagctgttttcagactcggaccttttgctgaggggacggaagcaagtgaggtgagccctgtgatctccctgacttccatctgaaagcactttctggaccaagttcagagaggaacagtccaagtacagcttggaagttcctgattggtagaggggacaaactggaacttggggaagctgaggcagctggaatttgcagggtggcatatgagagagcagggaccttaacagaaacagctcctgaaaccacatgggcatcccatagcctttgcttgaatactaaactgtgcgtgtgccagggagctgctagctgaatgattctcagcgttcacacaaggccaggaggcttctgagttcctactagcaagaagaatggaactctgttgaggctgggcacagtggctcacgcctgtaatcccagcactttgggaggccaagacaggcaaatcacttgaggtcaggagttcgagaccagcctggccaacatggtgaaactccacctctactaaaaatacaaaaattagccaggcgtggtggcaggcgactgtagtcccagctactcaggaggctgaggcgggaggatcacttgaacccgggacgtcaaggctgcagtgagccaagaatgcgcgactgcactccagcctgggtgacagagactatctttaaaaaacaacacaaacaaaaaaaaaaaacaaccctgttgaacacccagatgttcactagaggtgccagaggtactgaattatgcccatccctacaagtgccaaaaattcatcatgacaagatccagcagattgacaagtaagtcaactgcctgccccccaagacattcaacactctctcttttttttttctccctattcttgccattctggatttcagttagatatatgttagttagaccttctcattttattctccacgtccctttgttgtactagttttcctttttttgcggggacagagttttgctcttgttgcccaggctagagtgtaacagtgtgatctcggctcactgcaacttctgcctcctgggttcaagtgattctcctgcctcagcctcccgagtacctgagattacaggcatgtgccaccacgcctggctaacttttgtatttttagtagacatggggtttcaccatgttggccaggctggtctcaaactcctgacctcaggttcaggtgatccacctgcctcggcctcccaaagtgctgggattacagccgtgagccacctcgcccggccaacactctttaaaagacagtaacaaagtcaagacatgcaacatggcactgaaatgcccagtgcccaatcaagaattactagatatgccaagaaccaggaaaatgtgacccatagcccagagaaaaatcactctgtacaaaacagacgcagaaatgacagagatgatggaattcgcagacaaggatgttaaggcagcgactatgcatgtgctcaaggattcagggaaaacaatgcagagataaatgggtgttatataaataatccagtgaattaaagctgaaatgcagtatctagaatgaaaaattacttgttgggccgaatatcagagtagactttgcgggagttgagtgagtttgagattataacagtggaaactagctgaactgaagcaccaaaagaaaaaaatgatgaaaaaaacgagaagggcctcagcaaactgagacaaacatcagcgattctaatatgcctgtgattggaatcctagtaagaggttgtcggggggcagaaaagatttcaaaattaatgcccttgaatttcccagatttgatgaaaacgataaacccacagatacaagaagctcaataaacctcaagcaggatcgacacaaaggaaaagagccactgttgggcctagcactgaccaggtcaaaataaggctggagctgaacctcagtgtacccgaggcaacgtgcagtgggggcttaggatattggtgctgaaacttagttttcctcttaggggattgcagtgacattgtcaaactgcagagtctgagggcacagtcctccacaagactgcctttgctgcagacaccagccacacatttggggtccctggggccaccctcacttctaaccagcaggttacagttcaggatccaccctccccagctcttcaggtgacacattcgcagtactcactgggcgtgccctaatacgattatagtcaattggaggaaaggatgcttgttggaaggatgtgcagggcaaagtctgggaggtttccatgtgcaaagctttccctgtcctcagggacgcatcaccctccgagctctgaggtgggacgctcctcagggtactgccagccaggggcgctcacttgggctgtggtgttcagtttttattggggcttcgttgcatgggcacagttgactgaatcactggccacgtagctgagctcagcctccagcccttcacctcccaggaagtcagctgagttcaccaggcacacagccccaggcctctaaccccatgctgtctttctggtgtggccagccccatgttgagtcatcttgctagcataaagtcaggtgtggccccgtgataccagtcattcctgtcactcagaaatgagggtgtagagactgcctcctagaactgggccagaggccaccaaatcctacccaggagtcaatcagtatctaaacttgataaatcaagaagaagttgtagaaatgtattatttagaaatatagaggccgagcgtagtggctcacacctgtaataccggcactttgggaggccaaggcaggcagattgtttgagcccaggagttcgagaccagcctggccaacgtggcaagaccctgtctctacaaaaaatacaaaaattaaggccaagcacaatggcttacgcctgtaatcccagcactttgggaggccgaggcagacagatcacgaggtcaggagatcgagaccatcctggctaacacagtgaaaccccatctctactaaaaatacaaaaagttagctgggcttggtggcgggcgcctgtagtcccagctacttgggaggctgaggcaggagaatggcctgaacctgggaggcggagcttacagtgagccaagatcacgccactgcactccagcctgggcgacagagcaagactctgtctaaaaaaaaaaaaaaaaattagccaggcatggtgacctgtagtcccagatactcatgaggctgaggtgggaggatgacttgagtccaggaggttgaggctgcagttagtcaagatcacaccactgcactccagtgtgggtgacaaaaaaaaaaaaaatatatatatatataaaatatataatatatacatatagactataaatgtatatatataattatatagaataaatacatgtattatgttatgtatcatatatatgtattttgattaaaattttaaataatattataaagagtaattgcattacttcaacagttctgtatctgagttatatcatagacaaaataaattaaggcctgctttctaaatttaaccatcattttaaacattctaagcagggaaaacattgtgttctaagcagacatagtagtaaagcctcctctaggccgggcgtggtggctcatgcctgtaatcccagcacttcgggaggccaaggtgggcggatcacttgaagtcaggagttcaagaccagcctgaccaaaatggagaaaccctgtctctactaaaaatacaaaattagccaagcgttggtggcacatgcctgtaatcccagctactcgggaggctgaggcaggagaatcgtttgaatccggaaggcggaggttgtggtgagccaagatcacaccacagcactccagcctgggcatcaagagcaaaactccatctcagaaaaaaaaaaaaaaaaaaaaaaaaaagaaaagtctgctgtaatataagtggcatcatatcctggcgcttggctccctgcatggatttttactctgattttccatttgttgtcttctcccgcaccccgccgtcaccattgtaggtggacggaggctgacgtgtgtgccgtagctttgcaggtgtgtcaccatcggaggtggacagaggttgatgagtgtgccgtggctttgcaggtgtgctgctgtcaagggtgtgagcagtgcccaggaatctctgggaaatggggttcccttttctgagcatcaccctgaccgtagcgcctcctgatggaatgtacttcctggaacgggtgttaagaacacaggcgcagggacacacagacatgcacacatcctgttgcagacacatctgcagataacacatctccatacatggactcacgcagatgcaggtgcacagagacatgcagacagacatgcatgccaagcactgaggactgtggcacccagggatattggcatactgacagcacagggatttaggatccgtttggaaaggcatacccagaagtactgcggtaggtggtcagggggcctagtggctgctcctctgtgcagcacgtcctctcagatgcacacattgtgtgggacagcagtattttcacaattacatctgtttccatttcctgaagtggaatatgagttaatcaagtgcttggaattacataattagcaaatccacaaaattgtctttcttatacttctttgcaaaagttttatgtgtttaaacgaacccttccaatttgaaaggcttagctgagtttgatgtttctgcatgaaaatggacacattcgattttaagtgtcccctaatccattatcaagacacaatctcttgactaattgagtgggttacaaatacctaagtgtccctgtccttccctgctggtgtgtaacttgtgatctgaaccaccggggcgtcgccgttctcgtcacaggcagctgccccaccgtcctcgccgtgtctggaagcgcagcagagcccacgagctacctgaggattgcgttgggctcgaggcggctctggtacagcagaccagaccccgggtgttcctgctgtggcccctgagctttgggtgcatttattatatttgagtattgagatctcattcgttctatggttttcgattcactagaattttcctatttgatgattgtatcagttgactgggaggaagatttagtagatggattatggaggacttctgaattttaaagaactattgttaaatttggtttctttttcttttttaaatctttcttgtttaggtttgttcggacagtgttaccattttctcaggaatttcaaagagataagcagcctaatgcacagcctcagtatctgcatggatccaaggtaggctccaatgtgttcgtgttacgagcttgaagctcataatgaagcatgttttgaagtgtagtttaattggtttggttgcagtgacctaaatgtatcacgctgtgtataaaatgttattttttttttccattctgttaacatcttcctgaaaagtagcagtaatttaaaacaaaaactagccaaccaacccaaaacagtgcttatctagaactagcgcgtacgtagtgttgggacagctctggccttgtgataggtgtcaggctgggcctggtctctttcccagcacaaacacaagtgagattgttggaagattacaggtttaaaaacatcaagctgagaagacaagtggaagaggctcaggtgcattcctgagataaggaggcccagggtggctgtaaggcctgaccggaggagcggagctggaaaggtgagcccagggaaggtctgacatccagaaacaaggatgtccgcctgtgcctggagggtggaaacccggagcacccgggtctaccatgtgtgagataggatgatgtccacgctgggggtggcttggcttgtcacaagtctgagtattattaagggctagtttcttcacgtttcaagcacccgtgtgatttagtaaggaaaatataaacattgtagcaacgaagagagatgaaatgagcagataccccacaaaaatagagcagagcaaatacaagcagatccccagcctcagcggagctggggaaggaacaatgatggcggcaagagccagcaggcccccaggatgaggccagaggatccggctcgcctgtgaagagcgaaagcgtcttccctctgcgagctgcggtgtccccgggctctgcggtgggggcaggctgccagcactcatcagtatttaagtgtcctcgcttgtaggaagcggggacaatcacaggacattgtctgccccatctgcccaatgcctggagctgggatggagagggcccaggccctgccgctcacacgctgcctgcacctggacgctttctaacgcaccagctggctctgagtggcggaaacaatgttttccactcattcctttctaaccctctgttcttcagagcgagatcttctcactccagtcctttgggcgtcttccttctccttacagggcagtgccttggacctggcaggagcgcaagtgtttgcacctgggaaacggcaaacacccaaatcagggcattggtttttggagggcccaagcctcggcatacgctgcccgtctctcccgcccctgaaaagagcgagtgtgggccgggggcggcctttttacggcactcagagcatctctgagcaggagagacaggtcgtctgaactgtgtgcagtgatgaaggggatgtgagattcctcttcgggaaacggggcccacgtggaccaagggtgactgtgtaaacattatgtccttgaaaatatgttctttttattttttatttttttgagatggagtctcactttgtcgcccaggctggagggcagtggcatgatctcggctcactgcagcctccgcctcctgggttcaagtgatcctcctgcctcaacctcccgagtagctgggattacaggtgtgcaacaccatgcctggctaatttttgtatttttggtagagacggggtttcaccatgttggccaggctggtctccaactcctgacctcaggtgatctgcccgcatcggcctcccaaagtgctcggattacaggtgtgagccactgcgcctggccatctttagtgttttaggggttattttttttagcaatgttatgatggcaattgaaaaaaatacaattcagatcctctctagggtgcagatgtttgaaggaagtgggttcttgcctttcacaaagacaaggttaaaggtgggggtgggaggtggcattgcctgccttggggagaaaaatgtcagggctgggagcctcgctgacacatgagggccagggtcgccaatgcctggagaacatgggacaggctcattccatcattccacactccgcgttctcgaggctgttggcaggtgcggcctccgctgtgcccctccaccctgtctctgttcgtgttctcgaggctgttggcaggtgcggcctccgctgtgcccctccaccctgtctctgttcgtgttctcgaggctgttggcaggtgcggcctccgctgtgcccctccaccctgtctctgttcgtgttctcgaggctgttggcaggtgcggcctccgctgtgcccctccaccctgtctctgttcttagcaactcctaatggctgtggaactgtgagtggacacacagttcgtgtgattctgggcttcatgtggctgtgttggtgccccaggagggcatccagacaggtacccaggcgccaagaatgcagtgaccgggcctctcctctgtggggcagggtggggtgcacgcctgggcaggggtgcgccacagctgttacggggctccccctcacttcccgaagccctgtgagtggttaagaattcacctccattctgctccatgtgatactcccatgttctttctagcaaggattgaagttgacttttctttttttttttttttttgagatggagtctcctctatcacctaggatggagtgcagggcacaatctcggcttactgcaacctccacctcctgggttcaaacaattctcctgcctcagcctcccaaatagctgggattaaaggcgcctgccaccatgcccggacaattttttgtattttttttttttttagtagagatggggtttcaccatgttggccaggttggttttgaactcctgacctcaaatgatccgcccaccttggcctcccgaagtgttggaattacaggcatgagccaatggtggtgcccagttgaagctgacttttatgcaataattagttatactcaaaaggatgtttctttaaaggattagagtaagtgttctgaggcttctgcttctgaaagtaaaatgtagtgttttacctttagaactgaaggaaatgttattttagaagataggactagaaagtttggcgagtgagaataatttcttgggtctctgtgaactaaaagatttgctctgggcttctcttgactttgaaatttttaatccctgttttaggcataacaataaagtaggtttttgtcactccctgatagagaggcatttgtgcgcagagggcactgggcagagaggctcctctgtcacccccatctggagaggatggctgtggaagcgagggaggcaggcggggggtaggcaggcgacccgactgcgtggggccgtgcacctgcggttctgatggatcgagtcctggaaggggcctcgtggggttggtttttgagatcccaggatagcactgtggtgacatctttgctgcccagtgtgtctgtgtgccctttgtggtgttaaaggctcttgacacacgtttttattctccaggattttctcccaggagtgcagggaggcactgttgcttccattaagatgccaacatgagcgcgctgttccagggtggtggtgcggggtgcacatttgccttgagtcagcccctacactgccagagcaccctgctgccctgtgtgcatgggcaccacctcagggatggctccagggaatgggcacttggaggcatttgcaaagctgatgctcttttggagagaaagaaagatttgatgatgtgaatttgatttttttttaaattcaactatttgcaactgaacttgaacctcactgtaagagatttctgcctccgtttcagaaactgtttgtgtcgtttttgttaaaacctaagctagtacatggtttttctttttgttttttgttttttttgtgtgttttttttttttgagacagagtctgtcccctaggctggagtacagtggtgtgatcttgcctcactgcaacctccagtgattattgtgattccagtgattcgtgtgcctcagcctcccgagtagctgggattacaggagtgtgccaccacgcctggccaatttttgtatttttagtcgagacagggtttcaccatgttagccaggctggtctcgaactcctgacctcaaatgatccacctgcttcagcctcccaaagtgctgggataaaggcgtgagccactgtgcctggccataaaccagtaattttttttttttttgagacagggtttttgctttgtcacccattgctggattgcagtggcgcaatcacagttcactgaaacctccgcctcccaggctcaagcaatcctcctgcctcagcctcccaagtggctgggactacaggcatgcaccaccacatctggctaatttttgtgttttttgtagagatgggatttcaccatgttgcacaggctggtcgcgaactcctgagctcaatcagatctcctgcctgggcctcccaaagtgctgggatgtagccgtgagccaccgtgcctagtcctaaaccagtaattttctattagattatttagacatatacaagtgacactgatgttgaccaccacccactcaagaagaggctggatactaaaagagatgatgtctgagctgagtcatgtgctcacagcagacagcccttgtactcacaagcactcacatatgccacgtgcacttgcttctgctgcagtatgagtcacagtgtatatctgtgtgattatggaatacacaggaatccactcaaaaaacagattagtgctttttttatgaatagtgaactagggctggtatcttgcaggaataaaataaacttagatgagggacccatttatgcaatgttatctttttcgttcttggtcatgtcaccacttacagcatgcctgcttctcagtaagacacccttttgagcacattaactagtattctttatctcataagtaagattgtccccatttcacagatgaaggctcagagtgtcgtgaaagttagagcacccaagttgcacgactggcgagtccagagccggctctgtgtgctgtgacccaccttctctgcttgtcgaacaaggctggagactgtatcaggcacgggcagcagagtctgtcttgaactgagctgtgtgactggacatccagagtgcttcctcttctgagcttaagtcttttacagcacagtgtttgtgacggtgcccttccccagaagtagtgcctcctcccactcccctgagtagttaagtcacatctgctgtttgttaccctagctgtgttgtctctcggatgtgtcatctttggggtgagcttagtctactgggaaaccggacactgggcagggggccagaggcctgggaccatgtgttcattgagtgatgcctcctctgacagctgtcatcctgagccagtcagggcgggtctgagaatgaattctctcacttgtaacatgaggtcattagatttcactgatgactttcgtgttcttcttttcaaacattgaacctgttatcaaccaaaaatattacacagaatcccagcacataaagcccagggtgctgctctgaggagaggctgggaggagggggtgtgggcgaagatgtgtagatggtttcttcaaggttgcagcgggccgcagggcttgggcctgggacagacactgggtggggtttctgtccttcagtgttgtctaatctcgtcactgtaatcagttttggctctttgttttggggggtctcatgaccctctacacatctgataattcactagaaggactcacataactcagagtcttacagctgcagtttattccagcaaaggggtacaaagcaggatcagtaatggaagcagacagatcaggcggaggctgaagaaagcaggagtggctgtattaatataagataaaatcaacttcagagcaaagaatattgccagggagattacataataataagtcaaaccaccacgaagaaaacatagcaatgctagatgtttatgcgtcaaacaacaaggcttctgtacttgaaggaaagactaatagaagtaaaggagaagtgaacaatcccacagttacagttggggacttcaactctcattttagtaattgacagaacaagtagacacaaaatcagcaacagtagaaaagaactgaacaccaccatcgaccaacaggatctaactgacgtgtgtaggttcctctaccccacaacagcagaatatatacgtttttcagattcccatgaaacattcaccaagatagaccatacgctgggccataaaactcacctcaacaaaatttaaagaactgaaatcctatggagagtgttctccaactacaatgaactcaaaccagaaaccaataataaaaagataaccagaaaatctctatatgctcggaaattagcacacttttaaataatccttgggttgaagaggaaatctcaagagaaatttaaaaatacattgaattgaatgaaatgtaaatatatcaagatttgatatatacagctaaagaagtgatttatttgatttgattattcgatttatttatttgatttatttggtatacagctaaagtgctgagagggaaatttatagcactgaatactcacagtaggggtctcctgctatctgcacccgtgtccttagacaagctgaggggtgtccttctgcaggaaccaccttgatatgttttggctctatgtccacacccaaatctcatctgaaattgtaatcctcataacccccatgagtcaagggagggacctggtgggaggtgattggatcatgggggtgacgatgttctcatgatagtgagttctcacgagatctgatggttttataaggggttcttcccccttgctctctcttctcattcctgccaccttgtgaagaaggtgcctgctcccccttcaccttccgccatgattgaagttttctgaggcctccccagccatgtggaactatgagtcagttaaacctctttcctttataaattatccagtctcaggtatttatttttagcagggtgaaaatggactaatacagtaaattggtactggtagagtggagtactgctataaagatacctgaaaatgtggaagtgactttggaactgggtaacaggcagaggttggaacagttcggagggctccaaagaaggcgggaagatgtgggaaagtttggaactctctagagacttgttgaatgttttttgtttgtttgtttgttttttgaaatggagtctcaccctgttgcccaggctggagtgcaatggcgcaatctcagctcactgcaacctccgcctcccaggttcaaataattctcctgcctcagcctcccaagtagctgggattacaggtgcccaccaccatgcccagttaatttttttgtatttttagtagagacagagtttcaccgtgttggccaggctgttctcaaactcctgaccttgtgatccacccacctcggcctcccaacgtgctaggattacaggcgtgagccaccacgccctgcctgttgaatggttttgaccaaaatgctgatggtgctatggacaataaagtgcaggctaactaaggtggtctcagatggaattgaggagcttgttgggaactggagcaaaggtcacttttactacactttagccaagagactagcagcattttgccccgccctagagatacgtggtacattgaacttgagagagatctgaaattggagtttgtttaaaagggaagcagagtataaaagtttggaaaatttgcagcctgaggatgtgatggaaaagaaaaacccattttctggagaggaattcaagctggctgcagaaattttgaatgtcaatcaccaagacaatggggaaaatgtctccaggacatgtacgaggcagcccctcccatcataaacccagaggcctaggagggaaaaatggttttcttggctgggcccagggcctgccctgcccctatggttccccctcccccacctccccaccccaccccccatccccgtgcagcttcaggacttggtgccctgcatccctgcttcctggtcgctaaaaggggccaacatacagctcaggctgttgcttcagagggtgcaagccccaagccttggtggcttccgcgtggtgttggaccacctagatttcaaaggacatgtggaaatgcctgaatgtccatgcagaggtttgctgtgggggtggagccatcatggagaacctctgctagggcagtgaggaagggaaatggggggttggagccccacacacagagtccccactggaatactgcctagtggagctgtaaaaagagggccaccctcctccagaccccagtcagcttgtactgtgtacctggaaaagccacagacactcaatgccagcctgtgaaaacagccaggagggggactgtaccctgcaaagccacagggtggagctgcccaagactgtgggagcccacatcttacatcagtgtgacctggatgagagacacggagtcaaaggagattattttaaagctttaagatttaatgactgccccactggactttgggcttccatggggcctggagcccctttgttttggccagtctctcccatttgcaatgggagcatttatccaatgcctgtacccctattgtatctaggaagtaactaacttgttttttattatataggctcataggtggaagggacttgacttgtctcagatgagactttggacttggacttttgaattaatgctggaatgagttaagactttggggcactgttgggaaagcatgattgagatttgggaggggccaggggcagaatgataaggtttggctgtgtcccccacccaaatctcatctccacttgtaatccccattatgcccacatgtcaagggtgggagctggtgggagttgactggttcatgggggcagttttccacatgctgttcttgtgatagtgagtgagttctcacgagatctgatggttttataaggggcttcgccttttgttctctcttatctttcctgccttcttgtgaagaaggtgcttgcttcccctttaccttctgcataactgtaagttttctgaggcctccccagccatgtggaactgtgagtcagttaaacctgcctttttttttttttttttttttgagatgaagtctcgttctgtcacccgggctggagtgcagtggcgcgatctcggctcactgcaagctccacatcccaggttcatgccattctcctgcctcagcctcccgagtagctgggactacaggcacctgccaccacgcccggctaattttttgtatatttagtagagacggggtttcaccgtgttagccaggatggtctccatctcctgaccttgtgatctgcccacctcggcctcccaaagggctgggattacaggtgtgagtcgccgcgcctggcctaaacctgcttttttttaaaataaattatgcagtcttgggtatttctctatagcagtgtgaaaacggactaatacacaccctaactaccttcctcgccttcccactccacaggggtctctctcccggctccgggggtgccctgtgcatcctgagaaggcagctcccccggccccttcagggtccgaccttgggcatcctgctgggagactgggaggcagggggaaactctgggtcgtattcatttctcattctagacttcaaaatggcttctagcgagtcggctattcaacaaatgttgaaacaccaaatggttttcttttcttttctattttagcaggtttctttttggtggcaggctaagtaggttttgtaactgtaccagttaagggcagtagattttacaagtcagtagactcagacccgctcacctgagcctgtgtgtgttgagtgatcttctcacacagttcttcatctgcacatgtgtgcggggaccatgctgagagctctgtgccctgttttccaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctggtgagtgttccctggacatgcttctttcacacagcctggattccctggggcacccatgccagagggtcttctctgcctggactgtgattctccaacagctggattcgttcaattaggcttcaaacatttctgaccatatatagtttgatacttccctcatcttttcaaactcaagagaatgggtccaggttattttaactgatacgcagagtttttatttgtatgtgtagagagggggtcttgctatgttgctcaggctgtccttgaactcctgggctccagagatctgcccatcttggcctcccaaagtgctggggttacaggcgtgagccaccttggccagcctggatttagttttctagacataacttactttttataatttttcatcctttttattattttaatcttctgtgacttgagaccatgtaagagtttggtcacttggcacagccatcagcccgtgacccaaacaggtccttccaggacccgctggggactctgtcccaaaacatgtggcagcttggagggtgttaggattgctgacctcaccacagctgagcctggggccgcacccaggagcacagacagcgtcctgggggaccctggagctggcagtgctcacgatgctggggtgcatccccataggagacacctggcgacaaagctctcccctcattgtggcaccccgggaccactttcatcttgaaagaggagtccagtttcagaacatgaattcagtcatgggaagccacctggtgatggttgctctctctcccggggtggattttattccccagccagacgatcctgcagccttgctggttaccgagctctttgctaacagacttgtttcagggtatgcgccggccacaggcgttagcagagcggagtggggtggctgacgcagcccgtctcatctccccggcagctgcaaggcacaatcctgcagtacgtgaagacgctgatggaggtgatgcccaagatctgccgcctgccccggcacgagtacggctctcctggtgagtgcgggcgtgtggagctcacagtgctgtctgtggagaggtcagaaaggaattcaagtcagaaattcttgagaaggattagatttgccatgtgggaagaggcagtagacagacaaatgcaccttacaaccaggaagaggtgtgttggggtcactgtctgcaggcgaggaagcagaggtcagcctgcaagagttgagacaagagacccctgaacaccacgctctcgggcacccctacgaaagaattgccacccaatgaggcgagagagccgactgctgggtcctgctgccctgctgggcctatagggacttgaggctcagagacaggcccaccgagatggtgcaaggcctgcccctgcccccaggccgtcccatccatctgcaggtccagctgcagggccctcaggcaggtgtgctcttagggacaggcccacgtgacttgctgtgggttggtttggggcaatgcaaataaatagctttagtgatctcagaaagcattgtctcataaaattgtatgacagggacctttgtcacgtaacaaaactgcttttagtctcttacctggccgagttttcttgaaagctggacagttgaacactagccttgtgttgtaaagcgacttgagcctgcacgtgggtgaccgacgaggcactgtcctgatgggcagtcagtcagcgtggctgagctcttgaacacgtggctcaggactttttgctttttggcaactccccagggctgttgctggtgtttgaggagacgataaggtgtccccctcagccaccatggggaagtagccatcagcacggccctggctcaagagaatctgttttcagtttattgtcagaaagtagaggaggaatgctgggatgattaaaaccaatgcttatgtcgtgactagagatggaaatttcagatgttgaggagggagccatttcccagtgtggtacagggaaagcttgctgggaatgacacaggtgcatgagcgtccccgcccccacccccgccaagtggggctgagtccctgcagcggtgctgagagctgggaggagcagaggggccgtgtcgggccgctggtccttggggaaggggcactcgggcaagacctgctgggacaagggtttaaggtctgctgagcctcccgctttgctcttcccagggtagtttaggcccctcctgatgccacgttcattgtgcggtcagctgccggtttctgtctgggctggagttgaagctgtagattggctgggaaacgttggccttctgtcccatatttgcaccttgcgtctttttgtgccttattccgctgtccgggatgccgttgagacgcctgccttgctctggagctggcctggtgtgcggcctcccgttgggcgtgctgttagttagctgcaggcttcctagatgccctttctcagattaggtgcggccccttccatgcctgcgaagagagattgcattttgtcaaataccttgtctgcccccactggggatgtggtgcagtctttgttcttgtcatgtggtgacgtttcctatcatcatagccttccctaaagatatgaggttgagttgaaaagaggcttcagagccaaggcccggggtcacatggtgtgtggagaacgtgcccaggtggcgaataaaccaccgctgcagggaagatgctggggatgggacgttgtggctgtccttatagccaggcttgatggcggtgtcagaacggcaggtgctcctggctgtggacccaggctgctagggcccggccccctccagtcccccaaccccacctcactcccgccaccgtaggtatcctggagttcttccaccaccagctgaaggacatcgtggagtacgcagagctgaagacggtgtgcttccagaacctgcgggaggtggggaacgccatcctcttctgcctgctcatcgagcagagcctggtgagtggccccccaacgccgcccctccccgccccagcccaccccaccccaccccaccggccaggggagggctttctttggcgggttctttagtgggggtgtggcaacagctgtgcatcatttttttttttttgtggctgttgagactttagtttgaatttgttcccttcaattgaaaaacaaaaatgtactgtagttcactgtctcaagaatgtttttctgtgttaacgtcataaaactgttatattatgtgatgttttcaacatctaaatgaacatatttggtgtgcctgtaaggtataaggcattgctgcgcaggagggccctctgtatgcctgaggccgctgagcagttgaagtgtggctcagtgtgactgaggaactgagtgctaaatgttactgaattatcactgatttaaatctgaatggctgcacgtgccccatggtggacagcacgagtggccagcatgaaaggggagcccccgggagcccaccccctcttaggacgtggcacagtggacgcctcgtgttttcgactggccgcctttttgtggtgctgtctggctgtccctctgtcctgtacatcacagcagctcagtttataacctcctgggctgggaaagccagtgggaaatggaatctcaggtagccctctcctgccttccatcgtgactaacgaggtgggcatctcttcgttcgttgcgtcttcttgtttcttttcctgtgaaatgccccattgagttcttcggcctattttctttttctttttttttttttttgagacggagtcttgctctgtcaccccggctggagtgcagtggcgtgatgttggctcactgcaagctccgcctcccgggttcacgccattctcctgcctccgcctcagaagtagctgggactacaggcgcccaccaccacgcccagctaattttttgtatttttagtagagacggggtttcaccgtgttagccaggctggtctccaactcctgactttgtgatccacccgccttggtctcccaaagtgctgggattacaggcgtgagccactgcgcccggcctcttttgcctatttttctacagctcattctgtgtagactctttatgtgctgcacatatcgtaaattcttctcccatttgtggcttaccttttcactctgatagtggtgatttttgataaaatgctcttaatttggatgtagcctttttttttttaatgattagcacttttttttttttttaatctaccatctgcacatggaactttcagtatctttttgaagatgttttccctgccttggggtcatgaagacattcctttacattgtcatctaaagatttgaagctttgccttctgcatggaagtttgtaatccttctggagttggtctttgtgtataatgtgagaggcagaggaagcttctttctctctgtggagacccatttgtccctcctctagtggctgaagggctcctcctcccgttgctgaccagtggtgtcccctgccatctgccagcttttcatgggcacaccggcctgtctcctggctttctgccacatctcgctggtccaggcatctgtctctgacatcatagcacattgtcttgctcatcgttgctctaacatgactctcgagtccccacttgccgcgttccctgccttgctccttcttcttcagcatgttccctccccagggctctctgctctgccctgtttggggattggttcaccacataccctggcgaagcgtattggcttgtgcatgggaatggcacttcgtctccagagctgcctggggaggcctttcctatgttgtttcccaaagcagtctcttgtctttaggtctctggtagctttgcaaaggcagagttgtgtttgggaagaacagggagagggtggtctgtacacagctcagggcattgctgtcagactgccaggcctctggggactgagcctctggaccagccgcctcacaccagcctgtgcggtgaaagagaatgtgttggctcacatgtcaggggagtccgaggtcaggcgtgacacgcctgggagctgacagcctccatcagacctgcatcttcggctccctctatgcctgcacgcctaggcagaccctctcctggtggtttcaaagagggactgcagcagccccaggccttcattgtcctggccacccacaggctcggtggggaccccaagtagcatctcctcccatgctcccctcaccactgtgagtgtgaggggtacaagatggagaacccaccagtgtctcagaccagcaagaagccagtgtccagggtggccctgctctaaggacatgttccccaaataattgtgaattgttaaaaaccagatgttaggaagcatctctttaagtataatctctcattatgaattttaaatatttaatacaggaatattcctttcatgggtgacttttcctgaacttacagcataaggcgcgccctatctcatctgctatcttagtccattttgtgttgctgtggcagtgcctgagactgagtaatttataaagaaaaggagtttatttggctcatgactctggaggctgggaagtccaagatcaggcagcccatctgtcagggtctcatgctgcttcagctctgggggaacagagaaggggaagcgggtgttgccaagagaacaaacatgagaggcagccttgcttacaacaacctgctctcgcaggagcttatccattcccacaaaaactaacccaattgtgggagaactgacccagccctgtaagaaatccatcacctctcggaccaccttccaacactgctacattggcaattaaatttcaccatgagttttggcagggacaaaccacatccaaaccatagcctctgtgtatgtccaagcctgaggatgcctgtctggtcattggcctcaggtcagggaggtgagacccgagctttcttaatggggagacagccttgtggaattgatagagatagtgtcagagaccccttagggctggtttctcttctgtccagctgccctttttggaaataagataaagtgtcaaaagcttttctttacatcatttctttttttttttagactggagtttcacgcttgttgcccaggctggagtgcagtggcacaatcttgactcaccacaacttctacctcctgggttcaagtgattctcctgcctcagtctcccgagtagctgggattacaggcatgtgccaccacacccggctaattttgtgtttttagtagagatggggtttctccatgttggtcaggctggtcttgaactcccgacctcccgcctcgccctcccaaagtgctgggattacaggcgtgagccactgcacctggcctgacattcttcacataaacaaactcttgtggttctataattatttatgtccatcccaggactcatggacataaataattatagaaccacaagagtttgaagcaggcagaatggaatttactaggataatctcttagcttaaaggcacggtttctgtgcattgtcatggcaacagttggccctctgttggcttctggatggagtgtgatgctgcattagaaacagggaaagagaagcggagcagatggtgtctggccggcgtctggcactggattgacgttgatgagtacggaaaagtctgcctttcttcctcttggtcttagttttgccatcatctctgggaggtcctcagaagttaaaatctcattgtcggtatttcttgattttctgatagctgtttctttgtttaatcatttcttttactcctatgggactttaagatttcagcatggctgtggggtcggaggcactgaaggctccatcaccttctgcctgctccgtgggggtggtgagcgcactgtggtctgaagaggcccttcctggtggcctaagagccctcacctctaaagatgaacagcagttgctcaatttttgaccatctttgggttcttggtggatttggggtgttctgctgtcctcatgatcctggaggtacattttctttatatatatatatgttattctggagaacggaccttgtgtggtttttattacctctgtaaaggagcttgtgacccaagagcagttcggcatgatggcctagaactttgttttgggctctgtagggaatgagtggatgtggacaccagggtaggccacccctactccttccatctcctgtgttgtttgcaggagacgccccttccttctgtcagtgtggtgggatcttgtcataaactgtggttcttaagagcctggtggcaaattagcagggaaggatggggcgagagcttttagacaggtaaatcctggaaaacagagcacacattcaacactgggtcttacctgtgtctatatttacattaattaaatgtaactaaaaataaaattcagttcctcaagtgccaagccacattccaagtacttactaggcatgcatggctggcggctgccggaatggacaggacagacggaagcatttccatcatcccagaaatctcttgacagagataaaataaacttacagagtttattttatgctaaaaggcaaagaagttcttggttttcagcaccagattgctctctggcgagatacccttcctagcttgaccctctctttctctgctctagtctttagaagaagtgtgtgacctgctgcacgcggctcctttccagaacatcttgccgcgagtccatgtgaaaggtgagcctgctgacccccaccagggagtccagactgccctctgtgggggtggtgcccactgtatgcaaccggagagctaaggaccagtgcagattgtgggtttggcgcctgttcagtcatacccaggggtaatgaggagtgtacagaacctagttaaatgaagattgagaaatagagctgcaatgatatgatgtcttagaattgcttccaaatatcaatagcatgggagcagggggagttgggtatataagaagcagagtggccatgagttgataattatagcagatgatgggtacaggctcattgtgccattttctgctttcgattacatttggaatattcaataaatgaaaagtgaatattgagcagaaaattggttctgccggtttgaattaaaatattaaatgagccagttctgtaaaataattttcaaagagaatctgtatccataatgttaacttaaaaatcttttgttttttaaacaaatgtaaacctttgcaattaccgtttcatacaaaggagcagaatatagtaaaatattttttctactgcagagggggagagacttgatgccaaaatgaaaagactagaatcaaagtacgccccgctgcatcttgtcccactgattgaaagactggggacccctcaggtaacgtgtaccgtgatggctgtggctgttgcaagctgggcatccatgccaggccaggtggcctggttgggagccagactggaaggcatcgtgaagtccagcggctgcgtggctgctcaggcctcaagtgttgcaagtggggtgtgcaccaggactgcttccctgggtggtgggaggattcagatgagctaacacctggaaagagcttagcacatcacctggcacgtaaggcttacacagaagacatcactttcactgtccagcccttcatgaagaaggctttcccataggtgtttaagaacagaagaaattaggccaggaggcaaggtgtcagggtagagttctacagtgatccagctgcttatgctaagtcagggtttctcagccattttggaccagataactctatggtgggggctggggcgccctgtgcatcgtaggatggttagcagcatccctggcctccacactagctgccagtagacccgctccacccaaaacatttttccagggccgggcaccggggttcattcctgtcatcccagcactttgggaggccaagacaggagtttgagaccagcctgggcaacatggcgaaaccccatctctacaaaaaatacaaaaattatccgggtgtggtggcatgcacctggtcgcttgagcctgggaagtcaaggctgcagcgagctgtgattgtgccactgcactccagcctaggcagcagagcaagaccctgtctcaagagaaaagagacatagaggatgtggagtagctggatgcctggaggcccacggcattccacggcttgtcctttctgcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagtaagtgtgtgctgagagcaggacaaagccccagaggaggggaggagctgtgggggaggggaggcgtgttaggctaacaagcagccagccatgctcaggaagtggaccagaaactcactgagcggcttttaagcctcctgtagtggggattcttacttgatgccaaagagctgactcaggactctagtattcagggagtctctgaacccacggcaattgtatgcacgttgggcgtgcatttttctaggtgggaggtccatagagtcattcatcacagaggggatatgatctaaaaagggacaggaagcagcacaccagaagagcccaaaaaagttatttatcaaaaccagggaacagccacctggctgcccggcattctcttcctggctgtggaaggtgactgtgtaggcacagacagtaatgcagatggcttggtcactgacatctggagacagactgagaaaagacttcataacgtatcactcatctcccattctgtttctgcttcttgttcctaggcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtggtatgtggatgaaaatctcgcaccatctatggaccttttgcaaaagcatactttctttgtgttataagttcttgtttctggcaatgtttttcatcctagtacgtaaggtgccaccaacagaaactttcttttcgttcccaaaatgaatctaaatataattggccagtaaagcagtctggcagagaaaatactcattgttccgttttccttctcaaggtacttagatttacttccagtcttacaggatctgcattgtcagaatattggcaactatagtcttcgggcccctggaagtctgtgctttcttggctgctttaaaggccttttgtctttgttgctttatggatccctcatagttgaattctggaaaatactcagccattatctttgaaatatttcagcctcctttccattctccctattcttgccattcaggacttcagttaaacatatgttagaccttctcattctattctccacatctctttgttgtatcagttttcttttttctttctttttttttttttttttgagacagtttcgctcttgttgctcaggctggggtgcaatgccacgatcttggctcactgcaatctctgctgcccaggttcaagtgattctcctgcctcagcctcccgagtagctgggattataggcacctgccaccacgcccggctgatttttgtattttgtaattttgtatttttagtagagactaggtttcaccatgttggccaggctgatcttgaactcctgacataaggtgatccgcccacctcccaaagtgctaggattacaggcgcgcccagccctgttgtattagttttctattgcttccatgacaacaaatcaccacaggcttggcagtttaaataccactgattatctcacaattctctaagtcagatgcctgagttcagccaggcccagctgggtcctctgctcagtctcatggggccagtgtctgaggtgctgggttcaccctggaggccttcaagcttatgcacagttggctcaattattccttgcagctgtaggactgggtcccccttccttctcatgctttccaagtggccccctccagcaatggtgggttgggcagtctcagcctctagtcttctgccatgtctctcctgcctccggccagagaacattccctgactgtgactatattgagcccactggacaaccccagatactctccctgttctacagtccagtcttagccacacctgcccaggccccgtggagtggaggcaatgcagtcacaggctccaggtcatgggcctctctcaggggcccttctgcctcccactcctccatttccggggctcccagagctgtgtccagatactgtattcatgtgtcttagttaacttgtttacttcagctctaatctgctgagcttttactctgaaaatattattagttcactttttaaagttcaattaggttcttcaaatcttcttggtaactgacagttttattgtcttaactgaactttttccatctcttatttctttatccaattcatgtattctatattctgtgtgttttccttctagtatctgaaggccttggaggtatttaaaactttgctgtttccttgtgtgttgggttatttgggagtctttatttaactggagttaatttagattgctttcccccaagatgtgcatttgtatctgcccatctctatggggtgctaccaactcagggccgctttagccgaattggaggtcctggcttcactggggagtcttcggtgtggtcccgcttgcttacgcccgggctgctcctcaccccaccgccgctgttggcatctgcccctgaggaggccctggcttcccccttaccacctgcataggtagaaccagcttttcaaagcgttttgtttgcgtgtatgttcttaattcgtgttctttattcctgtggtagcaggagggtctgtcagagtatcccgtcacagtatttccaaactggaagtctaaaacttgtgttagttgactggcctttctccactgaccacatcatcttcatctggagatccccagctttgagcagacagtaggttcttaattgccaatgtggaaggaataggcctatcaattgtgcgcatgaatgaatctacagcagcatgaagccaacagagggattctaaattcaaaatatattcatccttccaactgttgcattaaagagatggtatgtggctgggagtgctggctcatacctgtaatcccaacagtttgggaggctgaggcagaggaggattgcttgagctcaggagttcaagaccatcctggacagcataataagaccttgtctttacaaaattaaatttaaaaattagctgcgtgtggtggtacacgcctgtggtcccagctactcaggaggctgaggtgggaggatgtcttgaggctacagtgagccgtgatcatgccactgcactccagcctgggcgtcagagtgagaccctatcttacaaaaaaaaacccaaaaagaacagtatgtgtgtcaattccgtttgctattatttttctgagaaaatataagaatcctgacattttgaaacatgaagaataaatgttgaagtgttaatagtaaaacatcctcactttgatggttgtagcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatataccgctcacctcagcacaggtttagctttatatttagggttccgcaggcaaatgaggtgtaaaacggccgtgttggctgctccaatctggatatgaagaggctactcagtgcctctctgttacctgtgcccatgacctggaggaagccagcaatgtgggaggagatcagtcaggcccagtgggtgctgcacaaagggaccgggagcaccgagtccagccttcagctgtccccgatccacagggctcacatggctggagctggttcacatgatctgtcagaatgaaaaacaatcggtctagactaccagtagagtcacgaacatgtttgagaaactaaagccatattttaaaaagtactaaggcaatgaggttctgaaaatcctaactaactgaatggaaaaagatgctatgcctgtttattgtagatgaatactacagataaacacaagtccagcatgattaactgaactcactttatattgtagcctggcagtcattttacattatttggagtattgcaaccttcaccaattttaaaattttctatggatgccaagttgccataaaaagcaggcctcgcctacttttccggaggcctttggaaactgtccagaagcatatgatgcacggcacagaaaagtagtaagtgtacgaaccatcctgttacactgccaaactcactcaagtgacatgaagcctaacaaacaattattctttctttataaaaagttccctaaaaatgcttttggtaatgtgaattaataaccctggggccagcattctgctgcagatttagaggtggtagctgtgcttatcttagaaactacagaataggatgaaaaattatggtaaaacttaatcaattaccaagttttataaggcttaattatataccaaatatgtaataccttaggtataagacaatctcaagtgctacaaaatgttaaataagaatttattatttattaacctatgcatgttcaaatgagtctctgtcctcaagggggagaaaactggttcttttatgtacaaagcacagatgtaggtacagtatataaacagatacgtagtacatctgtagtattaaaatggcatgggaggaggcagttagaaaaaacatctaaaacagctccttagaaggccaataataaagttggaaaaaagggagtttccacgcagccagtggtgagctgcatgggataccagcaccattggcaggggaggccctcggggagtgatggcttggcgctggcgcaccactgggtaacctccaggcaggagccacaggctggaacaggcgaacactttcttcccatcacctaggtggaaattaattctgccaatacttttttttaaaggccagtcaatggttatgagtggataggttcaaagctgaatggagttcattagaccttttttattattctaccttttctgcatatgtttgcagttttccatcgacttcttcataaacaaacattttctagaaaccaaaatatgtagtggcccaaaggagctcttaagcaaagtacttggtacaaagagaccatattctataaacatgttaagtttgttctaagcattcagacttttagaataagaacttcatttcaactttttattataacatgagctaaatttaagaaacaaccctagtcttctatttcccagagctgttcaaagtctaaatgacaatataactcattatgaaaatatactgaaaagtacaagagctgatgtaaaacggtaatcaaggttccaggcatcatgggattagggtaactgaagaataaacccagccaggctgcaacagcaggcaggatgtgctggcttgatgaggtgctaaggccatcgaatgctcagaggaagccggattcacggtgatcatctcaacctgagaaatcgttccttggggtgatttctgcccttttttttgttttgtaagaaagaggttccttcattcagtaacttagttttcccttaataaatatttcaaaaataaaaccaatcatcatcaaacaaacaggagccacttttgtaggtaaggtaaatcacaggataatgtattgggataactctgtttttttaaaataaaaaagccttacatggtcagggattgatggagtggggatgacaaatgcacatttcagactttcatcaccaatgaaaaaataaagcattttcatagacttaaaactgtcattagtgcattcggcttttggagaagggatgaaaatgtaaaatacttctacaacaataaaatgttaatagaaa

SEQ ID NO: 382 - DNA, 85885 bp, Homo sapiens
gtcttccacggagaatgcatccgcgtctcaagagtcggagtcccccgccgccgccgccgccatcttgaggagggtgtgagcgtgtattgagggggagagctagcgaagagttagcgcggcgaaggtgagtcactgggtttgctcaatctttatcatcttaaatgttcaagcaactctgactgtagtgcacgccttttctctagggatttaatatgcagtagttgaccaccagagcaaatgtacatttaggaaaatgacaattatccaccgtggtcaacagtgacgtagataatttaaagtcacccagtgtgagaactgagtgaaattctaagccatcaggtcaagaaggtaggtgcttattctgaaatggctctagtataacagatttgcacccaaactattctggtcaaatgagtaactaactctcctgctttgttttttaagtacttataacttcttgggtagaccattccagaacttaaaaaacaactttccagttctttcttatttctaacctaagtcctttacattgctttctaggttatttcctctaattctgtcatatatggagaagggtaaactggtggttaccctcagcgcattacactttttgatatggtttggctctgtactcccacccaaatctcatgttgagttgtaatccccagcgttggaggtggggtgtgatgggaggtgattggattatggggatggtttccaatggtttaccaccattcccttagtgctgtctcatgatagagttttcaggagatctggttgtttaaaagtgtgtagcgcctcccacttcactttctccctctttctccggctatgcttgtgtctgcttccccttcagcttccgccgtgattgtaagtttcctgaggcctaacagccatgcttcttttacaacctgtggaattgtgagtcaattaaacctcttacctttataaactacctagtctcaggtagttcttcaaagcaatgagagaacggactactacacttttaaaataaataacaatgacaagcaacacacatagtgtttactaatctaggttctttacagattaccatttaattctcacaacaattccatcagatagataactgttttaataccactttacaggtgggataactgaggcacagaagctaaacaccagctagtgaaagacacagctgggatctgagcccatgcccctgtctccaggatctttgcttcagtcactgcaccattttgcccctcccataagcaaattctccatctgggttgctattcactaatccctctctttttctgtttgtttgtttaagtgattcatgaagagacaccaaaaacctttctcttttttctttcattattttataaataaatgtacttcttttccttcttcctgaaaataaaaacctacgaccaatgctttatctgaaaaagagtctttgacaggttattgcagaaagggtctttcatttattcatgctgccctcattaatagagaaaaagtcttgctgggccaaattaagtcaacgtgttccccattcaccatctaattattttaaaaagcacaatccagcaccagaattaaagcaggaattctacccatcttttgtgagagcacaagaggccacgagatgaaccgcatagctaagactggtgacgaggactggagaacccaggagataatgttattcaagtttatgtggaggctttcgtggcactctggtttttctgcatcaggaaaactgctgtaggcagagagatggcagctccatatctatctacctacctatgtatctacgtgtccatctatgcacatatatgtaccacacacacccacacaatttcttttcattttccttatcttaaccactaaaatactaagttttttgtgtaccctttcaagtccccatcacagatagcaaagaaaagcctacccttcttattgtccacttcccaagcaaattccctaaaacaaaccagaaacataaaatagaggatgcacataactaaaagatataaaatatataccacataggtataaataaaaaattataggtataggtaaaattatatataaggtataaataaaaattatatatatggacattgtgtatatgtatatgtgtgtgtatagggtatttcacaccacaaacttagtggtataaaatatatcactttatttagtctcatgagaacaaactttaacacatcttatgaggaaacaatctcagtcaaggagggtttctcctcccttctaagttgccggagaagagctgtgtgcccaggcagtgggtggaagggggtgtctggtctgggtcatgatctgtccaagttggtgaagactgaggcatccttattgctgtctggtctttgattgttcacacacagaggcagcaaggctccaagggttcaatgctctcagagctgcagcccagggcacaagcagctccatgaggttgcctggggccctgaaccctgctgctccagaatgcacatgaagattccaggggactctggttctggctgccacccctttgaggttgggtagagggacaagagagtagatgctcaccacgctcagatcctctccttttacttggtatttttcttaccctgctccttacctccttcccagggttttagcctaggggagggagcagcaatgtgggaccgtttctcaggtcacgccagagtttagctaacctccctttgcctcccctctaattgtcttcctttccctatgccactaacctgtgaacctttggaggaattaagggtcaaagggaaggctgtctccttctcattaggtcttctttatgccctgagcccctcagcacctatgcttttaaaaggcatagcctttttttctgctataataacttgaagcaaagaggttgcatgcctaagtgatagagtggggcaaaggaaaatggagtgcagagagacaacagtcttttcctccaatcacatgtacccacctggcagtatataatatatgccaactgtgtgtatcttaacatgatatatacatatatgtatttaatacacaagaatcatatttacacatataggtattactcatgtggtttggggctatggattgtggcttttttggggagaaaaatttatggatgaatacttctatccaattcttaaatatttaagtcatatgttcttaattgtggatcataacagaaaaaaatggagaaccagaatataaaagataattatcttatagatagattgtaagatggattataattataatatatcagattatagatagatttctcatcaccatttgcacggagagaaaagggagcaagaatttctgactcaggaactctgtaacaatcaacttactgtaaccccagccatgtcatttagcctcattaacaatctcattttcattattaatgaggatgaaaaatgtgctcaaaatacaagtataagatcacagatttcaaataataaagctgattcagctgaagatcgaaaataccggcttattcataagacgttttagagcactatgcagacaataaagaattcttaatccttgtaccaaatgccatgattcacgttgttttcctttagtatgaaattactttcaatgtaaactctgacacactggggaaaaaaataggttccttaagacctttccatacaaaatgtaggtaaaataacttgaaaaagaagtaaaacaatcttaagttatattggttacatctttaacttattgctactagtttaaggcaagaacttaatctttatatctaaacatgcaaaaggaaatacccctttgctccatggtgaggagacaggacaaagcagttttttattacctgtggttgaggaaatagctgtttaagaaaaagatacttccattcttttggctagcctgaatcttgagaggacaatccctctcttccagttgttgggcaggctgtttttgtttcttgatggataaacatatttccactattaaccctaggtgataagattcagagtaaacagtgtctcagggattacttaggagggacaataggcagaggcagaatcttgggggaaagccctcaggtataaggttgtcaaatttagcaagtaaaaatacagaaaaaccggttaaatgtaaatttcagataaagaatataagttccctatattgcatgggaccaccttaccaaggtggaattatgtgaacataagaaatggccactgggtgagtgcccagcaggaatatgggctcaccaaccaagagagtaaacaagtgtcctctgggcattccagcctcagaaggtaacttagaattctaccaaattctaccaacagtagaagcaatcttcagggagtactaaaaatgtgtgtggcaaaccgaagcagtggtattagcacgagcctaccttggaattagcctgagctgcttggtgcaacattcaagtgagaccaaagtagggcagaagaaggaacaggggcctgtgtacccagggagtgtctgtcatgccaatctgtgccttgtctccaagttatcttaggacacaaatctgcgctcaggaagctcatctgtttctgtgcttctgttttttcccttttttggtcttcttgtgctttcctctcatttctcattcaaatttctttttgaatattctagcttttgtctctaaataattaacatctaggcctttagtcttgatcaccctcaccaacccatcctctttgtgccaaccagagggcctctctccttctgtcttttaaaatcagatttattgagatataatttatatataataaagctcaccaattttatatgtatgatctaggagttttgacaaatgtgtacagtgatttttctcaatgttttgagttttcagcatacagatctttcatgtattttgttatataacttataagtgtcatgattttttaatgctaatgtaaataatattttcattttaatttctaattatgtattcatagcatatagaaatggaattgattttttcattttgacatgtatcttgcacaggtgctaattcactttttagtttgagtcactttttttataggtgcattggcattttttatgtagacaatcatgacatctatgaatagagacagttttatttctttctttccaatgtgtatgcatgtaatttctttttcttgcctgattgcactagctagggtctgtagtacaacattgaatagaggtggtgagagcagacagccttgccttataccttatcttagaaggaaagtattcagtcttctgccattaagaatgatggtagctgtaggtatgtaggtagttgtagtaaatgctccaagtgcacttgataagaatgcatattctgctgttgggtggaacattctgtaaatatcaattaggtcaaaagaactaagatggcctttattgagttgatgactttcccttctatttctagtttgctgacagtttgtattatgagcctctgttgatttttgtcaaatgtttttgctgcatttgttgaaatgatcttatgctttttttcccctcatctgttgatatggtaaattatattgatttttaaacattgaaccagccttgcatttcttttataattggtctttttataccactggatttcatttgctagcattttgttgaagatgtttgcgtgtaggaaaattggtctgtaggaatattgatctgtagttttcctttcttgtaatgtctttaaccggttttggtatcacgataatactcatattaaaaaatgagttggggagtatcttctcctcttttattttctggaatacactacatagaattagtcttctttctttagtgttggatagaattcagcagaatagacaattagggctggagtattctttgttaggtggtttgtaatcatgaactcaatttctttaattgttaacactattcaaattatctatttcacattggacaagctgtggtagtttgtgcttttcaaggtattggtctatttcatttaagttgtcaaacttatgtgtgtagagtttttcatagtattcccttatccttttggtgtctgcagggtatgtagtgatatctcctgttacatccttgatatttgtgatttgtttcttctttcttttttcttttcatagtattcccttattatccttttggtgtctgcagggtacatagtgatatctcctgttacatccttgatatttgtgatttgtttcttctttcttttttctttttcaggcttgctggaggattgtcaaattttattgatttttttaaaagaactagtttttgtttcattgattttctctattgcttttccattttaaatttcattgatttctgctcttttcatatagtgtcttctttctgcttgctttggatttgatttactctttttttctagtttcttaagctgaaagtttagaggcatttcttctttcctaatattagtctttgattctataaatttctctctaagcattattttagctgatgctgtgtttttatttcattaaactaaccatattttctaatttatcttgtgaatttctatttgactcgtgagttatttagcactatgttatttaatttccaaatattgggagattttcagatatctttctactactgagttctagtttaattgagttatggacaaagaacatatattgtatgatttcaatacttttacatttttaaaggcttgttttgtggcccagaatattatctatattagtgaatgttccatgtacatgtgacaagaatgtgtattttgctgttgagtggaatgtgctataaatatcaattaagtcaagtttgttgattatgttattcaagccttctatatgctttctttttaaattttttatttttttatttttattaaatataatttaatatcatacaatccactcatttaatgtgtacaatccagtggattattagtatattcacattgcataactcatcaccattatctaattccagaacatttttataattccaaaaagaaatttcatattttttagcagtcactccccatttgctccaattgtgactgctaaacaatatgaaatttctttctggagttataaaaatagattagaaatagaaatatctaatctactttctatttctatggctttgccaattctggacatttcatactaatgaaatcatgctatgtgtgtccttttgtgtctggcttctttggcttagcataatattttcaaggttcatctattttgtggcaattgtcagaacttcattcctttttacaacctaataatacttcatatgtatatatagtcaatcatcgtcattcaaagattccatatttgtgaattcgcctacttgctaaaatttatttgtaatcccaaaaataaacattcatagtgttttcacagtcatctgtggatatgaacagaacaacaaaaaattggatttacccaatgtgcatattcccagttgaggtcaaacaaagtgatacccagctgtcttgttttagctgtcatactataaacaagtgtcctttttgtggtctgtttattgccatgttgtcctggtccacctagtgttgctataaaggaatacctgaggctgggtaacttataaagaaaagagatttatttggatcatgtttctcaggctgtacaggaagcattgcaccagcatctgcttccagtgagggcttcaggctgcttccactcatggcagaaggccgaagggagccagcatgtgcagagatcacatggtgagagaggaagcaagagagggaaaaggtgctaggttctttttaacaaccagctcttgcaggaaccaatagagcaagaactcactcattaccacaaagatggtaccaagccattcatgagggatccatccccataatccaaatacctcccatgaggccccatctgcaatattggggatcctatttcaacatgaagtttgaaggagtcaaatatccaagccatagcacttattttttttttgctttttttttttttttttttttgctttttgttggtgaatttgctatttaaatgctccccaccaagtgtagtgctgaagtgctatcttgtgttggtcagcacaagaagtccgtgatatgccttacagcaaaaatacatgttttaaataagctttattgaggcatgaattatagtgctgttggctgtgagttagatgttaatgaatcaacaatatatattaaataaggtgtctttaaaacagaaacaaaggcaaagaaaaattatttattgattggttgacaaaaatattgtgaccagaggctcacaggagcataactgtatattttgcctaggtgcaatggttcagtattcactgagtcaatgcttatggtggctttatttacaatactgcattttgtttacccattcatcggctgatggacatttggcttgattccacttttggtctattagcaatagtgctgctatgaatattcatatataggcttttgtgtctctatattgttctgtcaactactgagagaggaatgttgatgattccaaatgttattgtggatctgtgtatatctgatttcagtcttaccatttttgcgttatatgttttgaagctctgtgttaagtacatacacatttgtgattcttatgtcttctcggcgaattgacacctttattactaagtcctttactcctagtaatattctttgtcttaactgcatgccagatattgcaaaatttacattattaattgctggattttgttatattcctttgaatagtgttggattttttgatacacagataagttacatggaatgattttgacccttttgaggcttgctttccaactctgttagagtgagttcagaggggtctttagggctaatttagccctactactaaaataatacccttctgaggaatctattcaatttcctgtgtattacaaggtcttttaactctggatggtgaaatacaagctattttcaagtctaggaattcttctgccccaccattttagtggctttttttgctgcttctcatgcatatacagatctgtactcagccaaaaacttgaggatattcctctacatctctctagggcactcttgttggttctctctctctctctctctgtctctctctctctctctctccctttctctctctgtctctggtactatgctgccttggctccccaaactctgatctctgtctcctcactttggcatgatggttgggccaagtcgggttcctcttccttgtgctgcagcttagaaagagcctgcaggcagaaacctggggacattacagagctcacctcaattgtttcccttctatcatatatcacaatcctgcaccacatcttatttaatatgtgaaggccattgtttcatatattttgtttggttttctagctgtataggcatgagggtaaatctggtcctggttcctccatcttgactgaaagagaattcctgagagcccagagtgctctttttatgacaagtctaatccagttgcctcccctaaactttgtaatgactttcttgggcatcagtttcaaaagagtaaataaatgaaggagaaagggatgtgtgtatgtatctctaaagatggaagaaattaaaatgtggcctttagggaaccaggaatagtgatggagtctggacaatgaaaggtgcaaacacatgaaggggaggtccacgagtggattatgaaggcagaatggagcaaacactggtccagaatccagggtccttgagtccctctgctggaatccacaaatatagctaaaatagtatcccactctagccattccagctactcagcttcatgtcctgtttgcccatacatccttcatcccatagagtcttgccaagaatacagaccatgtaaataatgttgaccacaccgctagtttttggggggaggggggagttatctgaaggaactagagaactaaaatggaaacatcttttgccttcaagattgaaaatgagaagatggaaagacagactatacatgattaaaaaggactcaatcaatggtttaaaaaaaatgtttaataagacagtgaagtttcagctgtctgagaacaaaatgggttcaggagggaagccccaaggagggaagccatcttctgcttctgggtgagtcttggggctgaaagagtcatgtaagccataatcagaaagagaaatgggctcccgggtctaggtgtttcttgctgcaactgtttacttgccaagaaagcacagctgtgggtctaatcttctcaatttctaccttgggttctgggagacacctgagctgccttgagtaactgaaagcatactggctgagacaagaaagacgtcaacaattgttgagggaaaatatgtgaggtgttatgtcagagccttaaagacctcatctcgtaatgttaacagcaacccacatttcacagatgagaaaattgaggctcagaaaggttacatgcatggtttcaagttggggctctgtgccagcccaccaggccataaagtgaaagagattatgaggttttgtggtgagagcagctcaagccaagttcgaatcctgactataagtaaacatataaagatgggtgacatatacttgcgtatgtcataataaattataaatagaatgattttctttagagagtttaacatactgtcaaagtacaattttcagaaagttaaagacataactcctgtacaaatttagaatgaacacatgtcaaatatgttatttaattcattaaggagggaatttgtaagatggtaactctggtgcaaagaatattggaggaactgggtgttccttggcaacaaaaaataaagagagaatgagattactagattagatacaaaacttgttaatgtcttacagggcaataaaactatcatcttttaggttaccttttctctcagacagaaatcatttgcatctccaccagacaaaaatgtctgcaagttagcatgtaatttcacaaagtctgagacctgtaaacattaattaaaaaggaatcaaacaaagatacatttccctagataattaaatactcattgatgggtttcttgaacaactccttgactgatattaaaaggtcgtggtttctctcttggccttatttccaaattttggttgattttttcttatcaatacactaggaaatctatcataatagtgttaagtcctttgacagaaagtgattccaggttttatggggcctggagttcttacaatattacagtctcttttaaaaaaaaagaatacaaaaacatttacttttgcaaatcttataaaaatatataaacatgagaacacatcaatttatatcccccaagggcattggaaggagtcatgcacaaaaaggtccctgtttttttttttaatgtcaaatattctgtaaccaagtatcttcaactctgagttagcgtataactgtaatcgttcattttcatgctgctgataaagacatacccaagactgggtaatttataaagaaaaagaggtttaatgggcttacagttccacatggctgtgtcaccggtggagggtgtccaggttcttggcatcttgaacaaagaattggacaaaacgcaccagcaaaacaaggaaggaatgaagggatttactgaaaatgaaagtacactccccagtgtgggagtggccggagcataggggctcaagtgcctggatacagaatcttctcaggtccaaataccctctgcaggtttcccattggccacttggtggtcacctcatgtaaatgaagtggcggcctgcaatcagaggctgcagcgaagttacaaaggttacactcctgtgcaaacatctgataggctgcaaaaaacaaccaatcagaggttaaggtgaagttacaaagttgcacttttacacaaacgaagactctgcctgcaatcgtctgactggttgtagacattcaatttccaatttgccttgcagaaaatgtgggggtttgtaaagggagtagtctctggtccttttgttacttaggcttgggaagttagggttttcctttcaatttagttctcggaagtcagtgtgaaatggccttaggttccctgcctccataccttgttctcctgcctcagctggggaggcctcataatcatgatggaagatgaaaggcacatcttatattgagacagacgagagaatgagagccaagcaaaaagagtttccccttataaaaccatcagatctcatgagacttattcactaccatgagaacagtatggggaaaaccagccccatgattcaattgtctcccactactgggtccctcccacaacacatgggaattgtggaagctacaattcaagatgagatttgggtggggacacagccaaaccatatcaataaccaagctacacccctataattttttgtattatctaatattctatattattttaagatcattctgctcactgttccacaggtgatttggttgaatgaattccctacagctttacaaattgtctttaaaatcgtataccagaaaatatgtaccagcattaaattttcactagttaagaagatattaaaggctaatgtgaacaaactgattaatttgtgttcagtctatatttgacgaactcaaatttgttaacaaatgtgtgttcttgacagattctattttatccccattcactgaagaggctctgccttcaccacctcagttatttcccagcccccaaccttcaaagcaagttctgcctggtatttaccagactagttttcctcttttcttttcttttttattttcttctttcttattttcttctttcttttcttttcttttctttctctttctttctttctttctttctttctttctttctttctttctttctttctttctttctttctctctctctctctctcccctccctcccttcctccctccctgcctccttcctttctttcttcttttctttctttcttttctttcttctttctttctctctctctcccctccctccctccctcctttctttctttctctttctttctttctttctttctttctttctttctttctttctttctttctttctttctttcccttccttccttccttccttcccttccttccttccttccttccttccttccttcctttctctctctctctctctctctctttctttcttctctttcttctttttcttgacacagggtcccactatgttgcccacactgaccttgagctcctgggttcactcgtggactcaagcaatcctcccccctcagcctctcaagtagctgggacaacagcatatacacctggctctgcctttttttgatgctgacttcggatgggggaaaattaacagaggaaagaaaggaaatgcaaggagactactagagtggagaatatgtatagagcatttactatgtgctgggcactgttctaagagctctgcatgtattaacctactggaggcaggcactgctactattcttatattatgaaggaggaaacgaaatgaataaatagcttgctcaggtaaagccaaaacccacgtttccatctcagagcaaaatcacattcaaagaaacacaaacagtttgcatttttctgtgtcgggcctttgaaaaatgtagtgtaaacacagtgtttgtatctactcttatttaaaatcctttgactttttttattctctaattcccttgcattgggtttcacatgacaaaaacccaactgaaactttctcaagccgaaaggggctctattgaggctcgtgtaactagggtgttctcccttcaggcatgactcgatctggggcctttagtgacgccatcagaactcttgagtgtgtttgtctccccaccccttggctctgcttttctctgtgtgatggcttggttctacaggcagtttctctcatactactgggaaaattgcttccaacaactccaggcttacccaatccctacaactagaaatcccagagtgaaatagacatctcctctctcccagtgtccatagagcatgccatagggaaggccagtgttccagatgatggagactgccggttggtcagactggaccacagagatcccctctgtgaaggtcatggaagaaggtcatgggggaacttagtttttccaggaccacacgcagcgtgagaagcatagtgcccaaaaagaaaaaagagcatgctgttacctgacgaaggggaaagaataccaatcaggtgaaatcagtggacatccatgacactatgaaacaccgctctccctccttctgctgacccagagctccaccttcttcatgccatttagaaactatgctctcatactccaacatctctgcatgaatctacccagagctctcaacagattatatttctgctttgtcactcccctctcacagcctctttctgatttaggcttacatgtcaatcatttacattttaatgtgatttttttcactaatgcactgtgtctcccaatgatatttgaacttgaagctttagtgagcaattaaagcatttatccctagcttaaattaattttagcataggcaaacagggaggctgcagcttccctgcaacacgtgaaagtccagcagatgggcagttttccatatgcaagctgttgtcacacagagttcactgaccacacaccggttcatcgaggcagaagaacagaatctgcctgcagcctgtacacagagaattccttccataaacagtcatagtttcttttaggcctgggacacatggacagtcgcttcttcttaaggagatttactaggggctcaaaatgatcttcccttctctggttacccaaaccgaatagttgacccaaccatatttcatctgatatcaccatatctgaatagccctcttattcttgcacaattctatttttctttatacttcctcagtctcagcaaaaatacattataacccctctctcttagtcatttttgaccacttactgccttttcttttatctgctacataactcttttgaatgagagctgtctacagcaataaaggaaggaagaattatattggctggatgatggagtggcatcccagatgctacaaacagtgggaataaatggaaggtgacatttcgtcccagcgctaggtggaggaggctattattaaatcaactaacagctcacgcgtagagcagcagccatgagatctccactgctgggccagcctttggtttttaaatagattctgcccacaggtggcccagtgttttctctaaattgtttcttgtcaacaaatgagcttacccctatcccctggggacggccacaaagcattgcaaggtctaccactaccctgcaagcaaaagaaagtcgtggcatttctagaggagaaaagtgccttatgtattcctacatttcttccacattcttctggttgagttggcattgatccatgtaacaaacttcttccctgaggaaaagactttgccaatataagaatgctaaataatacacacatcaccagagtttattttcttcattctgttggtgacattggtccctatggaccagtaatcaataggagcttgctatttctgtgctgtaaaatactttgccctaaaatgttgctttcccttcctgtgttccttagggcaatgtttctttgtcaaccaagtaccgttatagctggggtctcaaggatagctggggctgtcttaccagtaaaattcaggcgtgtccaggtacctctggaacactgtggaccaataaaaggagcccattgggatgttcatttgcatgagtgtccaagaaatttatgggagaaaactcctaaaagaagaaaggattcctgtgtgtgcacaaatgtgagtgaaggggtgattttggtatgatgaggagtgcagggctcacactgcctgtggatcccccttcttgctgcccccacccttagctttcccctgtaccttcttcccgcagttctctacctagagtgggggagagaggttgagatacaaaaacaaagaagaggtgtttcactaacacctctgtgaggctgtaaaagcagaaagatgccatcccctatggcccatgttacagagcacaacacaaatagaaaatagtattttatccccattttatagggggcaacctgtcagctcaacattgccatccagagcagcagagcaccaaagccacccagcacaacccagtgctatctgagtggggaaggtgggagatcacaggaggcatgtacaaagctgtggagacaggttatgctcaggcttcaccaaggctgccatctccctgcattctttgggaataacttggttgaggggcaagggtagcaggaaagatgtgtagctagagttgctgaaattgtgcctagatgctgagtaataaaaaatcactttattactacttctgtgacctgtttcccccaggtttgatgtgtggagatcaaattcacagttatgataaaaattcatttattcaattgtcggtggggttttttttttccaaaatataattttgactctaagtcactccattttctagtttttaaatgagctgacatttggaattagtctgattttttactggtcccataatatataccgttttaaagaggctcataaaagcatggaaactcaaggaaggcccagagattataatattgatttcgaattacaaatacactttcaatgggacaaagagcaggccaaatccttcaccaagcttctactgggtgtccctattttaagactgcaatttggatgactgcaattatttgcatttttattactaattgctcctgccattggtgcagccagccacttttgggtgcaattaccccctcatgggagcaattacatataaaaacaattctgcacgtgcagctcattgtgacaaaacaaaaggaggctgaggagaacaattaggctcatcaagtcctatctccaacttcatcgtgtgccagctataaggtagaacagcagggacaggaaagtagcacctaccctgggatttgcaggctggagcagtccttccactgtctatgaacatttttttttttgagacagagttttgttcttgttgcccaggctagagtgcaatggcatgatctcagctcactgcaacctccgcctcctgggttcaagcgattctcctgcctcagcctcccgagtagctgggattacaggcacctgccaccacgccgggctaatttttgtatttttagtagagacggggtttcaccacattggccaagcaggtctcaaactcctgacgtcagttgatctgccctcctccgcctcccaaagtgctgggattacaggcgtgagccactgcgcccagccctacgaacatatttttagaggattagattgtggatttatttaattagaaaaaagcaactcatcttgctaaagtggattccaaacaccaaatcaagccatatagccctctaattaagtacccagacttccagaaaacgccagatttttatgaaattctgttttttcacaaagagcactgacacatccatcccactgaattacagcgtatacaccagtctccctccccttgtctctgctagacacactaacttaactgctccagccctaagattgggaatgatggtgtaatgagctgacacatgaggtctgagcaccaggaggagcagccccaattgcaaaatgcagcaggcattctacacaaaccatcttagggtttccaggcagcccacagaccaaattgtcatattacatctcatcacccgattcaaattttaattagaaatgggaaatgggagtgcatccaaggccaccatcagcctgtaaacgattacctcattgtgcctcaatttcctcctctgtaaaatggggataagaatagcccttgcctcatagggttttgacagtgattaaaagagccaattcatggaaacacttagaacagtgcctagcactccaaaaatgttaactatttttatcattacctgtgcaattttgttgcaattatttatttctagatctgtctcctctttgagttgttaggaaaaattacacaaaactggagataatcatagtttttctcatcatgttcaagcatcatttaacacagacctaaagggaaagtaactttgacttactattttttgttaactagaggctagattctggaaagttagatatttgtagaagattgataaattacaaatgatttttatccaggaaagaggcaaaccattttcttccaatcaaaaagaataaacccaaaggtttagggtcctaaagaaaggacattaacctgttttgtacctaactttgacactgtattccagcattttcttttttcctattgactacatttatcagtttcctcctattctcctttgctccagctttgccattttgctggtcccctcattagtgaattaaataaatctttgacacacactcactatacatttttctgagatccatgtttttactttttgtaaaaaaaagtatttgccagaagccatgcactccgtgcaggtggaactctctcacagtcatctttgtgtgctggttcagtgtttctcacattttaatgtgcatccaaatcaactgagtgttaccaccagcgaatccatatgggtctgcagcaacctcaattcttccctcctaagaagaaagaatttgaggaggcgtaaggcaaaaggagagactgaggcaagttttagagcaggaatcaaagttattaataatttaaaaagctttagggcaggaatgaaaggaagagggccaaacaggcgacttgagagatcaaatgcatgctttgacctctgacttccagggtcttgcattacttccctgattcttcccgtggggtgggctgtccacataggcagtggcctgctagcgtttgggaggggaacatgagtggtgtgtttagtggagttgtacgcatgctctcttgaggcgttctccccttaccagtcgaatgtccctagaaggtcatataccatttaaactctaccattttgcttcttaatgctcatgcttgagctcacttgcccaactcctgaggtcttattgggaagctgctgattaccagtttcaggcattttctatcttatcgggagactgcctttccctggcactagctgcacctgaccaattattattttggaaagacagttaacaaccgcctgaccatcacctgatggttgcctgacattcctggttgggggttggggagtcctctcctgccctgagcatgcctgactagccacctactgtaacatgacgattcactcattctggggagaggcctaaaatacgaaatttctgcagatgctgctggctttagtcctgagcccaaagcctggacttggaaaatgcaggtgcttagaaatgtatgtaaacatccacctgtgaggacaaatgacatgtcttactccttattgctacctcctccaataagtgtcttttatttccacaatgtatatgcagtaatgcagaggacctgatttgggtggggacacaatagggcttgcttatcataatgacgtagttaaatgagagcttattaagagggtgagggaagatgggaggtagttcaataatgggaaaacacagtcagttaggatgtaaaaactatgccacttacagtggttatggtcccccctgttgatgcccccattgcaggactctcagcaggactaacaccagcagcattgcccaacctcattcctcaacggctgcgtggatcccctctcaggcaatctcaggcttaagagaagtgaatcatagttggccttaaaaacacaatggggacttctaacctaggcagaagacttagtttctagcttctgttggctcagggcatcctacctccatgtgccttcatgtatataaaattaacaggcagttaactctactgctagaaaaataatcatatagcccttgtgtgaatttaggcagaattataattgtctaccccagtggttctcaaacctgaggtcacattagaattgggagcttgtatgaaaacattcatatgcctgggtctcacttctagagagtctgctatagttagcttgggcaacacatgaacaatattcctctatgcctaaagaggagatggcattagctcatcagctgcgctgtcattgtggtaagtgagaagttgttaggcattgacttcttctatcattctccaacacattaaggcaaaggtgtctctagtcatcttagaagcactgcaaatttttcaaataaagtagttttaatttaattttctgtactttataatgtgaatacattagaactgcttttcagggggaagtgctagatgctgcgaaaggtctggtataagtggcatgaatcctgaccatgaggtgctacttccccaagcacccggaaataggaagaataatgttttacttgaggctgaaactaatacagtccacacataatggataaaattaagcaaccaaatgattgtaaatatgtgattataaagttttctttggcttttaaatagaatacttttattattgaaataatatctttctaaaaataaattactttggaaagagttatatgaggtaagaatgtaaagtttccatttctacaccctctcgtaactccccatcgccccctgctcccagctgctccttcctcaaagagagttttcattgagtttagctcatttccttctagagctcctctgcgcgtgtacaaatgcatgctcgtgtgtatgtgtgtgtatagctttttcttctttttgcatcctgtttccaagtcttccccaccattctcacttaaatctactctagtgaggttttcctttatcccagttaactttatcacaggcaacttcagcaaagctcccacagtggtaaatcctatggcaaatctcttgttgtcacagtggctcactcctgacaccacacacatctggttttcctcccacctccaactactccttctcagtctcctctgcagtttttttctttaatcctctctctgatctctaaatttagacaccttccccccaacccccagtcctccaagccctttcctgctctatgtgcacttactcccttagtgatctctgcaagtctcttggctttaaacaccatctgtacgctgatgacacccaaatttatatttccagtgtgaataactctcgtaaacttcatgttttggtttagtttttgttattacatgaatatttatttgtatgcatatatctttttttccttcccaacttttactttaggttcagggatacatgtgcaggtttgttacatgggtaaattacatgttgtggggatttgatacacaaagaattttgtcacccaggtaatgagtacagcacttgataggtagtttttcaatcctcactctcctcccacccttcacccgcaagcggctccagaatcttttgttgtctcctttgtgtacatgtgtagttaacatttaactcccacttataaatgagaacatgcagtatttgatttttggattcctgcattaatattcttaggataatggccttcagctccatccatgttgctacaaagaacatgatctcattctttattatggctgcatagtattccagggtgtatatgtaccacattttctttatctagcccactgtcaatgggcatctaggttgattccatgtctttttttggtggggggaaggagttgttttattaatttattttttattttttgctttacattttaaaaatttttttatttcaataggttttgggggagcaggtggtgtttggttacatgaataagctcttcagtggtaatttctgggattttggtgcacccatcacccaagcagtgtatgctgtactcagtgtgtagtcttttatcccttgccaccccccaccctttccctgagcctccaaagtccaatgtattattcttatacctttacatcgtcatagcttagctcccacatatgagtgagaacataacattgtttggtttttcattcctgagttacttcacttaaaataatagtctccaattccacccaggttgctgtgaatgccattatttcattcctttttatggctgagtagtattccatggtgtgtgtgtgtatatatatatatgtgtgtgtgtgtgtgtgtgtgtatatatatatagatatatatagatacatgtgatatatatcactgtgcaagtatcttttccgcataatgacttattttcctctgggtaggtacctagtaataggattgctggatcaaacactagatctacttttagttctttaaggaatctccacactgttttccatagtggttgtactagtttatattcccaccagcagtgtagaagtgttctgttttcaccatatccatgccaacatctatttttttttattttttcattatggccattcttgcaggagtgaggtggtatggaattgtggttttgatttgcatttccctgataattagtgatgttgagcatttttccatatgcttgtgggccgtttgtacatcttattttgagaattgtctgttcatgtccttagcccactttttgatgggattgtttgttttttcttgctgatttgtttgaattctttgtagattctggatattagttctttgttggatgtatagattgtgaagattttctcccactctgtgggttgtctgttaactctgctgattatttctgtgtagaagctttttagtttaattaaatcccatctatttatttttgtttttgttgcatttacttttgagttcttagtcatgaagtctttgcctaagccaatgtctagaagggtttttccaatgttatcttctagaatctttatggtttcaggtcttagatttaagtctttgatccatctcaagttgattttttttataaggtgagagatgaggatccagtttcattcttctgcatgtggcttgccaattatcccagcaccatttgttgaacagggtgtcctttccccactttatgtttttgtttgctttgtcaaagattagttggctgtattagagtttatttctcggttctctattctgttccattggtctatgtgcctatttttataccaataccatgctgttttggtgactatggccttatagtatagtttgaagttaggtaatgtgatgcctccagatttgttcttttttcttagtcctgcttttgctatgtgggctcttttttggttccatatgaattttaagactttttttttctagttctgagaagaatgatcatggtatattgatgggaattgcattgaatttgtgcattgcttttggcagtatcgtcattttcacagtattgattctacccatccatgaacatgggatgtgtttctatttgcttgtatcatctatgatttctttcagcagtgttttgtagttttccttgtagaggtccttcatgtccttggttaggtatatccctaagtattttgtttttttgcagctattgtgaaaggtgctgagttcttgatttgattctcatcttggtcactgttggtgtatagtagagctactgacttatgtacattaaatttgtatcctgaaactttgctgaactcatttaccagttctagaaacttttttttggatgagtctttagagttttttaggtatacaatcatatcatcagcaaacagcaattctctttactgatgtggatgccttttatttctttctcttgtctgatttctctggctaggacttccagtactatgttgaacagaagtggtgaaagtgggcatccttgtcttgttctagttctcagggggaatgctttcaacttttccccatttggtataatattgactgtgggtttgtgatagatggattttactatgttaaggtatgtcccttgatgtcaattttgctgaggtttttaatcataatgggtactggattttgtcaaatgttttttctgcatatattgagatgatcaagtgatttttgtttttaattctgtttaagtggtgtatcacatttattgacttacacatgttaaaccatccctgcatccctagtataaaacccttttgatcatggtggattatctttttgatatgctgttggatttggttcactagcattttgttgaggatttttgcatctatgttcatctgggatattggtctgtagttttcttttttgttacgtccttccttcattttaatattagggtgatactggcttcatagaatgatttagggaggagtctcttttctccgtcttttgtaatagtgtcaataggtttggtaccaattctttgaatatctgatagaattcagctttgaatctctctggtcctggacattttttgttggcagttttttattaccctttcaatcttgctgcttgttattggtctgttcagacattctatattttcctggtttaatcaaggggattgtatatttccaggaatttatctatcccctctaggttttctagtttatgggcataaaggtgttcatgatagccttgaataatcttttgtatttctgtgctgtcagtactaatatctcccatttcgtttctaattgagcttatttggattgtctctcttcttttcttggttaatctcactaatggtctatcaattttatttatcttttcaaagaaccagctttttgtttcatttatcttttgtattttttcccaattttatttagttctcctctgatcttagttctttctttccttctgctggatttgggtttgaattattcttgtttctccagttccatgaggtctgaccttagattatttatttgtgctctttcagtctttttggtgtgggcatttaatgaactttcctcttagcaatgcttttgctgtatcccagaggttttgataggttatgtcactattatcattcagttcaaagaattttttaatttccatcctgatttcattgttgacccaacgttcaggagcaagttatttaatttccacatatttgcatggttttgagagttccttttgaagttgttttccaattttattccactgtggtctgagagagtacttgatataatttcagttttcttaaatttactgagacttgtgtgttggcctatcatatgatctctcttggagaatgatccatgtgctgatgaatagaatgtatattctagggccaggcacagtggctcacacctataatcccagcactttggaaggccaaggcaggtggatcacctgagttcaggagttcaagaccagcctggccaacatgtcgaaaacccatctccacttgatcttagccaaaaggccaagaagcgattggaaccccatctctactaaaaatacaaaaaaataaaagataaaaattagccgggtgtggtggcaggcacctgtaatcccagctacttgggaggctgaggcaggagaattgcttgaacccaagaggtggaggttgcagcagtgagccggagccaagatcatgccattgcactccaacctggtgacagaaggagactctgtctcaaaaaaaaaaaaaaaagcatattcttcagttgcttggtagactgttctgtaaatatctgttaagtccatttgtcgtagggtacatttagatttaggttcactgtttctttgttgactttctgtcttgatgacctgtctagtgctgtcagtggagtatagtcccccattattattgtgttaccatctatctcatttattaggtcatagtaattgctttataaatttgggagctccagtgttaagtgcatatatatttagaattgtgatattctcctgttgggctagtccttttatcattatataatgtcccactttgtctttttaaactgttgttgctttaaagtttgttttgtctgatataagaatagctattcctgcttgcttttggtgtccatttgcatggaatatctttttccacccctttaccttaagtttatatgagtccttacgtgtgtttatatgagtccttaagggttaggtgagtctcctgaagacacagaaacttggctggtgaattcttattcattctactgttctgtatcttttaagtggagcatttaggacatttacattgaatgttagtgctgagatgtgagttactattctattcattgtgcatttgttgcctgaataccttggcttttttcattgtgttattgttatataggtcctgtgagatttatgctccaaggaggttctgttttggtgtatttcaaggatttgcttcaagatttagagctccttttagcagttcttgtagtgctgtcttggtagtggcagattctctcggcatttgtttgtttggaaaagactgtatctttccttcatttatgaagctcagttttgctggatacaaaattcttggctgataattgttttgtttaaggaggctaaaaaataggtccccaatcccttctagctcatagggtttctgctgagaaatctgctgctaatctgttaagttttcctttgcaggttacctgatgcttttgcctcacaactcttaagattctttcctttgtcttgactttaggtaacctgatgattatgtgcctagagggtgttctttttgtgatgaatttcccaggtgttctttgagcttcttgtatttggatgtctagatctctagcaaagccagggaaattttcatcgattattagcgcaaatatgttttccagacttttagatttctcttcttcctctggaacaccaattactcaccaattatttggaaggtttaacatagtcccaaacttcttggaggctttgtttattttaaaaaattcctttctctttgtctttgatggattgtgttaattcaaaagccttgtctccaagctctggagttgtttcttctgcttgttcgattgtattgcggagactttccagtgcactttgcatttctctaaatgtgtccttgatttgcataagttgcgattgttttttatttatgctatctgtttcactgaagaattttcctttcatatcctgtatcatgtttttcatttctttaagttggattttatctttctctggtgcctcctgtattagcttaattctgaattctttttttggcagttcagagattctgtcttggtttggatccattgctggtgagctggtatgatcttttgggcgtgttaaagaactgtgttttgtcatactaccagaagtgtgtttctggttccttctcatttgggtagactatgtcagagggaagacctgggattcaagggctgctcttcagattcttttgtcccatggggtgctcccttgatgtggtgttctcccccttcccctaggaatgtggcttcctgagagctgaactgtaatggttgtttttgcttttctgggtcttaccacccagcagagctaccaggctctgggctggtactgaggagtgtctgcaaagagtcctgtgatgtgatccgttttcaggccttgcaggcatggataccagcacctgctccagtggaggtagcaggagactgaagtggactctgtgaggatctttggttgtgtttttgtttagtgcactggttttgtgttggttaagctccaggcaggaagtgccactttcaagagtttatcagctgcggccctgtaaggaggatgcaaatttaccctagggagacctggttaagtattcaggtttctcaggcagtgggcagggccatagagctcccaagagattatgacctttatcttccgctaccagggcaggtagagaaagaccatctagtggggacagggatagtgtgtctgagctgagcctctccttgggcggagtttgctgcagctgctgtggggaatgggtgtgtggctcccagtccaagggagctatattccctggaggattatggctgcttctgctgagtcatacaggttgccagggaagtgggggaaagctggcagtcacaggcctcacttcactcccactcagcccacagtcctaaaggctggtctcactcccaccgaggccctgcaacagcaccaagtctatttctaggcagcccatgaccagggctgagaacttgccccagaccatgagcctcccggctgagaaaacaagttaactcacagtttttcagcatctcagggagcctgcagcagtgatccagttccttcaaactgtctgtggattctctcggctttcctggtatgtgcctgagaaagcaagttgactcagtttttcagcatctcagggagcctgaagcagtgatccagttgcttcaaacgtctgtggattccctcggctttcctggtatgttcctgtgctacaagaattgtagcaaaaaagctcatgatgtgagtctccacatgctgctctctccatatgagcaggagctgcaagctagtcctgcctcctattcgccatcttaatcctggtttgggctgattccatgtctttgctattgtgaatagtgctgtgatgaacatacatgtgcatgtgtctttatggtagaacaatttatattccgttgggtacatacccaataacgggattgctgggtcaagtggtagttctgttttaagttctttgagaaatctccagattgctttccacagtggctgaactaatttacactcccaccagcagtgtctaagtgttcccttttctctgcaactttgccagcatgtcattttttgactttttattaattgccattatgactggtgtgagatggtgtctcattgtggctttgatttgtatttctctaatgattagtgatgttgagaattttttcacatgcttgcccatgtgtatgtgttcttttgagagtatctgttcatgtcctttgcccattttttaatggggttatttattttttgcttattgatttgcttaagttccttacagattctggatattagacctttgtcagatgcatagtttgcaaatattttctcccattctgtaggttgtctgtttactctgttgatagtttcttttgctgtgcagatgctcttggtttaattaggtcccacttatcaatttttttgttggttgcaattgcttctggagtctttatcatgaactctttccagggcctgtgtccagaatggtatttcctaggttttcttctaggttttttgtagttttaggttttacatttaagtcatatgtctttgtgtaagtatttatgagttgtaattttttttttttttttgagacagagtctcgctctgtggcccaggctggagtgcagtggcacgatctcggctcactgcaagctccatctcccaggttcatgcccttctcctgcctcagcctcccgagtagctgggactacaggtgcccgccaccatgcctggctaattttttgtatttttagtggagatggggtttcaccatattagccagggtggtctccatctcctgacctcgtgatccacccaccttgcctcccaaagtactgggattacaggtgtgagccaccgccagcctatgagttgcaattttttaagtggaattaacgaatgagaacgtggccaggcatggtggctcacgcctgtaatcccagcactttgggaggccaaagcagatgaatcacttgaggtcaggggtttgagaccagcctggtcaacatggtgaagcctcatctctactaaaaatacaaaaattagccggttatggtggtgcatgtttgtaattccagctactcagaaggctgaggcacaagaatcgctcgaacctgggagacagacgttgcagtgagccgagatcacgccattctactccagcccggatgacagtgagaccccatctaaaaaataaaaaaaagaatgagaatgttttagaatacccaggactgcaatcaaggtcacctaagtttaatttctgggaagcagatttgaaattgattgaatttagtgaataaaaactgaatcaattttatcatgagatggtgagaatgaagcatagaaaaagaaaacccagtgagcaaaaagtatacattgttgtccagcatgctcagtcagtgcgaaaatatttattgaatatctatgatagagcaggcacatgcaaaggagtgagacactgactcagacaaacaggaattcagccctagaaagattctctctctgaggaggtactgctaatctattgcccctgtctgtggccttgatcagatttcatcttcactgagcaacttcaggtttatgccctgatcctgcatgttatacatgaatctttcaggcatttcaaagaatgtctcccaataaaacaaccactttcagaatcataatagcaacatcagtgtttactttgcacctgacagccactaaacactttacaatctaatttagtctttgcagttattctctgaggtacgtagtatctccgttttctagatgaggaaactgaggcttagcaagattaggtcagttgtccaagatcacattgctccacatagtggcagagtgaagataaggacatagttctgagtccaaagcccgtggtcataatccctgagctatcctgagtctaggattctggtttagacaattggtccttcattaatcagttgaaacaaatcagtgctttgctgtccatcaactttgagtgacctgataaagcttaatttttgcctgacagcaggccttgacccaagattacataaattcatggcaccatagtgaaaggcttagcttgggagccagtgcacatcccagaaggacatctatcttacttttgcccttctaatcccaaaaaaggtaaacagcaacaaggaccacagtgtttatgtaacaggaaaaatggcccgtgtgtgaaagacatagtattcttcctgagaggttttcttccatgtcactgctacttgcaagtatcttacaaggctattgattaagagttttattcattaacagcagtgaggttaccctaactaatacagtttcactgtgaagatattttctattcagacttaaaagactaattttgccaaggagtttgcaaagcccagaagagtagctttgaagacattgaaagtgaggttcaaaggacagctcatattttgttgtggctttattcaaaacatttatggcaatgatgagtttattcggatgatatgagagggaataatattctattaatgattttttgaaggcatctatacaatttcatctaaaaaatctcttgtgaaattcacagtctttaaaataaaatgaataggcttatcatttgggttctgatgcctgtgttctcatcggctgaatggtgtgttctcatctgccaaatgaggggtagagatgaatgagccgggaagtaccttccagcatcaacattctaggctggctcaacatgggaaatttaacttaaagtaggagtaatcgcttattacaaacagttcaagacttagggacaaatgaagcttctcgctcgtcttaactctgagcttggagcagaagtcatgaagtgtctgtgtaagaatgtgagcatatttacagacaccagctgatataaaggattctagctacattttaactaggctatcatttttttaaaaatcacatacattgtatgactctaccttaaataaaatgattaattgaagtatttctttttttgtgcaaagtagagtactgctagatcctcgaaaggtttctaagagaaaacacatcaaggcgcagtggctcacgcctgtaatcccagcactttgggagaccagggcgggcggatcacgaggtcaagaaatcgagaaaacatatcagctcagctaggccaatttgacttcctcttccttccgtcattttcttcacccctttgttctctgtcctttgaactcctcctcattagagcccctggctctctaatttcacagtcccaccatttgacattgaattcacctttccttttgacaggacctgctgctttatcttttcccttttctaactttgcaaagataaaatcttatttctcaatgaaaactgagactcagatacaaggtatacccaagaattgacttaattgtcaaagaaaattagtgatgagtcagataactgagctaacccaaatccaattttaaatctggtataataatggtcctttttcaaactcagagcataaccaaatcactactttttgaaggcttcatgaaactcaatcaagcatacagcagggtatgtgaatggcaatctttacaagaatcattagtaccagcctgcctttcaccggcttgaacctaaccaagctggaacaacctcaggtataactagaaactgaaatctaaacagcaaattttaagcttctgctccgttgagggttaaagtagcaactgcaattaattttatcaattaggctgagtagtctctaaaaacagatttgagaatttgattttactcttcagataatttgggttcttatttattccataagctaaagttagactctaaatctaatattctctctctctcttttcccccagctctgtctcctcacctcctttaccttggtcctcccacctcctttttatctctccctcccctgtcctccctcttctctctcctttgcctttggttgctggtgggggaatgtcctccaaggctcaggctttttaccatttctcctttgaggggtccagtccattcttgtgaatccacctctcttatctctgtctgtgatttctatttttggtctctagttctattctttcatctaaattccaggtctgcatgacacatttgcatgaatgttgtagcttgtctccaagaatgctgcctcaatttcttctcctgttagtgaattctatcccttcacccccttgaatctgggctgatgtgtgactgttttaaccaacagaaatagtgatgctgtgacacttctaaggctaggatttaagaagccttgcagagtccaccagggtcccttggaacacaaattgtgggagaagcaatccctgaagaaagccagccattatggaagaaatccaacgaccctgagaccactatgctgtaaggaagaccaagccagcaaagaagaagaaaccatgtccgggtgcggtggctcacgcctgtaatcccagcactttgggaggccgaggtgggcggatcactaggtcaagagaaagagaccatcctggccaacatggtgaaaccccatctctactaaaaatacaaaaattagctgggcgtggtggcacgtgcctgtagtcccagctactcgggaggctgaggcaggagaaccgctttgaacctggggggcggaggttgtagtgagccaagattgcaccactgcactccagcctggcaacagagtgaaaaaaaaaaaaaaaaaaaaaaaaagaagaagaaaccatatggagacagagatgccccaccagtacccaaatgtctcagacatcacaggcatcagacacattagtaaagaagctgtaagccaaccccagttatttgactggaatcatatgaggaaccctaagtaagaactacatctctgagctcatcaaggccacagaatggtgagaggtaatcataaatggttgttttaagccacaaagttcaggagtagatggttatatggaataaataactaccagaggtgtctaactttcattcaatcactgactctttcattcagcaattgtttattgaacactttatgtgcagcaacttgcaaggcactaggaacaagaatgaataagacaggcccaacccctactacttttatggggttgacggtcttttggaaaggcattgaaaaattggttgattgatcatttcaacttctaatacctgttcccctgtgctcactctaagctggtgacttttctcatttttcattgagactttagaaataatcagaaaggaactccttcatcaacctagaatgtagactcctaacctaccagcatctatgtaaaattctccaccttttcttttctctggatgaagtgtctccagagattccccgtccacttgagctctggatcccatccccttaacaatgacttctctatcactttcatcagaaagcaaacatgctccagatgatctcaaccaggatcccagcttgaataccatctttgggctgatggtcctggaacccatgtctccagccttgatctatctgcagaaccacagacttttatatattcagccttctacttggcccctcagcttagatatctgatctatctcaaacttagcatgacccaaatagaacgccagatgtttcacctgcaacctaccccctctcacattcttccctacccccataaatggcctcttcaccaattctatttctaaaatagataagttatccttattttctttctccccattccccccacatccaacccagtaggcagtcctattgactctaccttcaaaacatatcctgaatccacccactcctcttcagcttcagcatttctatcctggtccaagccaccatcctctcactgaattgctgaaatttcaagcctcctaacttgcctgccccatttcactctgacccacacaatctgagcctcctcttcgtatgggtggctgactggaaacatccaaagggcactgaaaaggatgttaacattctactaggttttagaacaggcctaaagtgagatacactgcatgactcatagcaaattactctaaaatccctctctagccatccatgcctgtttccagggcagccactcagaaatctctcctggctcctttccccaccctttctttgctaactctcccgctaaactcctccagcgttggctatttccctctcccctccccacttctgctcagctcttcactaaggagacccaattagctttctaggtctccttcaattcattttttattccaagcagcaacacaaagccaggctgtaagacctccttagaaagaaagggggaggttgcaaacatttgttatattattctgtttctttttcacccagtcacaaattctctctagggaaaacttttctgttctctgaaatgaggacatcatactctctgggtcaccttccagacaccccagcatacttcccccaatccttttctcctattggattcagccaggttctgctctgacataggccttgtgggggtggggtagagggcactactgaggttgctggtgaggaccaagtcctctagactttctcctagaaaagtgactttcacacttttcttttgcgactcactgtaagaaatacatttcacatctcacccaagtgcacatatgtgtacacacacacatctgaagcaaaaggttaatattacttaaccttcactctgatattttctattctctgtatgtcatttcaaaatggtactaatcatcttttagtgatacataccaaaatatttactgatgaaatgatatgaggtctggagcttgcttcaaaatctgtgagacgactggtgaaacaagattggtcatgagttgatcatatcaaactgggtgataggcacgtgggagtttgttatactattccaatattttatatatttgatatctttaataataataaatttaaaacaaaagaaaattattggtcatgccccactaaattgatttcagaacccactaataggccaagaactagtttgtaaagtaccttctagaaaaatctaggagttgggaagtttaaaattagatggcagggaaacaaatctacagttaaatttaatctaatgctctctttctaccccaccccctaatgaagtctatttcttcttccagggttaggaggtaggatatttactgagttttctgccaccctcagagtatggtttcatatcagatgtcattatttgccaaaactgaaacaaagaggtgatctccacccaccaagattcaagccagtttctcatgaactgcagtttcctagacatcaggggatttgtccctgggggccacagggccagccacctgggagattctatctgtgagcaacccagtcatgttggaagcaaactaagggatattgtctgtgaccaaagtcctggaaaggatctggtaggatcctgggctgggcaagaaaggctgctcagtctctcctctacagccaagctgttcaccacttctggctcatcagctgctccctgttgctttcctggtgttctctgatgacctccatgatcaccccatgctcttcttattttttaattagtttcatggaagtaagagctcaggcagccctttagtttgtggccaaatataaggttgtttggtatctcttggtcacaaggttttcctgaacaagcctcaactctgcttctccagagctctccattgtgctgagtggatgcctcagccgcctcttgtgtctgaaagcacacatgaaccatttctctattccctttgctaggtagctatgaactctacctagaaatcccactttggttaaaaaaaaaagtctttccatagctaaagcaactctgtcacaaaaacaaaggccccgcgaattttgagttcacaatgctgacttggcaaacccaatcttttccccacctgaggcctgtcaccttcataactcaaggttcccttctcccatctggcccacagtttcggtagtttctgcaagcaaataattcctacttgtggtttctaaacccttatcaattgaaacaccacagcggcccagttcccagtggatcccaacactattatcgtccatatggataaaaatgaatatggttcagggaggaaaaacacaatgaaaagatggtaaagacagtcaaggcagttctgtctggtgtctgttttaagtggggaaaaaaaaggaggtaatcattgcattccatctagacatgacagtgagatttactggaagtatttccagttgtgttcatctgccaaccctccaggaatgcttgataaagtttatatttgatgtcaagttgccagccacctgggatatgatctccatagttgaggttatgtttatgaaaaaaggcaagctcccagttgaggaaggatgggcatcacctattgcctgtaacagagaatgtgatcccatatactatttagaccagaaggctataaagctcattctgaggctgactccaccatcccagctttcctgaaaggtatctaccgggtagtgatagacctgtctcgtgaggactctggttatggggcttctgacattgtacctgcaacacccattgacctgtcagatcttctgagtggggactggcataaaaccgcatcaacatctttcctggaaaccatcagcaagaaaacccaagcccgagtcctctgactcctaaacagaaacatggagaaggaggcccctaaatgcactattgaattctaagattacataaacaacactgcagaaagatactgctaacttataaaagtatggacctcctggaagaaattaaaagcaatcccaatttccataaaatgtactattaaaaggttgctaacatccttcttaataacctgcatacataaatagctgattccagtggtaaccttccttaccaaattggaaaatgtgtcagtctaccatggcgggatgacagtgaactttattttatttactgtaattctctcctggaacctatttctcatcctgcctttgggttgctatcaacagctctcttggagactccctggttgcgaagccctcatgaagcctcagttcctccaattggctgagaaaactgacccattcacagtgactctgaggagtaagactctgaaccctggttaaaaaaaaaaaatcatacccactcaaaaagatgcttctataagccatgacatggtgatgctgctgcttctaaaatgcacactagtccagcttttctggggtctctagccaccagagatggggacaaggtctggtctaggactaggccacagtacagtcccttggtatcaggaagccccgctgtcagagtctttcatcactacagcagacaatggtgttaccagacggtgttgctggatgaccacacagtgtcagaggaacagcagtctgagtggtgagactcaggaacccactggcactccttacactccttacactacctaccccatgatgtgtgcccctgacttccttttcttttctgaaatggattcacatttcctgaaaaaaacttatctttatggaggctcaaataaaaattttttaataaaaaacaaacaaactgtatttagcctataagctgacgagggagtggatagtctcaatctaaagctgtctcaaagtccccgtgcaagtgtgactcgatatccattcacccaactctgggtcagacattcttaacaaagattggttctgcagttttagagtgggttccatcacttcctgatgattccaaggtgctgctccatgaggagatctgctgagactgcatgcacatcatttgctttgcacatcagtttgctggcagaccctcttgctgaaggtgcccatgaagttcagttctgtggggacatttaactatatttacaaataaatatgtatgtttatctggaactgagatactggtgagttgctgctacttcagggccaaggtccaggacaccttctctcaattttgccttgtaggcaacacacaggaactaaaaccaaagagaaaggctgggaaaggataagagattgtaacttatgttttcttgatttcctttgcagctcgtggcagagagttgagacttaagtaagaggcagggttactttatgaatttatttctttcttttatttatttatttttttttgagatggagtctcactctatcatccaggctggagtgcagtggcgcgatcttggctcactgcaacctccacctcccgggttctagtgattctcctgcatcagcctcccgagtagctgggactataggcgtgtgccaccatgcccggctaatttttgtattttttactagagacagggtttcaccatattggccaggctggtctggaactcctgacctcgtgatctgcgcgccttggcctcccaaagtgctgggattacaggcgtgagctaccacgcccggccttcttcttcttcttctttttttaaagtattgttaaaaacttttaacttttattttaggttcagaggtatatgtgtaggtttgttatgtaggtgaactcatgtcacaggggtttgttgcacagattatttaatcccccaggtactaagcctagtacccaatagttttttctctgatcctctccctcctcccaccctccaccctcaagtaggccccagtgtgtgttattcccctctgtgtccttgtgttctcatcatttagctcccacttacaagtgagaacatgtggtatttgtttttctgtttctgtgttagttagctaaagataatagcttccagccccatccatgttcctgcaaaagacatgatctcattcttttttatggctgcatgatatttcatggtgtatatgtacattttctttatccaatctgtcattgatggacatgtagattgattctttgtctttgctatttctaatagcactgcagtgaacatatgcgtgcgtgtctatgacacaatgatttatactcctttgggtatatgtaatgggattgttgaagtgtatggtaattctgcttttagctctttgaggaattgttacactgctttccacaatggttgaactaatttacactcccaccagcagtgtataagcattcccttttctccacaaccttgccagcatctgttattttttgactttttaataatagccattctgactggtgtgagatggtacctcattgtggtttctctaattgcacttctctaatgatagtgctattaagctttttttcatatgcttcttggccactgtattaatcagggttctctagagggacagaactagtaggatagatagataaatataaaggggagtttattaaggagtattaaattcacacgatcacaaggtcccacaataggccacctgcaagctgaggagcaaggaagccagtccaagtctcaaagctgaagaacttgaagtctgatgttcaagggaaggaagcatccagcatgggagaaagatgtaggctgggaggctaagccagtctggccttttcacgtttttctgcctgctttatattctagctgaactggccgctgactagatggtgcctacgaagattaagggtgaatctgcctttcccagcccactgactccattgttaatctccttggcaacatgcttacagacacggccaggatcaatactttgcatccttcaatccaatcaagtttacactcagtattaaccatcccagccacatatgtatcttcttttgaagagtgtctgttcgtgtcccttgctcactttttaatgaggctgtttgtttttttcttgtcaatttgtttaaattccttatagatgctgggtattattagaccctttgtcagatgcatagtttgcaaatattttctcccattctgtaggttgtctatgtattctaatgatagtttcttttgctctgcggaagctcttaagttcagttaaagcccatttgtcaatttttgcttttgttgcaattgctttcggcatcttcattatgaaatattttccagttcctatatcttgaatggtattgcctagcttgtcttccacagtttttatagttttgggttttacatttaagtctttaatccatcttgagttgatttttgtatatggtataaggaaggagtccagtttcagtcttctacatatggctagccagttatcccagcatcatttattgaataaggaatcctttccccattgcttgcttttgtcaaatttgtcaaagatcaggtggttgtaggtgtgagaccttatttctggattttctattctgttccattagtctatgtgttttttcttgtattagtaccattgtgttttggttactgtagccctgtagtatattttgaagttgggtagtgtgatgcctccagctttgttctttttgcttagaattgccttggctattcgagctctttctttggttccatatgaatttaaaaatttttttttctagttctgtgaagaatgtcattggtagtttgatagaaatagcattgaatctgtaaattgctttgggctgtgtggccattttaatgatattgattctttttatccatgagcatggactgtttctccatttgtttgtgtcatctctgatttctttggcaagtgttttgtaaatctcattttagagaactttcacttctctggttagctgtattcctaggtattttattctttttgtggcaattgtgaaagggattgtgttcctgatttggctctcagcttggctgtcgtttggtgtataggaatgctagtgatttttgtacattgattttgtatcctgaaactttgccgaagttgtttatcagctgaaggagctttttgagttgagattgtgtggtttttctccatatagaattatttcacctgcaaacaaggatagtttgactacttttcttcgtatttggatgccctttatttctttctcttgctcgattgctctgaccaggactatatttagtactgtgtttaagcaggagtggtgggagaggacttccttgtcttgtgccagttttcagggggaatgcttccagcttttgcccattgagtatgatgttggctgtgggtctgtcatagatggctctttattattttgaggtatgttccttcaatacatattatgaatttcaagggcccttagcacttttacttccctgggcttcttccttcattaaaaatatttgaaattatattttgtcactgcattgctgtaaagacaaataatattagtatgaaaacattttcttcaacctaaaagttattttttcttctaattttaaaagaaattaaaacattttcacagacctctgaaaatagtgtggatcttagttgttgtacctactgtgcctgttaagatatgcccattaagtatctgttgatggatgggtggatggatgaatgttataaaaaagttaactttaggggtaagaacatgacatagaagagagatggaggtatgaggaaatcatttactgtgcttccttctatctgttcacactgccctgagctccctgttctcagccatgatgtctggatctccaattcactttgaaggatgggagcattgatgtgaagcattgatgtgaagcttcatttcccacatataagtcaccacaacactaatacaagattatagttttcaaatttaaaataaaattaatttaagcacactgacagaaatatcaagaatgaattttgtcttcaactacaaacatcactgcagatgtcattagaaagactattctaaaagatgtttagaaaactaccttcagaatcttgggccttattatcataatatttttcaggtgttgattaattgagtatctagtcttatgatccactgagtcacaaatagaaagacataagattggcaatggcttctacaatatttcatatttgttattttcagaacatatcaacaagagaaaatttattatagtattttttgttgatgtggccctaatttgcttttccctgctgttctacaggtctacaatggtgagaatctaagatggaatcctgaaaatcctatgcttttcaaaatacattttgagttccctttaacctaacacacagatgccaagtggcacatttagcagtagactgggtgtgtcctcaagcaaggatggagtggcacactagagagtttgaaaatggctcttaatattgtcagaactaagttaactgagttattatcttagagcagcagtaggcaaactacaacctgtgagccaaatctggcccaccacctatttttgattagaccaggagataaaatggtttctacattttttcaatggttgggaaaaaagcctaaagaaaaataatatttagtaacatgaaaattatataaaattcaaattccactggaagaataatatttagtgacataaaaaattatgtgaaattcagattccagcatacataaataaagtttaatttggaacataactatgtcaatttatttatggattatggcagctttcatgccaaagaacaaagttgagtatttgcaacagagataatatggcccactaagcctgaaatatttactacctggctctttacagaaaacacttgacccctgtcttggagcacagaaattcctgaagaagatctgaagcaccaagtttcttttagtaatcccactatgggaactttttttttttttttttcagatggagtcttgctcttgtcacccaggctggagtacaatggcacaatctcagctcactgcaacctccacctcctgggctcaagcatttctcctgcctcagcctcctgagtagctgggaatagtggtattcccagctaattttttgtatttttagtagagacgaggtttcaccattttggccagcctagtctcaaactcctgacctcaggtgatcctcccgcctcagcctcccaaagtgctgggattacaggcatgagccatcgcacccagccccattacaggaactcttatccatgaataatgcataaatcatattgctagttcacctgtgttgatcttttactatgtgctgggccccatgttagatgtttccattcattatctcatttaatcttcacaacctagtgaggtagataatgtcaacatctctattttataggttagaaaaatgaagttccagggagattacctaacttgcccaaagtcactctcagcaaatggcctacctgggattcaaacccaagaccatctaatgtcaaagtttatgccctgagctatgttatcacaatgactcaagcctttcttggcattaaggatgtttgtcactagtacttcccctctgagaaaagactgcatgaaacttactatcttagtctgtttgggctgctatgccatggactgggtgactgtaacaacagaaatttctcaaaaattgtgcaggcagaattttgggagatacaaaatccaggcattggcagacccagtgtttggtgaggggctgtgtcctggtggagaaagagggagcaagctctcccctgtcttttataagggcaccaaccccatcatgagagctccatcttcatgacctagttatctctcaaaggccccatctccaaataccgtcacactgaggatctaagcttcaacatataaattttacaggaatacaaatattcagtacattgcacttactaactactgtgcaaagtaattcttccttttatttgtcttaaatttgcaactttcaagcttcccatgagactgactcctggtgagtttgtgtttatctagtcacagctttctctgctgtatgtattttaatcttatccccctctaggccttttttcaggggaaatggagggtctgtgctttctgtatatggaagtcccccctgctcttcttcaagcctgctatgatttgatttctttgaatgcaatgaccagaataatacatgatatttctaggttcaataaactggcaggatagtggttattttcatttcccatgtcttcttaatgattcatagcatttcactgttgttttagttcatcttcttggggctacagaaacaaaataggtaaatgttttcagcttacaatttcccaatcatattcctggagcataactttgctcagagccaagcatcttattatattgctcacattagttttctctgaatagtttaaatatcatttttctgcagaattaaaggtttttggttcttattctagagagaaaggcacagtacaaatagcgtgagtgtgtgtccctgcactgggaaaggctgaccagtgaggcaggaaaaacctatatttctttaaaagaagcagaacttccacattttcccaagagtaacagatatgatctaatctctgacagactctgttcctatgactcatgactctagatacatcttgtaacaatcaagctttatcttaacatggatgagagtatctatcacctgagcaatgcggataaagcagatctttttaaaggcttctgtgtcttccaaagaagtagaaacaatattttgattcgatatatcttatgcctgtcttcttaaatatatttttgcaaaacatatatgtctgacaggtttgtaggtaaatttgcatgtaagcttcagtgtaattgccagttggtggtggggggttgaccctgacacagctcctaacagtacatgtctaggctctctaaggtaatcagtctcacgggctgtataatttgagatgatgccattcatcaacctggctgagaaagactgtaattcctgcctggcaattcatctccacaatgaaagattctattgatgagactctttctggacattcatgcaactttttcaaagtcttcagtgtttttcatgacctctcccctctatgatattcatgcttattctgtctagtcagctagttccttttgtactaacttctccagtctctttttagaaaacctaataaaaatttcacccactctcactatttaacacatttcccattctatatgtgtttttttaatataaaattaagtttagaagccaagaaaaatacttttgtgataagggaaaccaagtgtgtggtatccctgttgattgtactgggcacctttcctcaaccaaggtgaacatcacactgtcctgagttctcccaggttcccaacacctcacggcagaaagaagagtggaccccttctgcctccaaggaataagtataaattgtgaagaatgaataattaattaggatattgctttagaacttatttttataactattatagtaaatgaatataatccatgtgtgaagataaacaaaatacaaacagaatacattttatttgcttaacaggaatctatactatagagtagaatcatgtcttacccagaacatagactctaaaatcaatctgtaataagaaggttacgtataatccaatcttctcttaaaaataatcaaacacagtattcatggctttggacttacaactttttgctgtgtgtgcaggatggacagaatataataaagaatacacatgccaaatatgtttacagtgttttatttccatgaaggtagttgaactggactcacaatatgcacatattatgtgatattatgtgactctactatatctcatctcttctgaatagtagtagtaatgatgatgatgatcatgatgacaatgattatgctaaaattgtgcagtatggttactggtagacactaaagccactgagatcatcacagtaccgctcagatctccttccatgttgtagggtcaaccttagccaaggacaaaatggtgccagctaagttcaaaggtaaactcatttagcatatttcaaatgtcttaatataatagccaacccaaacttttggaacctgtgttctacttattatcttgctttccatataagcaagtaatttgcttatatggaaatcacttagtaatttccatgtctcattaatagtctgagactggactcagcacagacctgaagaaacagctttctttggcatttcttcctgtaacctctccctgtcatcagacacttccattgacaaggaatgtaccccagggtgggtctcatttgcagactttaggctttactctatagctcaacctctcatgtattttgtgagtggagattccccacccaccctaccctatgattgactatgagattgacttatagtcagtctccatgagacagagattaactagaattactaattcatcttccttattactcttcattagataagacataaagagaaaaatagtaattaggtattaatgttcgtaattcacatatagaagtcagctggattacattatctagaatgcacaaactccgggcttgctgaaaggctagagaatgtgacaatgtcacacattcttcaggtggtcataattccacaaaaaggggcttgcttactgggctttttagaactggtacaattttatcaataacatttcacatattgacaaacaatttatttaaacttggtgtagatattgtgtcacagcatcagccagtgttctcagaggaggatccaaagcatttctggacaatcaaagctcagggacaatggatcaaggtgtctgcaagaccaggtttgacctaaagcccatggagctcactgggagcccaagtgaaaagagcactgccatttccaggctctaaatgggtcctacaggacagagcctgaaattgaactaatgcttagttaaaacaagagcaaccagccatatttgaggcttgcatcaaggtaaaggggccgtaaaactggcagagcttgaaaaagacaaagcttttagcccatgtcaaaaataattatgtaatgtgaatctctaatcttgtaattatctatactaaataaaatactctagaactagaattatttctaatttatttctaattatttctgtgtctagaaataacagtctgtggtcatgagctttctatgcatgccaaatgtgcagtgaggtgtttgtgagaggagagataggacaaaaggttgtaaatctcaggtttgtatcttttagaaaagaccttctgggcccttttcagaattgtggaatgttagccatcacctagagagactgccctagatagggcacttttaatacattagggacccgagaaaccaggaaaaatcttactttaggagagtaggttgcaggtagcccttgaaacaaagaatttctacagtcaattttggactctccctgttttattaaaatgcagtatacatgtgaactcttgcctatttaaaaaaattctgaaccacagaatatcacaataaaaagccagaaagaagaaggtaaaatgaaaccctgcattttgtcatgtagttattctggtttctacaacaactggagaagaaacaaattaaaaattaccaatgcttcttaaacattttcaaaattcttatgaaaaatttttctctagttttacatccttactgattccccaaactgacctcattattgataatgtagtggaacacaaacagcgaaatatagtcatgaatatgaaacatttgtacttaaaaatctagtctgaaccatcatagttttatacactatgttcatcaaaatataatatcacatgtcataatctgtcagattttggaaagaaaaatatttttatcaaatagcgttaatccttctttttcctagttgaaatcttatttttgaagcaattaatactttatataactcacataatttgtcagttgttcagtaggccgccaggagggcaaacccaaaattcagaccatagtgtggtctatcattatcaaaattagttattttctctaggaaacagcctagtcaaaaattaacttgccactttatttttaattgatacgtaatacctgtacacatttatggggtacatgtgatattttgttacgtgcacagaatgtgtaatgatcaagtcagggtatttagggtacctatcacctcaagtatttatcatttttatgtgttgggaatatttcaagtcctttcctctagctgttttgaaagatacaatatattgttgttaactataatcaccctactctgttatcaaacattagaacttatttcttctatctaactgcatgtttttactcactgaccaaactctattcattcttccaacccccaacacccttcccagcttctcgtaactatcattcaactctcaatctccatgagatcaacttctgtagctctcatagatgagtgagaacatgtgattatgtgatatttgtttttctgtgccaagcttaatttcacttaacatagtaacctccagttctatccatgttgctgcaaataacatgtgtttattatttttatggccaaatagcattccattgtgtaaatatagcacactttctttatccatccacctgttgagagacacttaggttgattccatatattccatatattgactattgtgaatagttctgtaaacatgacggtacaggtatctttctgatacactgatttcttttcctttggataaatacccagtagtgggattgctggatcatattatagttctgtttttagtttttctgataaatctccatactgtttttcatagtggttgtactagtttttattcctatcaacagtgcataagaattcccttttctccatatcctcaccagcatctgttattttctgtctttttaataacagcctatttaactggggtaagatgatatctcattgcgattttaatttgcatttccttgatgattaggaatattgagtattttttcatatacctgttgaccttttctgtgtcttatttttaaaaatatctattcatgtcttttgcccactttttaatgggattgtttggtttattgttgagttgtttgagttccttgtatattctggatattagtctctgactgaatgaatagtttgcaaatattttctcccattcaagagattttctctttattgattgtttcttttgctgtgcagaaactttttagtttaatcaagttccacttgtctgtttttgtttttgtttttgatacttgtgcttttggggtcttaggcataaaatatttccctagaccaatgtcctgaagtgattcccctatattttctgctagtagctttatagttttgggtcttacacttgcgtctttaacatattttgagttgatttttgtgtatggtgagaaataggggaacattcttttgcatatggatatccagttttcccagcaccattcactttttaaaaaagacatatttattcagcatcatgttcagacagactattacatctggcaatcaacagcatgagtggaaaaaatctacattaaaccccttttgttgggatgctttacactttccacagaacagaaacattaagctgttatacaattagtcacaactacattcctcaagtttttttctaatacagatgagtattgtctaaaacatgtccctttttttgtgtgtgtggtagctaggccctgccaccactgtgcttggcccagttcacaaatcctcttgtaacctatagcttccttatcacttctctagctttcctctactgctaagctttgtttcctggcagtaactaaaatcttctgctactgctgtagctattgctgctactggaaccaccacagctgccttggttttatggtttggcaaagtattggcctccaccaccataggaaccagaacttctgcctccaaagttttctcccttcatggattcaaaatttgaagactgacagttgtaattgccaaaatcattgtagcttctgccacctccaaaattgcttccactgctagcattaatgctgcctctgcctcctccattgttatagcagtcataggtgccaatcctgccatagccactgccctggtttccataaccctgttcaccacttctgtagcctctgcttcctcctccagagtaaccagggcttcctcctccctaagcaccaacattacagaattcattataactatgcccactgccaccatatccaccaccaccacagctgcctctaaagcctacacaaccattaaagtttcctccatgaccaaaattgtcatttccaccaaaaccaccttcacagctactaccaaagtttccaaaaccactgtgacctctttggcttcgtgaagccatctcttgcttttaaaagtgctttccttacttcccattatatccattcacagtatggtgtttctgaatgacagtcttatccacagagtcacggttgtcaaaggttacaaaagcaaagccctttttcttgccactgcctcagacagccatgatttcaatcatttaaattttcccattctgttcaaaataatctcttaggtgatgctcttcaatgtctcctttaatagcaccaacaaatatctttctcacagttaagtgggcacctagtctttgggaatcttcgcttgagacaactccctttgtttccacaactcttccatctactttgtgtggccttgattcatggctgcattcccctcctctaaattggcataggtgacaagcccaaagctcctggagcgctaggtgtttggatctctcgttaccacacattctgtgagtgtttcccattgctcacaatggctcctcagactcccgttggttgtttcaccaagcctttgatgaagaccttccacagctgtttggtctctttaggagaccctgacttagagtggcagatggcagatggcagaattagacagatggcagtgggaagatacttaatgatactttttccacagacagaaaagagtaagctaacaaacgtatatctcatttattatttgtttgtttttatacatttaagaaatacaagtgcaatattgttacatggatatattgtgaagtggtgaagtcagggcttttagtgtatccgtcacccaaataatgtatattgtacctgttaagtaatttctcatcatctaccctctcacactcttccacccttcccaggttccattgtctctcagtccacgtatatacattatttagcttccatttgtaagtgagaacatgcagtatttgtctttctgtgtctgacttacttcacttaagacaatggcctccagttctatccatgttgctacaaaagacatgatttcttttttatggctgtatagtattccattgtgtatatataccacattttctttatccattcatccattgatggacacttaagtgattccacatctatgctatagtgattgtaattttgtgctgtgataaacatgcaagtgtaggtatctttttgatataatgatttattttcttttgggtagatacccagtagtggaattgctggatcaaatggcacttctatttttagttctttgatacatttccatacagttttccaaagaggttgtactaatttacattcccaccaacagtgactggcattcccttttctctatatccttgtcatctgttattttttgtctttttaataatagccattctgactggtacaagatgatagctcatcatggttttaatttccctgatgattagtgatgttgagcgttttgtatatgcctcttggccatttgtatgtcttattttgaaaaatatctattaatatcctttgcccactatttaatgagattatttggggtttttcttgttattgatgagttgtttgagttctttgtaaattctgaatatcagtctcctgttgcatgcatagtttccaaatattttctctttttctgaaggttgtctgatcactctgttattttttctctgcagaagctttttagtttagttaagttccatttgtctatttgttgttttcgttgcttatgcttttgaagtcttactcataaaatctttcctaaaccaatgtcctgaagtgtttcccctatattatctgttagtagttttatagttgcaggtcttatattttaagtgtttaatccatttcaagtttatttttcatctatggtgagagataggggtccagtttcattatttgcatatagatatccaagcactatgattgaagaagatgttccttctccaatgtctgttcttggcatctttgttgaaaatcagttggctgtaaatacataaattaatttctagatttcctattatgttccattggtctatgtgtcaccaataccatgttatttttgttactatagccttataatgatgcctccagatttgttctttttgcttaggattgctttggttttctgggttcttttttggttccatatgaattttaggattgttttttctatttctaaaaatagcattggtattttcataagaattgcatggaacctgtagattgctttgggcagcatggccattttaatgatattaattcttccaattcatgagcatatgatgtctgtccatttgtttgtgtcctctttaatttatttcatcgtagttcactagtttccattatagaggtctttcacttccttagttaaatttattcccacatatttcattattttatagctattataaatgggatcacttttttatttctttttcagctggctcgatattgttgtatattaatgctactaatttttgtatatcgattttgtatcctgcagtattaccaaatttattcatcagatctaagagttttttggtggaggctttaggcttttctagatataagatcatgtcatccgaaaagaggagcagtttgacttccacttttccaagttggatgccttttatttctttttcatgcctgattgttctgtctaggacttccagtactatgttcaataggagtggtgaaagtggtcacccttgtcttgttccagatctaaaggccttcaattttccatttagtatggtgttacctgtcatatttggcctttattattttgaggtatgttccttctatacccaatttgaggaggtttttctttttttatcatgaagagatgttaaattttatcaaatgctttttctgcttttattgagatgatcacatagtttttgtcctttattctgttgatgtgtgtatgttgaactgtacttgtatccatgagataaataccacttgatcatggtgtactgctggatttttgggggtcatatttgttgaggaattttgcatttaaattcatcaaggatattggtctgtaattttcttttttattgcaaacttgtctggttttgatatcagggcaatgccagcttcatagaataagctatggagaagtccttcctcttcaatttttggaattgtttgaggtgttagttcttccttgtaattatggcaaaatttggcagtgaagatatccagtcctggactttcctttgtggggagacttttgatactgaatcaatctcattacttgtaattggtctgttcagtttctctctttatgattcagtcttgataggtcatatgtgtccatgaattcatctatttcctcacagttacctagtttgttagtgtatggttgttcatagcaatctctgattatcttatgcatttctgtgacaacagtcgtaatgtctcctttttcatttctgattctatttgtgtcttttttttttcttagtctaactagtggtttgttgattttgtttatcctttcaaaaaacagacttttcagtgtgttgatcctttgtatggttttgtagtctatttcatttagttctgctctgatctttattatttctttccttattttcttgctcttctaatttcttaaggtgaattattagaacttactggggatccttcgacttttttgatgtcagatttattgttataaaattcattcttatcactgctttggttttatcccataggttttggcatattgtgctttgattctcatttgtttcaatttttttgaacttcttcctaatttcttccttgacccagtggtcatttaggagcatgtttttaaatttccatataattgtacagtttccaaagttcctcttcttactgatttctagttttattccattgtggtctgagaagatacttgatatgattacaatttttaaaaatctgttgagacttgttttgtgtcctaatatatggcttatcctggagaatattccatgtgttgatgagaagaatgtgtattctgtagctgttggatgaagtgttctctgtctgtttggtccatctggtctaatgtgcagcttaaactcaatgtttctttgttaattttctgtctagatgatctgtctaatactgagaatgggatgttgaagtccccaactattattgtgttggagtttatctctccctttagatctaatatttgctatctgtctgggtgttctggtactgggtgcatatatgtttagtataattatatcctcttgctgagttgatctcctcatcattatataatgaccttctttgtctctttttactgtttttcactttaaagtctgttttgtctgagataactatagctattcctgcttatttttggtttctgtttgcatgggatatctttttctatccctttattttcagtctatatgtgtctttacaggagagatgagtttcttggtggcatgtagttgagtcatgttttttaattcattcagccactctatatcttttaaatggacagtttaattcatttacattcaaactttttattgctatgtgagggctattcctgtcattttattaattgatttctggttgttgtgtatatcctttgttcttttcgctctctcttactatttatcattgtggtttagtggttttgtgtagtaagaacatttgaattctttttcttacttatttatgtgtttgctctccagtgcattttatacttttgtatgttttaatgaggatagatatcatcttttgcttccacatgtgggatttccgtacgcatttctttttctttctttttaaattttctttctgtttttgttttttaagagataagtgtcttgctatgttgcccaggctggccttgaactcctgggcacaagtgatcctcctggctcagcctccctggtagttatgactattggtatgcaccaccacatctggtcaagtatttcttgtaggaccagtctaatggtgaagacttcctttagcttttgcttctataggaaagactttatttctccttcacttatgaaggataactttgctgggtataatatctttggccgacaatttttttttcctttcagcattttgaatatataatctcattctctcctgagctataaagtttctgctaagaaatctgccattggtctgatgaggcttccctcataagtaactatatacttttctcctgctatttttacaattctctcttcatccttgacttttgacagtttgactgtaatgtgctgtggagaagacctttttgaattttatctgtttggaaatctctgagctttctgtgtctaggtatttcttgctagatttgggaagttttcagctaaattttcagctaaatttcattaagtaggtttactatcccttttattttctcttcaccttgtgggacatcaaaaatccaaataatttggttgccttatggtgttccatatgtcacataggctttgttcattcttttttctttatttttgtctgactaggtgattttaaaagacccttttttggctgggcacggtggctcacgcctgtaatcccagcactttgggaggccagggtggttgtatcacctgaggttaggagttcgagaccagcctgaccaatatgatgaaaccctgtctctactaaaaatacaaaaattagctgggtgtggtggcatgtgcctgtaatcccagctacttgggaggctgagacaggagaatgacttgaacccgggagttagaggttgcagtgagccgagatcacaccattgcacttcagcctaggcaacaagaggaaaactccatctcaaaaacaaacaaacaaacaaaaaacctttttcaagttctgaaataatttcttctgtttggtctagtctattgttaaagctgtcatatgtattttgtattttattcaataaattcttgcattactaaatttatatttggttctttttatgatatctatgtctttagtaaatttctcatttatgtcctgaattttctgatttctttgtattgtttttctgagttctcttatgtctcactgagctttttaaatattattttgaaccattttgaattatttttctgagatttcataaatttctttttcattggaatctgttggtggagaattattgtgttcctctggaggtgtcatatttccttgccttttcatgtttcctgtgttctcatgttgatatctgtgcatctggtataatggtcacttcttccaattctttgaatttgctttcatagcggaggactttttcctgatgatgtccctgtggcattggttggtagggtactttgactttgaattagggtgtatgcaatagtgtagtctctttttgatttctttgcctataaacagtgtcaagagtgtctgtagttccctcagtggcttagggtgtaatcattaacggagggagtggtgaagttttgttggagacagggacatcaggtgggccagccattgggtcccaatggtggcggcagcatgccaagcatgcctgtccttcactcccagggaagtatatactggcattgtttttagcaggtacaggtgagccaattcttgggcctccaggctgcttacttgggagccagtagtggcagtggtgggtcaggcaggtgggtgggtccttgggcctctaggcagtgggtgtagtgtggccaatgacagtagcagtagtgcgacaattctctggttcccaagtgatgttgacggtggctgtgataggctgggtgagccagtccccaggcctgaaggtgatacacatgggtgagtgccagctatgatactagcagcaggttgggtggtctgttctctggcctccaagaggagtcctcacatgccaatggtggtagacggggaagggagatccccaggttcctgaatggcgtgcctgggcactggtggatacgagctgggccatgtagacctgtcctcaggccccttagaggtgcatgcaggtgctagctgtggtaggcaggggtgagatgatcaccaggcctctggctgaaatgctcaagtagggggaagctgcagctatgctgcaactctgctcctgtgaagagcagggttgctttcagtggctgcagtcttaaatgtatggcaggggggcatacaaacttgggcccttggtggcagatttaaggaggatagcctgtcctcagggtgctttcaaagcagccatgctactgggagtggcagggttgctcccaatagtttgcacttcagccctggtggcagcaactagcagcagcacctggctgcatgcaaggtatgtcagtggggctctatggatatggagatgaaagggctactgagccccagggcaggatgcaggctggtgggagctggactctcaaagtggcactttgctgtagctgcttaggactccaggcatctgtgggacccctctctgaagcaatcctgttatgcagtctccaggcagatccctatgttagtctcagggccctcatgagttgaggggctctcccatggctaggattgggagagtctgcagtgagaatgtagatcactgggagtcacttactctttccccacattgaggagcctctgcagactcccaactgatcctgtcatccctgagctgactacctcactcccctctcctttgtcttaggtgtctactgtcatttctttgttgaattccagtgttcttaggtgatctgttagaaatgtgattattggccgggcgcggtggctcacgcctgtaatcccagcactttgggaggccgaggcgggcggatcacgaggtcaggagattgagaccatcctggctaacatggtgaaaccccgtctctactaaaaatacaaaaaattagccaagtgtggtggcgggtgcctgtagtcccagctactcgggaggctgaggcaggagaatgacgtgaacccgggaggcggagcttgcagtgagccgagatagtgccactgcactccagcctcagcgacagagcgacccactccttcctctgtttaggaagatgattaagtgccaaactatgtaggttcaatcaaaccatctcctaactaaataactttaggcaagtactcaccttctccatgccttaactttcttatctgtaagatgagtaacaccaaccttatatgatttatgtggattaattgagtgaatatttgtaaagcactcaaaataatgcctgtatgtagaaagcattatataagtgtttgctaaataaaataaatacttcattgatttattttaacatttaattaagatgacttaaataaatcaccattatgtctgacaaatagtaagtagtcagcaggagttgccattaccattacaggaggtgatgtggtgatcattgctaaacatttccttactagtagactttcaatcctacactggggagaagtctgtttgctcattaataatgagagttcataaaccttatgcagtttttgtccttataggccatattatcaagtaaaacagtgatggtaagggaaaatttgttcaagaagagatcccgcaggagtttaaaaaaaaaaaaaagaggggtggtaatataaagttgtaactgtcaggactgttcaaagctgatgaaaatgttagcgaagaaccaaggctttacctttagagtgggcataattaatacggaagaaatcaagctttcagagcctttgccagagactggcagcaacagcattccctgggagcttgttagaaatgcagaatattgggccctcccagagtcagaattagcaagatcccccaggtggttcttatgcaaattaaaatttgagaggcattgttgtataatatttttactttccatgtttttttcctgtagtttattttgaatatgccatatcaataatactaacattttggccatattaggtcttttttaaagtgatacatgtttctttgaaggtgtgactaaaatttggctacatgcaatggttttagtatatcccagggacaattttttctaatcaaaagtcacctctggttttataatgcaaataagcatgaaaggaggcaccatgcatgttttatagcaaatgtcactggcatttctcaggtttattacatgagggatgcatgtttttaaaaaaaatcatctccgaatcacaagagttcagaattttatcacttttcactgttcactcttgcttatcctgaaggtgacaaatgaaaacaggtctctgattcatgcttcttctgctataatgaagccacaactcactgacttttaaaatagaatgtttcaagaccaaatattttatttggatgtatctgaggggctaaaatatttctattgaaactctctgtgagaaaacattctagatatgaaacatctgtttttggtcattccagttaaagactaatatttgcgcagggcagagaggcccatggtaatattgtgttgttctaagtacagtattcccatgattcaatattcctgaaggattgggtcaaagtattcacccaattaacatggctcaaacattcccaacatatttgtgaatatgtacatctgcaaatatattaaacacactttcccacttcctctttttctttctttttggggatagagggtggggagagtgtgggtgggggttggacacagctatggaaaaaccctgaagctcaagatcaggggtaaagtgcctagaaagagtcaagggagacaggaatgtcagatttagtattccttagtaggagtcattacaaccagaggctctttcagacgaccctctgggtcagagtgaagatgatcaagacacctgccatttactatggtgtggctgtgggggccattcgtccccaccttttgcagagcaagaggtcagaaagttccatcctctagtctaactttctttgtgtagggtactggagctgaaggccttgtgatcaaacctttaggttttcaaccttggctgcacagttggaatcacttggggagctttaaaagttactgatgcccaggtttcacccccagacattctgattgaattgttcttgagtacaacctgggcattgagattatgatgaccaatgtgcagacaggggcctctgtaccacaacccttggggctcctctctcgcttcctcagaatacaccctcctctctgatttctgctcctcatatcattcaattccttttctatacccccagagtttccatcgcagatcctttccaaggctgggttcttctgcccaccgtgtttgagccctcagtctcttggttcttggaaatcattatgagctgaattgtgctccccaaaattcacacgtatgttgaaatcctaacacccatccagtaccttaaagatgtgactatagagccagggcctgtaaagaggtaattaaggtaaaatgagctcatatgggtgggccctaatccaatataacaggtgtccttacaagaggaggacattaggagacagataggcacagaggaaaaaccatgtattactacagagagaagatggccatctacaagccaaggagaaaaacctcagaagaaagtaatcttgtcgacaccttgatgtcagacttctagctgctataattgtgagcaagtaaatttctgttgtttaaatcccccagtctgtggtacttgatatagcagtccaagcacactaagacagaaatcttcccagcacacagggtgcattttgagtcacggtccttctctctgcagagactgagtttgctggcatgtagattagcctttaatatctgagagagtttttgcatagagaggaacactcacaattatatgaaccttaatgtcagtggagtgagcatttaggtattgatacaaaatttgattaaattcctttaaacagcaattgcaaatttagtatgtctgattcttttgaacatttcaacaccctaaaatacaaaatacacaaaatgcattttgtagataaaacaacaaaacttattacaacatttaaccttaagctattccaaacatcaagtaccatgtggtgaatttatttcttccttaaagttgttttatacctttctaggattagagataaacttattttgatttcttcctaatgtttcagtactattagttggataccttctgggtagtaatttttactcaaccccaaattccctggggtcctggattttttttctttttttttttttagatggattctcactctctcgcccaggctggagtgcagtggcatgatcttggctcactgcaacctccacctcccaggttcaagtgattcttctgcctcagcctcctgagtagctgggattacaggcacccaccactacatccagctaattttttgtatttttagtagagacggggtttcaccatgttggccaggctggtctcaaactcctgacctcgtgattctcccacctcagcctcccaaagtgctgggattacacaaaattcagttttttcttctaaagtgacttaaacctaagacaatagcctctctttcttattattaaactttgttgttaggttgcttaaactttttaaagtcaactcctttctctagattttagtttgcccccagaacttggtgtttgttttctgaaataatgtattttaaagtctcacttggtcaagatgatataatacattaccctatattggggtagattgatctgtcatattagggttttaaacaacatatatgttcttattggtactttattgcttttgctggaaccaccagagtttcattacctcagtctgtgtgcttagcaaacctctgtaggacatttaggaaatttatcgttttggaatacatgaatggacctcttttttatttggtgatgcaactgacccctggtgctaattaacaatccaattattctatactttttgttaactcattagttagaagctcataacccttcataaacaccacttgtttcaatttaaacttattctatttttatgcttatatcaccacataatgactagagcctatcttctgcttgagcttgagtgacatgacaagcaaaatatcttctaattagttaaccttggaagatgccattttcaaagcttcctacccaatccatggcttcttcacatccttacttcacctaggggagcagggagaagggcagttttggccacacacacaaatgggatcttttgtgttgagctgatgaatagagataggatggcatgtcttcttttttggctgattttgaacctctttggagaggctaaaagcagacacagtcaagtgggactttgtgagatttacccaagctgagctgctttggaggcatatgcaacaaagaatggcccagagttaaaaggaaggttctccttgtatttttggagacagagtcttgctctatcccccaggctggagtacagtggcataatctcagctcactgccacctctgcctcccaggttcaagcgattctcatgcctcagcctcccaagtagctgggattacaggcgtctgccaccacacctaggtaattttttatttttagtagagatggggcttcaccatgttggccaatctagtcttgaactcctgacctcaggtgatccttggcctcccaaagtgctgggattacaggtgtgaggcacctcacccagccccccttgtttattataatgatgatgatgatgatgacagctttttattgtctattgtaccagagcctgtggtcctactttgtatattttatatatatattatatagtcctcaaaatagtctttatttagtcctcaaaatagtcttttgagctaggtattacttattgggctattataaataatgctgtttttcagcctcttttaaaggttttttggtgcaaaaaatgtgaacacgtttttgttgcatgtatacctatggttggaatgaataggtcctagggtatgggtacgatcagctttgggagatttgatatatatcacatcataggagctcaagactagcctgggcaacatggtgaaaccctgtctctactaaatatacaaaaaaaaaaaaaattagccaggcgtggtggtgagtacctgtagtcccagctactcaggaggctgaggcatgagacttgcttgaacctaggaggcagaagttgcagtgagctgagatcacgccactggattccagtctgggcaacagaacaagactgtgtctcaaaacaaacaaacaaacaaacaaacaaacgaataaaccccaaagatacatatttatcacatatcagcatgcacattatatcaacatgacttattattgttgatgctaactttgacccacttagggtcatgcttgccactcttctcttgctatttttcccttttcatattctgttcattagcaccaagtcactaagtccagcctacactcaagggaaaaggagttaaactctacctctggaggagagtatatgaaagactttataggcttatgttaaatgaccacagtaattaataaatatttagaaggaaatactttgagtttatgcaaatatctcactcatcctaaaagtttcactcactaattttagcattcatcagtggatcttgctcatagtagctattactgtggtgttctaatggtgattttctatttctctcattccttctatatttagtacttacaattcttctgtaaggaagatttgtcccttcttacccatttatgtatgtatgtatgtatgtcagtatggagtcatgaatatcacgaagattctattttggggctttaatccaatactaccattacttaatttgttgctcagattgttccaactttggccattggtagcactttcagttggttcttgtgtgtcttcaatatacaccatcctttttttttttctttctttcttttttttttgagatggaagcttgctttgtttcccaggctgaagtgcaatggcgcgatcttggctcactgcaacctccgcctcccaggttcaagcgattctcttgcctcagcctcccaagtagctgggactacaggtgtgtgccaccacacctggctaattttttgtatttttggtagagatgggggtttcaccgtgttagccaggatggtcttgatctcctgacatcgtgatccccccgcctcggcctcccaaagtgctgggattacaggtgtgagccactgtgcctggccttttttttgtttgttttatagagcactttcttcttaatcagctttgttgaggtataatttatataccataaaatttattgacgtgtatgcacatattcaactttcatactcatcacatcaggaggtacatgatatcaatatgaattttagtatatttacagagttgtaaaactaataggacaagctaattgtagaatacttccaccatcccgaaaggaagcctcatcttcatttgcagtcattttcccattctcagtctcagccataggcattcactaatctaatttccatctctatagagtttttttctggacacttcctttctggcactgtaagatgctccaggctcatattgtatttactctgctctagatctagaaacaactatttctttaaggagcactggttctgtttgttggaaaaaggtatttagatttgggaggccgaagcgggtgtatcgcctgaagtcacaagtttgagaccctggccaacatggtgaaaccccatctctactaaaaatacaaaagttagcagggcatggtggtgcgtggctgtaatcccagctactcgggaggctgaggcagaattgcttgaacctgggaggcagaggttgcagtgacccaagatcatgccactgcactacagcctgggtgacagagtgagactccatctcaaacaaacaaacaaacaaaaaaaaggtatttagaaataaagatctaagtagtatgtctacttgttactacttgagtgtcattgcttcagcttctgttagtgaacagaagtaggagatatatgtatgtatactaacccatgtatctacaatacctgtatttatgctcatatatctgtatacatattaatataaactcatgctgataaatgtgactctaatccagcaccacaggggtcattctaacctttcactcttgcccatttgtaacttctttctcatgtcagtgagaaacctggctctcattatttacaatatattttcttattcaatttttattttttattttttgttatttagtttttatttcatgatcataaatgtaactgtgtaatccagctagacatggaagggaataaggaaaatatggaacctaaagaatagcagagatagcacaaagattataggatactgtgagcaaatgggttggaggggtgctctcctgagctacagaagcaattctcttgtggttaacataaaacatgattcaaatttattagcgttttccacagtcagcaatgatcttcttgctggtcttgccattcctggacccaaagcattccatggcttccaccttattagtgcctgcttttaccttgccgaagaccacatgcttgcctaccaaccactcagtctttgcagtgcagatgaaaaaatgggaaccatttgtgttgagtacagcatttgccatggacaagatgccagaacctgtatacttcaggatgacgctctcatcatcaaatttctccgcatagatggactttccaccagtgccattatggcatgtgaaatcaccacccagacacataaatcctggaataatactgtgaaagcaagaactcttaataaccaaattctttctctccagtgctcagagcatgaaaattttctgctgtctttgtattaatagctttgtctgcaaatggatctaaggaaatgtggcccaaggactcaccactgacagtgatgtcaaagagcatggtggggtcgactatggctggtgtcaggggctctgggcagtgacagtgtttgcaaagcacttattcattttatatacatgtgtattaggttgattggtgatcctcaaaaatatatgcctatgtcttaaccactggaagctgtgaatgtaaccttacttagaaaaggggtcttcacagacataatcaaggatcttaagattcatttacattagattatcccagtgggccctaaatccaatgacaagtatccttataagagacacgcagagaagagaaacatagaggcaagacgagaagaccaggtaaagacagaggcagagactgtagtgaagcagccacaagtcaacgaacacctgaagtcaccaggagctggaagacacaaagaaggattctcccctagagacttcagagataccgcagctctgacaccttgattttggacttccggttttcagaactgtgaaagattaaatttctcctgctttatgccaccaagtctgtggtaatttgttacagcagccttagaaaacacaacatgtaaaagagtttcagaattgctaaccaagctcctgtgagaaacagatttaccaaccagagtgtagtgtttgtgtagttttgtctgccttgtagtatcaagtcaaaatattgcatttcaaagcttcttaggtcagctttatcagttagtgctcttttgtggtggggagtggtctggcttctttcattaaacatgattcactgttgttggatgtatcagatgtgttattttttattgttgaataatattccattatatgaatacatcacaattttctaatccatacctctgctgatggacatttagttttttaccagtttggggttattacaaataaagctgctaaaaccatttttgtccaagtgtttgtgtaaacatgtgatttaaagttccatgatagggtgtgggatggccgcggagccgggcggagctggcttgcggctaccggggccggctctctggccggagacatggcccgggggcccggcccgctaggcaggcctcgccccgatacggtcgccatgcccaagagaggaaagcgactcaagttccgggcccacgacgcctgctccggccgagtgaccgtggcggattacgccgactcggatctggcggtcgtgaggtctggacgagtcaagaaagccgtagccaacgctgttcggcaggaagtaaaatctctttgtggcttggaagcctctcaggttcctgcagaggaagctctttctggggctggtgagccctatgacatcatcgacagcagtgatgagatggatgcccaggaggaaaacatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcactgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcattcaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaaaaaaaaaaaaaaaaaagttccatgataaatacttaagagtacaatagctcagtcatatggtgggtttgtgtttaaaattttaagaaactgccaagttgttttccaaaaggctgtaccatattttacattcccattatcagtgtatgagtttgtagtataaagaaagaaattaaaaactttttgataaggtccaatttatcatttttttcttttgtgattcatgcttttctgtgtcctaattaagaattctttgcctaattcaaggtcacaaagacttcttcattttcttctagaaatattataattttagctcttaaatttaggttaggatcccctttcattttttgcagagagtgagatgtaagggtagaggttcatttttttgcacagatgtccagttattccagcactattttttgaaaaaattatcttctcccattaccttgacatctatttgaaaaagtgattgaccatacatagatctatttctggagtctctattctggcctactgacctgtatgtttatccttgtgccaatattacatatactgtagacttgatagccaatagtgaatgtcctccaattctgttgttcttcaagaaacattttcttggttattcttggtcctttgcatttatgtatgaattttattaacagtttgccaattttttctctctctgtctctctcactcactatctctcatacagacacacacacatgcacacacacataactgttgggatttcaaaatttctcattttaattatcacaaaaatacagaaaattgcaccagttataggtatatagcttgatgaatttccacagagttaacacatccatataaatagccctgagatcaagaaacagtactataacactactccagggcacccttcaaataatctacccaaaggatacactttatctggcattttttaactgtatgtttgtgagtttcattcatatgttgaaaatagttaccattatgtttattctcactgctgtataatattccattgcatgaatataacatttattatccatcctatttttgataggcatttgggtgtttccagtttggagttactatgaattgtgctgtgaacattcttgcagtcttttagggaagacatggaagcatttttacttggatatatatctaggagtggaactgtgaagtcttaggtttgtgtatgttcagttatagtagacactgcaagcatcatccaaaattattgtactattttacgcttctaatagcagtcagtgtatgtgttgttctgattggtaacacatggtattttctctctttttcatttttgccattctaataggcaaatagtgatattgcattgtggttaaacttcaattgtggtaaaatacacataacaaaacttactatcttaccaattttaaagtgtacagatcagtagaataaattctattcacattattgtgctaccattaccatcgtccacatatagaactcttttcatcttcttaaactgaaactctgtacccattaaacaataattcatttcctcctccctccaggcctggtactccattctatttactatctctatgattttaactgatctaagtatctcatataagtggaatcatacaatatttgtcatttagcgactgacttatttcactaagcataatgtcctcaagatttatccgtgtcttagcatgtgtcagaattttcttcctttttaaggctaaataacattccattgtatgtatataccaccacttgtttatccatctgtcatggacacttgggttacttctaccttttggctattggaaataatgctgctatgaacatgggtgtgccacatctgtttgagttattactttcacttcttttgtttttatacccagaaatgaaacttctggatcatatggcaatcatatttttaattttttgaggaaccaccttactattttctatattggttgtaccattttacgttcccaccaagagtgcacagggattccagtttctccacatccttaccaacacttagtattttctgttttttttttattataatagccatcctaatgggtataagatggtgcaaaagataattttctttttcctggtgaataatgcagttgaacatcttctcctgtggttattggcctgtaatctcttttgcagattttccattcaagcctttgcccacttttcttacaaattgtcaccctttttctgttgtcctatagtttacttacatattttgaacgagtactatattagtctgttctcacactgctataaagaactacctgacactcagtagttcataaagaaaagaggtttaattgactcacagttccacagtctctgtacaggaggcatggctggggaggcctcaggaaatttacaatcatggcagaaggtgaaggagaagcaggcacaatcttcacatggtggagcgggagggagagagtgagcgaagagggaagtggtacatgctttcaaacgaccagatctcatgagaactctatcacaagaaaagcaaggcagggagtccaccccatgattcagtcatcttccacaaggccctgcccctgacatgtgaggattacaattcaacatgagatttgggtggggacacagagccaaaccatatgaagtactttgtcagatgtatgtgttgcaaatatcttctctcattctgtgggctgctttttctagtggaagggggaatcagtggcttatgctgtctctatgattttgaaaaccaaacttcagttctacccattccttaaggtctaacagtacttgggtcttttctatgaaacattgttttattagtttcttataactccagcctccattaattttcaccatctctgcccttctagagtgtttaccacctgattttgtgatctaatggtaatataattagttcatatccttgtttgcctctcacatactctacagccagaccacattgctcacgtgctttgcatgcattactttcctgcctgactttaaatcagagggcaagggcctttttaacaaatgttatccttaatacataccaacaagtacagcggtagcaagagctgcaacacttgttacctgtaacaagagctacaatacttgttatatgtaacaagagcaagagctcaatacttgttatatgacttgaaaaatgtaaatattaccaggaatatctactatccactaaaagaactgatagcaaataaattgttccaattaaatattttgttcaagaggtcttgaaaacaagccatgtaagtcatcaagtgagtctaacctctacaacataaaggcatcgtattgaaagtgtttcactttaacctccctggattctatttggaatttcagttattaacagtcctgcataccaccttcatcatctacttcatctagttactcacttacttctaaaaatacttacttttgacctcaggttggtaaaattagcctactctcatgtttgtttatgcttttgttctgctgctggtctctttggtcaatgtccatctattcatattatgagtttggatcagcctgaaatggtaaagtgggataaggtgtcaacatgatctttgacagtcttattatgtgcataattagctacctaatataaatttctcaataagaatgcgggtgctgtagctggtggtggtgaagtttacattctttgaaaatcaaatgatttagacatctatatatttgacattcacttttaaaatgcttgtaaatggaacacagccattgctcaatttacactttccttttagttctctgtcagtatgtttgtgaacccagaaagaatttttcccagaagtgatatctgagtttcattgggtaaaaataaaagattttaaaagcctcatttaatacttttttgggggaaacagctacttaattaaattttattatttgtcctctgggactgagatgaagaaaaattagacatgtaatctctttggggggtgttttgatggattgcctgcatttctctcatatcagataacaagatggccaatgtttttgtaggctttgtgcctttacccttggaattctacaaaaaacatctctcaagttcacatataacttggaatgaaatgctctacatgtgcttccagaattctcttttctgcatcaaatcagaaaaaatgagtcataactcataaggaattttctgtcagctaatgtgatatttagggaggtacacgaaatcgttgaagcctctagggcactatttaatgtattattgccaaaaaaaaaaaaacaaacagtagagcaattttctatgatatggctaattcagtcattattacaatagggatgcaatagatgtaaagcatttcctcaagagcttaactcattatggaaaagcaaaactggataaactagaatgcttagagacctgaagtgggatagcaaaatggatattctggttagagcagggtctggttgcacttaacacaggctgattacagtactttaaccaagtaaggagtttatttacccaatctaacaagagtctgggggtaggaaatgaatggatagtgaaggtccttgagagaacaggcccctttcccctcctgctccacaatgctcagcacttacgaatgactgccccactttgacactgaatcacaatctggacaagagaaaagacaggttaaaagtagaaagcttatgccagctgagcagtcctttacagaaagatataggtatcaaggaaaaaatagctttccatgaagtagcttttgatctagtttattggccaatggactagatgaccaccctagctggaagggcatttatggaggtattttaaattatttactattatctcaagcaaattcaagattctgttagcaaggaagaagagtacatactggataggcaaaccagcaatgtctatcacatttgattaactgaattaagtgccacacttcatattttaaatcttgccatcagacatttaaaagaatgtatttcatccatttccacacaattcaaagttcaccaccacacagatcataaagaagtttttttttggttattttttctcaacttacctgatatttcaataagaaatgataacttatgatacagccacttgatggactactgcacagtcattaacaatgaaaaatatgtagcaaaagatttgcacaagcacttcacaaaaaagtatctaaatgactaacaacaagaaaaagatgctcacctttgtcattggaaatatgcaaattaaagccataattaaataccataatacaactagcaaaatgtttaaaattaaaaagacacacaatatcaactgttggtgcatatgtggagaaactgaaatcctcatacagaaattattagagaaatcttcaaaatacccttttcctgccaaataaagggaaacaaatcttgagcagaaagcagagctgaagtctgtatgtaaccaggaaaaatggggctagtctgagtgcagatgcaaatggcaactatgtgaggagctgaatcagatactcctgcctttagggggcaccagagaaagggttaaagtgcccccaggttgcttagcaccctggacatatagtagaagcagatacaaactgtttttgaagaaaagtctccacactttaggccattaaatttcctacatattaagatcaatgaaatatcattcacaatctttaagatcaccaagcatacaaggaggcaagccactatgggtgaggtagatgaaaaacaacatacaacttgtttatatattggaatggtttcattgggcaaaaacaaaagattttaaaagcctcgtttaatactgactactgagatacagatacagagtacaaaataagtaggtaagaaacatttaaagaaatgaagtatggaaccacaaagatcgggaaggaatacaagagtatcaggaataactgggaagatacgcataacaataaaatggaacttctaaaatgaaaaatagacttttagaaattaaaaaagtctcaatgtatgggtttatcaacagatgaaacatagttgaacagtgatatggaatacacatctgaggaaattacccagaatagagcacagagagtagtaagatgaaaaagatgaaagaagttaagagatacggagaacagaagaggaaacagaaacatatgtattctgaactctaagacagtaaagagaactgagaaaaaggaattaattgaagagatagtaattgagaattttacagaagtgatgataaatataaatctattttcctaagtagaataaaagaaacccaaatgtagacacatcatagtgaaactgtagaagagcaaacacaaaaaggttccaaagtagccagaggaaaagagacaaatcatccatatgatacaacagcagtgacaaaaaccaaaatgaaatggaataacatcttcaaagtgtccattttgcattgtagatccaacccattgtcagaggatgaaagtgatataaatacattttcagataaacatagtttctcaccaacagactgctattaaaggaacttctaaaagatgtactttagaaagaaaaatgatcatagaatgatctgagatatgaaaaggaatagtaagtaaataaaatacaaacatgtaagtacatatatatacacacatacataaacatctgtgtaagagtctggagagaggtgtccagacttaaaacattctaaggtttttggattgtctaggggtagtgtttaagatatttaacttaaaactttattgtattaaatatgcaaggcaaaaatttaagggtaacactaagaaaaattggtagcataaatttgaaaaaaaaaaaagaataaaacacacatgcccgacattttttttaaaggcaaggaagaaaaaagcatagaaaaaaaaagagactaataaaattagttcaaacaagtccaaatgtatgtcaataattacaatgaatgtaaatggaataaacttgccaattaaaggttatactgccatattggataaaaaaacaaaatccagctgcgtgaagtttatgagacacaaaataaaaaggacagagaaaggttgaaagagaggtggggagcgaaaagatatataaggtaaacaccaataaaaagagagctgggatgttaccttaatatttgacaaaaattttaagacaaaaagcagtattggtgatcaagagggcaactactaaataataaagaataaattcatcagaaaggaaaaatataacaatttaaatttccattttcctaatagcctcaaaatataaaaagcaaaaattcatagaatttcagggtaaaatggccaaatgcagaattataagttctccttgttctttactgtaaaaatcatacatagtgaatacattcaaaagatatttgtattagcttgtgggattaaggatttttctccattttctaaactttattgctgtgatattgattttataattcatatacttttttcagaaatgaactatgcggtgaaatttttaaataactgatggttaattatggttttactaaatttgggggtaattactgtgtatagttttagatcctgctcccaatgattatcaggttgtgtacattttaaagataatttcttgtttgtgttttgctaaaatttcaaatgatttttacatggactcaagtggttcagacaccacttgacttacacattaaagaacgtggcttactacacagtttctgctttactcaataagaataaaataattctggaaagaatgcataataatgcactccaaacttaaatatgctactgattgttaatggctacattattctggctatttgtatcaacaacacagccacaacttttctaaacttctgcccagatattacaattatcctagggattacttactctcagaaaagtagaggaagatacaaattggcaattctttttctcacactgatactcctttggacttaagtgaaccaatattgttattactaaagctcagtattccacctctatttatactttctgaaacgtataagcaacacttagatgaaataggaagggatcactgtacacaaatggaaaataaagcagcatgcaaggaagctggttctaaagaaaacaagcacaggtggccgggcatggtggctcatgcctgtaatcccagcactttgggaggccgaggcaggcgaataacgaggtcaggagtttgagaccagcctggccaacatggtgaaaccccgtctctacaaaaaatacaaaaaattagctgggcgtagtggcgggtgtctgtaatcccagctacttttgggaggctgaggcaggagaatcgcttgaacccaggaagcggaggttgcagtgagccgagatcatgccactgcactccagccctggtgacggagtctcatctcaataaacaaacaaacaaaaaagcacaggttactttattacagtactgaaaaccaagacagcacatggactctctttgaatatataacctaaaaattgaaactgtaaaatttaatctattatacagaatttttttcatagttgtttaaattttactgtttgcaattctagaaaaataacatcatgttggaaaagtaagcagtaatttaaaatgaattatattttgaaaaatatagaagaatgacaagaattctaaatttttgtgaatattttacccaagaaatgtgttttagaatcttttgagatttgaattagaaaatattgttggtcaaattctttcactgtttaaagccaacaataaaagaataggaaaagaatgtagttatttccaactctgtgctataacaataagatagtaacgtctagaaattatatcttaaaaccttcagagtaaattaataaaaattcaacatacttcaagttatcactgtattttttctataattaccttttcgtttactgtttcaatttattgaattatacatacaatgaagagcacaataaatgtacatacagcttgatgaattctcacatagtgagcctgtgttacaagtaatctattattaacttttaagatgatacagtgctatgatcgaaggactaaaatgatcaacatcaccataaaaggcagagtcataaacaagaacaattaagtgtaattaaatcaggtgggaggcacacttacaaaaatgaaacaatttttggttcacattttacaccacacaggtattctgtatctttagaacatgagaaaatacatattctcagtctgataggtctctgacttgggggtttcttttactgtactttttttctctctagtagctgaacattttaaagcaatcagcagaaaaaatataaaacttcagaaccaattagacttttaaaagcaacgttcttgccctttccagagatacattccttaatcctcctacaaatcatgacctcacacgataactttaagggtgaacatcaacttatctacattttggtgctttctttcccttaagtggcagatggtttctattaacctaaaattgaagtcattgttgggggacccctaattccatgtctagtcctagtgcccagaggctaccaaagacgatacgaatagcttctcaggcactctacccaccgtttaccttgttaatacaaatctttcccagacctgggtcccgaaattattttaccctgcagagcagaaatgttacggtgttcattcagtgaactcttccctagtttttaatctttgtattttctgcgtatacttcaagccaccagtaactttcccagttaccaagaaacagtgtaacacaggtcgctatttgttttgttcggaatttacgagcaatttaaccacacgtgattagcaacattaagggggctcctccaggcaaagaatccacagaatgagaggcccttggtacccaaatgaagcaacaatgaaagatcggcgaagctcagcaaggttcctgagcgccacggacgcctgctctgatttcaggttgccggcgcgcgcccgcgggtctgcctttatggacgaggcgcaagagggatccaggaaagacggtgcccttagagactcggagattagcgtgggcaaccctgccaccagctgcccctgccaccagccgcccccacaacaaaaaggaggaaacgctccgcatcccgtcaccaggacaactctgtaacccgacaccgaggctcaagattccgcatcccgggcagcgaacacaggagaaaagcacatcgcggcccggccgcggggctccaaggcgtccgtgccgccgctgttcctggggtgccgagagcgacgcggggtccaccctctccgccggcccgaggtccgaagctcggcccgccaccgctcccggccggcgcctcccgcacgtggcggccgtgattgtcccggggcggtatccctccgcgcccccgcctcagtctccccccgcccttcccgggaccctccgtgcccgggcgccgcggaaggatcgcacgcacgcgcgcgcgcacgcccagccgtgtccgcggaaaacggagggcgctgcggtaaggagcagccgccacaggcacagccgcttcgcagcctcccgccgctggtttgtcagccccgcggctgcgggcggccgggcggccgagcgcgctctgaggttcgtccctcatcgctgaacccgcgtcctcccgccgcagctcctcggggaggggggcggtcggtgcctgcgcagagccgcctcctccccgcccccgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacggtgaggaccagtggcggccggtaccctggtccctgcaccggagcggggtggccggccgcgggggcaccgcagcgcggggctggaacactgagggccgagcccgcaggtgtgctaggcagcgggcgccgaggatgcggctgccgggcgggcggggaggccgaggcccggggacgccccctcacccggggctgcgctgacaggctgggggcggcggccggactccttgctggccctggccgggcgcccccggcgttcccagcgtcggtccaggtgcccgggttgggggagggggcacgcaccggccagggcaaggggaggggttccttttttcctcctagtgcggttcccctaggttctcttgaagccctgaggtttgctatgcacgttctggggtggaagcgggggtcggggatccgggctggggcgcgcgggccccgggtggaggtccctaggctctctggccggctcttgctccgcggacagcgcgcctcccgcgcctccggctgtgggaggcggcggccccggcccggcccccgggattctcgaagcgactttgcgtaggtttaccgatgtccaggcctctggggcttgcgagagatgtacgccgaccgcgtaggtggattcgtgaatctcgacttcagctctagctctataggttgttttttttttttttttaaattctccaagatggcgaactgccattgatttctcttctcatatggagattcatcgatatacggttatccccagttatgcaacatagctcaaaaaaggggtgcttttcgggggctttcaattatctgcgaagaccaggagcacacttcacttctctaagtccctccctctttagtggtggcagtaaaggaactaatgcagttttatgcttcacattgcctgattttcttgagacttgatggttttgagttggttgcaatatgtttggagaatatttgccacaaaacctccagcttattgttttgcctgtttctgcccaaggctgtttctaaaattatgataattgtactaaatacgagaccattctctttatttcttagcaccacgctccctttccattaagcaccaaaattcaggtcccctattaagggtgctaattattcttttaccacttaacatggtttaaagtctaactttagaactcagtccttgatagtagtactttaaggtctcgtatacccgcagtggactacaattcttgtagggaattggcatctggtcatcaacttttttcctgcagtcctcttgtctttgtgtgtgagttcccgctgtctgactaggaagattgcgggagtgtgcttggaaatggctggggcctgctatgactctgcagttctgatgggggcgacgccttccttcttattcatggaatgttagaatgcacgttttctcctttccggttctggtggctacctcagtttctttcccaatctccctccattttttctgttttactattgcctaccgcagtgctgtagacagaatccactttgcgtttgcccagaaagaaaactgattactgagatgggaggggaagggaagttggaaagaaacgggagtcgtggctagaaaaataggagggaaatatgaatttggaaaagcactgatgtccaggggttgaagtccatctcatcacgtatatttctagttactctaagcagagaagtgaacacatcaaagaacaggctttattttgggagactttgaagcaactttaaatttgatgaaacatgatttactgtaatgggactgaatatgatagaccagctttgttcagagttgatagctgaatttttaccattacgtgaacactttcaggcaccagctgacttaatacagtttataaataactctttaagtttgcactttgtctagtgtcaactgtcaactctttacagtttctttgtatagactggtcttggttaagagacgacatcattaactgaagtcaaatcaactcatgtaaaatatgtgattatataggattaaataattatttagaaaagactgaatcttggttttacattagtgaaatgtggctatctggcagtggtagcataagcctagctacagcccttcctgttacatcaagccctaaaaggagttaactacaacttaatgtgtgtgtgttttttttttttctttttggtggggggcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagaggtgagtaaggcattcttttggttaaagttgcatgccacattacaacttattaagcagtttcttttaacattttgaataaaagttagtccataatggctattaaggtggtttttgtgaactgcccagcactatggagaagcactgctttagttttacctactctacagcatctatgacctggcctcttagatcctgattttgtttctacgatagaatattcgtatgaactcactttcagctttattaaacttaaaagtctcttaaactgcttgacatgtcaaatcataatcctgtggtgtttcagattgttaaattgttcgaatcacttggttattttagtcccttttggtgtgtgtttgacctttggatctcttttcttttttttcttgcttgtattctaaccatttcactactcagcataaagaaggaaaaattaacatccgttcatttttcagttaggaactttgctggggaaaagataattagatgaggattttggagtaagttgtccattcactgaaatattttcaaagattgtgtctgagacttagatttgaaaagtaggaaattacatttagtttgtatacttggtccagaaattcaggtgtctccagactgttgtcagcattatagaaactcttaattgcactaaagaagtctccctactttttcaaaataaacttttgaaattgagttttattatgacatctaattgatttacaaatacattttaatgtgttaacgcatacgaatattttgtaaatagagagtgcttctgtagcctcacatagctgacttggcacatctaattttaataacagctctaccatgtgaggggagttgaagctgctgtgagttataattaatgctatggctctaccagctccctgtgattatcctaaaagttactcgtattctggtgtgagttgatgtttataaggatttataagaaaattagatgactttgaaatagtgacaaatctctttaaaccttagctgcactatacgctgaaaagaagcgtcaaacacaagacaaaaaaccagaatattttatacgatacagcactactgacatctagtggtagtgaatataaaatttgacatatacatatattttgggttatacacctttgaattgcatcatagaagagcaattagaaatcgtaaacctatttttttagacgcaattaaaaacaaggctactacggtgaagttatcagtaagcaaacaccttaaataatttaatttggccttttctgaatgatactgagtatgctacttaaaatttgatcttcattttcctctggaaataatagatacatttagcctcactggtaaaacttaatagtttaaacttatcaagcatgttaaaatttggggagagtttgtaagtaagtaactccccaggtttattaagtttatattttgggggcaagtaataacatgtacttgacatcagccagaatttttttgccctaaaatagaagacaaatggtcacttttttttttttctgtagctagtgtaaagatagttgtatagaacttttgcttgcattgattggcttccaagatgcagtcaagtttactattttctgtttagtatattactagtttgaaagttctttttggaaacctacttgacttcagtgcttggcagttcatggaaaactaacttaatgttaacttattaatccgggttctgtctgctaaaacttatgtgactttcttgattaacacttcttttgaaacacttttcttctttctctttcagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaa

SEQ ID NO: 383 - DNA, 188370 bp, Homo sapiens
taaaaacttctgttcagagcaaggacggatagtcactgcgattagggtgggcgacccggaggggggtcatgagcctggaccttgacagatctggtgaggtctggatttggtttgattcctggctatcttttcttaatattcaactggctctacgctttttaaccattcactttcttcaaggtaagtgcggcagaagcctggcgcatgcgcagtacaagcccttaagcggcgccccgcccacatactactacaacttccggcaggctccgcgcccgcctctggcgcgtcgcgggctgctgacgtaatgcggtagcgcggggaatttcgagtggtgttggagcgccggaggctagtgggtggctgacccccagcatcctcgggagcgaccatggactccctggccgagtctcggtggcctccgggcctggcagtcatgaaggtgagtgcttcggggagtttgggagctcccgggtgtctgcggggggaggtccctccctttgaggaggatgtcctcgccttaaggagaaaggatgaggcgcgagcgtcgcactgggcccgggtatccggctctgccctgccactagccgaccgcgtggctctgggtctcagtttactcctctgataagtgacaaggacaagcctggtgagctgaggttggcagtcttatggcaccagctattctgcgatccaatcccaacaataacatggagaaaaacagttattccaaacaatgacatcgacagctgttctttactgaaagcttactttgtgtcaagcactaaacagtgacaccggacatgattttgggtggacactttatcagataacatgtatgtaatcacgtagccaagcaggtagtctcctttacaggctctttcatttcttctgattattctcaataaacgtagtgctcgtttgttctgacatactgccccaactcctctctaacacaccttcactcttctctaacaattgctcatgtctcttaaacagagatcaggactcaggctcagcgctgatcttgcattgcgtctgattatttcacttaaataacatttatttttgtggccactttctgttttggcaaggcataccagtttccatttacagtagtggtgggccctggatttgctcaagagcagatgcactttgctgtgctggataaagatcagttgcttggtgtttcttcttgctctgtgattatttccgtttctcacagtggctaagatagccttcttctccctcagttttgtagacttggggattataatacctgtcccactgactcataaatttgactttagaattaagtgaaggctaaagtaagtagaaggccttgttcttcctgctgtcatcagtgacgtctagagtgcttggggacttgagatatctgcatgatgagaagctgacattgtgaaatgatccaggaaagctgtagttttggagttgtgggcttggcaccaggatgcagtggagaagagcacagatttgagttccagtggtcctgggtgaaatctcctgtctgcctcttgactgtatgaccttcggttagtaacttaacctctctgagcctgaatttcttcaactataaattagagacaaaaataacagttcataggattgattaaataaattagttgatgtatgtgggcacagattctgctgtgtattcactgtgcttactgcagtgcctgacaccaagtgggtgctcaaatattatttgctgcttgattgaaagtatctggaatgtagtaagcattcaatgaatatattttattattattagcactgtgttaagtgcttctttccccttttaatttgttgtcatgaagcttgacttggataaggaaagtaaaagagctctgtaacctgtaaagctcctgctttgtagatttaagcacactttacatattcccacaatttcagtgttctttagaggcgggttccatgtcttctctgactttggtatctcaccacagcactgaatgtagagtttggcaccacagagcgttcagtgagtgttcaaccagagagttgattgagcccgtatttttttgctcacattggaatcatggaatcttaaggttagaaaaccagcccctttcagtattttaatctcctttataacacatctgccaatttctcacctaatttttgcttgaactcttccaggcacaaagaactatcagatcccagaagcagatctgactgaagttacttcttttattgaatagaagtctgactcagaatccatggttgctaacttaggattcacagaaagactttggagtctcaagttatttgtaaaatttttgcatgtatgtttttctgagcagagagtccatagttgtcatccatttttcaaagggatctgtaaccccaaaaacttaagagtatttttgtaattattacgtttttccacccattttctacttctccctttcactttctctctctctaaactaaagaaattttggggagtctgctgaccactctctattcaggcatcattttttgtttagttggttgaggcgcatgtgatatgcatgttactgtcttggagtgacatgacaagaaatttgaaccagaaatggctcatctgatgtagtgtcaacttccacaattgtgctctgcagatctttcagaatcattcctccaccagaagaggatggcatagataagaaagtgtgatataatagactggttctggcttctgggcctgcctctgctcttaattgatcttgaacataaccctttagatttttgtgtctgtgacagcttaccatccacaataatggaagattttggcattttattatttccctggttttactttaacaaaaatttactgtttttggcatattgtaaatgtaatatgtgtacacggtagaaaaaaattaaaattcagaataagataaaggagaaaaataaaaccatccataattctaccacccagagaaccagtgtttaacattttaccttattttcctttggtttttgtgcatttaaaatttgggatcactgtggagtcaacttcttgggtttgatccagccaacttaggaactctgtagactttatttttaaaattgggatactgatgctgtggacttcataagattgctatgaagattaaactacagagttgttattattatgtattattggcataggtttgttttctgatttttattttcctagggcattaattattctttgaaagcatgttttttaatggctgcataatatttcatcatatggaccattagcgacattagtccttttttgtttacatttttaaaattcaggtaataggttcacatggttcaaaatacacataaaataaaaagtaaaagtctccttcttaccatgttcctggccctgatcattatttatgacttcttgtttatcttctcattatttacatttacaatgaaaatagaatgcattcttttttcctttttttcttttttgagatagggtctcactgtcgcccagactggaatgcagtggcaatcacggctcactgcagccttgaactcctgggctaaagcaatccttccgcctcagcctcctgagtagctgggactacaggcatgcgccactactcccaacgaatttttaaattttttatagacatggatttttgttattttgccaggctggtctcaaactcctggactcaagcagttctcctgccttggcctcccaaagtgctaggattacagagccaccatgctaggcctattagaatacattcttactcacctcttccttttaaacaaaccgtagcatagtatatgtactgtctataccttatttccttttttcacttatcttggcaatcttttcatatcagtatgatggagagcttcctcttttttttttttttttttgagacagtttcactcggtcatgcaggctggagtatagtggtgcgatgtgggctcactgcaacctacgcctcctggactcaagcgatcctcccgtcgagagcttcctccttttaaaaaatatttctgttgaatggaataatattttattttaaacaatttgaaagattttaggttgccagagtagttccgttcctgtttggattgcattccaggttggcacacatctctctttccaagttgtccactttcccttcctctgctttcactgccccagctctttccaggcttcctcatttggctgcatgtgtagtaccatgccgaaagcactggactgccagacgggagacaggaattttggtcttggcttgactgatgcctactattgtgtgcctgcttttgataccagtttcctcttttgactagacagtttctggagtttggctttaacattctttgatttgattcttaacttgtgtggtggcaatggccacctttcacccaatagtgactataggctaggtgttggagtctgaagaggaggaggcttggagtaagagctggaagcgcattagaagtggaacagaagtacagtagcccttatgtgaagggatgacaatatggcacaagaatcggtgtgccatcatctttagctgtctaaagcaatttgggcaacctgagactgaatgtataagagtcatatgagagaagtttttatttatttgtcaagatcccttgcagtttatctggagttagcttttgaatttgtgtatttgacaaagagtttgattttttttttaggggatagagaaaaagttttgtgacaggacttccaattttgatgtctttctgatatgtatatatgcatatttgcatttcagacaatagatgatttgctgcggtgtggaatttgcttcgagtatttcaacattgcaatgataatacctcagtgttcacataactgtaagtatgttttgttcctgtgagttagtaaattgcgatttttacatgaggtagtgttaatttaacaccaaagatatgtgcacatatttatgtttcacctttagctcttctatcttgtagtttttcagaaggtctttttcactgccttcctcttgaatattgaaggtttttacaaggcttctatattttctacctcgttcctctttgatatttttatgattcttatagcatttatggcagtaaaatttttggtcacaataagtggttctttatttgccaagtgttttttgacgttaagtttcagaatttttgtttttaacaggataacagataggtggttccaccaagtagtacttgatatagaatttcaaagtttaaaaatctgtaacaataagaatattgccccagtgggagaattctaccactgactttattacagacagttttataccttaactgctatgtgacgctggaaagactcatgttggaatttgtttgtacttctctttaagagtctagtatataagcatttaaaaatatcgtaccttaagatatttagtgcataggggttaccctatcattgttgaggagctagacatacagtttatgggttattcaggttcatgatctttcttgtcctctattttcaagttgatttatcttggaaagttaaaaacagtcaacttaggcctaagaaattggttttagttggtagtagctttggtggaaaagtttctgtggagaagacatagtaagagggtagcagtgacggcagcacgggcattgcagatgcccttgggcttgactcttgaaaatcgggtgagaatttactactttagaaaatgtttgtgagaattaaatgtgcagaactcactgtccggcacattatgagtccttaacaatgttagttttcttccagacaagattcacattaaaaaccaagataagttttggagattgttttaaaatatattttaacatcatctttatttgggtgtaatttacatacaataaaatacatccattttaagtgcacattaaggtataaaagtgttcatgaattttgacaaatgtgtatgctgtgttactactgcaattaagatactgaacattttcattatctgataaatttctccccatctcagtcagtatgacctcagctagccatctgtagtctatttctggactcttctattccattgatcttagaaacttagtagtttttcaccaaaactactgcccactaaaaccaattgtttaggcctaagtttactgttgctttagctttccaagataaatcaacttgaaaatagagaacaggaaagagcatgaacctaaataatctgtaaactgtttgtctaactcctgaacaatgataggataacccctattgcagtaaatacctcaaggtacaatattttaaaatgcttatatgctagactcatatatgtctatccttgtgccagtaccacactatcttgattactgtggctttgtagtaagtcttgaagtcaggcattgtaagtcctccaacttttttttcttcgttttttttaggatcgttgcattttaaatgcatttccatgtataacttaaaatcaggttgtcaatttctaccaaaagcctgctgggatgttcactggaattgtattgaatctagagatcaatttgggagaattgacatcttaacaatgccgagtcttcagtgtatgaatatgatacacttctctatctttatttctctcaacagtgttgtttgattttcattgcacagaccttgcacaaagaaatataacttatattgacctttcgtcttctgactgcagtaaattcactttaattccagcatcttttttgttgattccttagaaatttttgcatacacaatcatgtcatttgtggataaagacagttttactcattcctttctgatctatatgcctttatgtttctttttgttacacaggctggtacctcaactacagtgttgaaagtggtgtggagggacatcctgtccttactcttaattttttggggaaagcattcagtcttttaccattaagtatgatgttagctgtaagttttttttatattcttaatatgttttcataaacctaccaagttgaggcacttctctacccctggttaggcgagaggatttttttttttaaatcatgaatgggtgttgaattttgtcaagtattttctgcagttatggagatgctcatatgattttcttcctttattttgtgacatagctaataacgttgtttttgttttgttttgtttgggagacagggcctcactccctcacagtggctttgttacagactggctttgtactgtagtccccccttatctgtgatttcagttacctgtggtcaactgcattctgaaaatactaaatgggaaattctggaaataaataattcataagttttaaattgcactctgttctaagtaaagcactgatgaaatcttgtgccgtcctgcccaggatgggaatcatccctttgtcaagtgtgttgatgttacatatgctatctaccgttaatcgtttagtgaccatcctggttaccagattgactgttgcagcatggcagtaattgtcactgtgttgcagaacacagtaattgtgtcaagtagcgcttattttacttaatagtagccccaaagcacaagagtaatgatgctggcaattcggatatgacaaagagaaaccataaaatgcttcctttaagtgaaaaggtgaaagttcttaacaaggaaaggaaagaaaattgtatgctgaggttgctaagatctacagtaccatctacagtacagcacaagatattttgagagaaagaccacatttacataacttttgttatagtatattgttttaattctatgttattgttattgttcctaatctcttactgtgtcttattaataaattaaactttatcataggtaagtatgtataggaaaaaacatagtataaataggattcagtactacctgtggttttaggcatccactgcgctttatggaatgtctcgcctgtgtataagggggcactaccatatagagaaagatctttactagtcagcttgactgcagattctaggggcttcgtaagccttttctgtggatgtgtcttccctggacttgtgattataaatttccaagccgagagatttggtcagttttttcattagctgctgtttttctctctcatgtgtctgtccatggtattgcaggttctccagagttgctgtaagccatcagcctctttttttgttttcagctgccctcaagcatctaaagtatgctgatccaaagcaccccaagttgagtgagacagaaaccattcccttaggcagtcctttgaaaagttcaaatgttggtcacacactccactattctctcccagcctcccctcccaagataagccgcagagctatatcagcctctgtctgctctatgggtcctgtggatcagtagcaagcaacccagcttttttttattcttagcagtccccagtcacctagaacatgcagggttcatgcttagtggggtgagacagaagccagtcctctggccagctcttggaaaagctagaacattggaccgtgtttcccttctttctctccccaggcagaaagttgggggtttctcttccttgctgagcctgggggaggcacactggccagtgagtgtggtactagtccagacctttgcttttgttctcagtggccctcaacctggttcccttttctgtcagtgtatagattcaggcagctcagaaaccagtttctcaagtagcccccgcaatgtaagtgctagtcttctgtttctctccctagggatacatgttgtttgctcacttcttcatgacttatagctgtcacttatgccattctttaagaggaagtcagtggagggaagtttcagtaatgatgattttttattttatgagcacttttttttcacttgtgaagtctcagtattcagtaggcctcttctactaaacaccagttgtcacaagtcccgtcatgtctaaaatttgctctgggtctttagtgttttaatgacacaaaacccccagggctgtagtggaagccaggtctgtcatgttctggtatcatcttggattgactagaattggtgatccagaatcctaggtatttattgttgcttcttagatttttcatgatttatcatttttaaatcactttattttgttttgttctgtttaggtttttggatatgagtaataaacactacatttgtagttctgcaggtacaaaggtgtgagtggggtgccttggcagaatgcaggtcaattaaattgatccaaatttgtgctattaaagagtattttgggggcgagagggagcagacttactccaacccataaaacaccattaagtgagaaatggtcttgctaatagactaatatgcccaagtgccaattttctttgcacttgctataatttttctcacttcataatggaagatgatcaaaatatttagcaattggctggctttcaaacatcaaaagagtctagcatcttaatagtaaaaaggaaatttctaaaacttaaatgaatccttgtcatgtgaaatcttaaggactttatgaaagaaggaactttttagaaagaaacatctaaagtgtccagttaaaagcaaaaaccagtgtgaaaagaacaggaggtccaagaaagctgaaaaggttggcatctgcctccagttctaatgttaagggacagttagttggtaagagaataacatccctccaactaaagactagcatttcagaatttccagaagtgcagctctgcataattatatctcccttttgtgtgtgtagctatttctcttctcctctgccttgtttcacagtgctacttcatgagaatataaaagaagataaacacgtttattatttgcctaatagaatcttatgttgtctcttgaattagcaaaggtttcgtaaggggaacatttcatatttcagtttgttttaaaaaatgaaataaaattgctttttacttctacacaagctttgattaattttttttgagtcaaaatccacaaaaggaaaaaaaaaaaagattgctggccaagctttaaaatagtggtaatttatcagtgtccacaagccaattattttatctaggatcttgcttgggattagagatgccccctctcccaaggcttggatatttctgtgaaactactctttaattcattgttgttattgtaccttcctccactctgcccacacatcttttttgggctctcttggatggaaagacaaatttcataggtgatttaaatgaagccctctgggaatacatgaattcaaaactcttcagctgttcttctttgaatggaagggttgtcatagttgcccactagagaataaattatgctggtctgcagcttaccagtacatatttggtagtagtctagtagagtgaaattaagcctagggcttgatctacttaggactccatatctggttctcctcatttcaaaagaaaagaagaggaaagatatacaagattatgcagaagagaaagcagtagccttattataaatactaatttaaaaggtacatgtgaccttattaattaaatgttatttattgatgtatacataatatatataatgtatacttatataggtacaattacatatataataatgtatacactatattgtataagtatacattatataactatacatagtacatatttatataagtatacattatagtataaatgtacagtatatatttattataaacaaatgtttatagatatagtcagtccctgacttaccatgatttgacttaggatttttcaactttacgatggtgtgaaagcgatacacattcagtagaaaccatactttgaattttgaattttgatcttttcccaggctagagataggtatattaaatacattttggcttatgatattttcaatttatgatgggtttatcgggatgtaatcccatgttaagtcaaggagcatctgtaatttttaataattaatatattaagagtctggactctggtgctttcctttgccacatattagttccattatctttggcaagttggctgagccctgtgcttcatttttcttcttgtcaaatgtgactaacattggtaccaacctcagggttgctgtgaggatcgaaagagttaatacatgtaaagtgcttagaacagagcacatactaagtgcagtgtttatttgaaccacatgaaattgccaatatttgtccatttttgacttaaccaaaaatgtcagtttcatataattcaacttaatagtgacaacttattaattttttaaaaattgttgccattgttgaatcaatattacatattaagaatgtgatttactgaccaaaatccattgaatcactatgactggggatacagcctgggaaactaagttaaaaccagcataaatctccctaggtgactgagctgagcagctaggttttaggatttcttgacttacagtattgctcaggagacttcttatagtataaagagaacagcattgataattaagagaatgagtctggacaggaatttttgcctcaggatgattcataccttgagtctcatccatatctgatttaggtgatatttagatgagactttagattttagactttagagttggtactggaataagttaagacttttggggctgttgagatgggatggatgtattttgcatttgagaagaacatgaatttgggaggttaaaggtggaatgcctggagtgaattttatcccccctaaagtcctatgtcgaagccccaaccccaatgtgttggtgtttgaagatgaggcctttgggagataattaggtttaaattaggtcctgacagtggagccctagtgatgggattagtgtccgtatgagaagagataccggagcttatggtcactcctcaccccctcatgggaggacgcagtgagcaggtggttgtctataggccagaaagagagctttcagcataaacttaccatattggcaccttgatcttggacttttagcctccagaaccatgagaaaacaatttctgttgtttaacctgcccagtctgtggtattttgttatggcagctcaagctaagaaatgctttcctgtagtcttttgtaccattgctgtcattcatttcacttatgcataagcattcataagcgtgcatttttatacgcatatacataataagcatctataattgaatacttcgttattatttttgtacaaagtgttatctgttaaattaacaagaaaaagtttttattacagtttcacatattccttctccagtactcttcctttctttacgtagattggagtttctgacctaaattattttcctcctctctgaagaatttcttttagcatttcttgcaagggaagtctactgaaaacagattccttcaatttgtgtttgtctgagaaagtccttatttctctttcacttttgagggataatttctcaggatatagttttaggttggtgatgattttctctcaacactaaatatttcggtgcactctctgtggtttgtgagaagtcaggtgtcattctttgcttctctgtaggtaaggcccccactacagcttctttcaatattttttcgttatctttgattttatgtagtttcaatatgattggctgaggtgtctatttgttttgtttttgcatttatcctggttagtgttctccgatcttccaggataagtagtttagtgtttaacattaatttggagaaattcttagccattattatttcttctgctcctttcattcttccctttctggtattcccattatgtgtatgttacatcttttgtagtcatcctgcagttcttggttattctattccatttttcctgtctttttttctctttgcttttcagttttggaggtttccattgacatgtcctaaagctcagagattcctcagccgtgttcaatctattaatgaacctatcaaaggcattctgttatagcggttctttttatcgctagcattcctttttgattcttccttagaatttccacctctctgcttatgttcccatctgttcttgcatgttgtctactttttccattagagcccttagcatataatttttaaaaattgctggtccgataatttcaacatttctggtatatctgactttggttctgatgcttgctcagtttcttcaaactgtgtgtttttccttgtggtttttttgttaataactggaaatgatgtcctgggtaaaaggaactgcagtaaataggcctttaggtatgggcagaggggacacattctatagtcctatgattaggtcttttagcgaactttgcccctggactgtgaatgttactaacgctcctcagttttcccctccttagatgggacaggatggctagagggctagagttgtgtatttcctttttccagagtcagctgggctctgataaaactccagtagattaggctctgtaaaatagtttcttctgagggagggctttgttgagaacagactactctgggccagtgcagtggctcagacctgtaatcccagccctctgggaggccgaggtgggcggtcacctatggtcaggagtttgagaccagcctggccaatatggcgaaaccccatctctactaaaaatacaaaaattagctgggtgtggtgtggtggcgcacacctgtaatcccagctactcgggaggctgaggcgggagaatcacttgaacccaggaggcggaggttgcattgagccgagattgcgccactgtactccagcctgggtgacagaattagactccatcttgaaggggaaaaaacaaaacaaaacaaaaaaaacagactactctggcttatttagaaatggttacttttaccctcctactcctggaaggactggggggtttttctccaatattcactgtgagaactttgaagaactcctggaactaaaactcacagaagtgtgaggacatcctctccatgcctgcaatgacagggttccctggagtttttgactctcagacttgcccacactgagccgccagcaattcgtcaattacagctcaggttctcccaccccagcactggttccagcacaggtttctcctctggttcccatggaggtttctgtttgtgggtttctgttccagtaagttgtgattgtctgtattacccccctctctctctccagttcggggagagcagtttgccctgtgaccctgcttttctgctggatctacgaaaagttgttggtttttcagtttgttcagctttttacttgttaggacagagtggtgacttccaagccccttacatgctgaatcggtcccctgtattcatctttgcttcctaaaagaactcaacctgttgtctgttttatccttttcataatatgtttctttgtttttcctcctggggtgctcttacttaggctggcaagacttgcttatttcctggatatccataccattgaaattatgctgtctcctcctcaactaaacgaatcctgaatttatacagtgtactgaaattgtactgtctcctcctcaactaaacagaatccagctgaatttgggctactagtaaattagcttaggtaattagtaaggtaccattctgttagtcacatctgctttgtctttgactgggagaacatttacactgccttgagtgtggtgaatttagtttgtgcccatttcctgcttaaattgttaggatatattatgcggaattatgctgtaattgcttcactattttattagctccttgaggtcaagaaccttcctttatatatattgttcttagtgcctgccacaaaagtgcttgttaaatgtgggacagaggacattatttacagaattaagatatagaagtccctaatgtgataacctggatatatattttttcttaatatgtgtatatatattatttcaaaatttatattttcaaatgataagcagtagagatatctggcaggtttatacagtacccagcccaagtgtatgtttcctgtgttttgcagatggaggacacagagtgatgtatgttgcttgtgtagttgtggtatcctaaagacttacaatatttatgttttcctttccttaaaatgctgtttaatcacatgtgtaagtgtgcatagagtagaggtactagaaatttaagcttatgatgatataccttagatgacggaaatagtctagggcttaagattttgttagaagtcatattcctgtattattaatatagcttaattaacattatgttgcactttgtgttttgcagactgctctctctgtataagaaaatttctgtcctataaaactcagtgtccaacttgctgtgtggtgagtttttgtttcctttttttaaaacttactgactgctgcaaatatttctgctttgtgtatacgtaaaagcctgtgtatatatagggtgatgtgtagttactgaattaagctatatgaaagacattttcagaaaggacctctaaagtacatgtaagaagagctgggctttgttcagtttttttgttaagatttctgaaaacctaaatgtattttaggaagtagcactctttaattcttatgacccatgtttttatggcttctcatttttaataatttctcactttggtagaaactctggtggtatgattattcatttgcaaagaactgtctaagtatttgtgcagaaggtaaatatgcatggctgttgggcttaatccggcctatctgttcccttacatctttcccctaccagagcttcagggaaaaccctagaaagtttgttgttattgtttctgaaacttttcaagtagtgggaacaggtggaaaagtagactaaaagggtaattaaacataagtgggaataaagaaagaagagacaagtgaggtctgacagagccgacactaggactaggtaaggagtttggttagttttgcctctctggtaggtatgtggtgtcagggtgtcactgaacatttcgaactatttctctatgtaagaaattttgtgatttggctcttaagtctaagatctttacgatatgttacactgcttttgacaagatggtctcatcgctgagataaactgtgtaccattcatgccaaataagtactgggtttgtcacttttctcttgcattcctgaaaaccaatcttactttaaaattctccttgaacacttagtgcctctcccagtgttagaacttaaaagaacatttctcttctgtttttccggagaaatttctgagaaagctgagtgctggcattttgaagaaagattcttgcttatattaggtttgattgtagtcagtacagagtatatatgattataagagaagctctggagagcttttatcagacttccagtcagcagatactgattcactgttttaaaatttcatattagcatgagataaatgaactttattttgaggctgccttagaagacttagtgggatggagaacctcaggaggatgggtcagacattttcaaaaacaagattatgacaagttgattattgtttttgacctttttccatctgttgtttgttttttctagactgtcacagagccggatctgaaaaataaccgcatattagatgaactggtaaaaagcttgaattttgcacggtatgatttaattttgtgactaacctctaactacttttgccttttatatgtgttctctctttactttgtgcacctttggattagggaatgcagggttgcatattttatagtcaaagaagggaagtaacagtcattattcacacatggaaaatttactagagtaagattttcttcctttacttaacagaaattctcctgtagtatagaataattaagagttaaaacgcagatttgaggacttccttacttttgggtgctctgaagatactccttttcctgcccaagccctagaatcagccatttctccaaggagctcctcttcttggagaatagtatttagagaccaggatctggtgctgggtatgcttgttgctactggggtgtcattgcttctaggccctctcaatggacagagctaagtaatatatgtatgttatatatatgtatgtactaactcatgtatatacacatatctataattgattctgtctgctatatattaatctgttaattcttaatcggatttattcagcatgtattaaatggtatggcatttgaaatatgtaattgcttgtactttataaagctcagatatgcaactttacttcctgtcaaatgcatgaatgtgtgaaagtgagtttggtcacccaaagggatatgaaaaggcatgtttcaatatcttggattacttttagttttaatcatgcaagtcaaacaagaatttttatgaaggacgtactggtttagatagtggtcaggtgcccctgtagttaagtgtaatcatgtgttgcttaacagggatgtgttctgagaaatgtgtcattaggcaatttggttgctgtgtgaacatcatacggtgtacttacacaaaccaacatggtatagcctactacactcctattctatatggcagggcctattgctccttggtaacaaaacctgtacagcatgttactatagctaatacggtaggcagttgcaacacaatggtacctattagtgtatctaaacatagaaaaagtacagggaaaatatggtataaaagataaaaaatggtacatctttatagggcatttactatgaatggagctttcaggactgaaagttactcttgatgagtcaatgagtgagtgataagtgaatgtgaaggcctaaggcccttaccatacactactgtagactttataaacactgtacacttagactacacactaaatttataaaaaagtttcttcaataattaaccttactgtaacttttacactttgtaaacttttatatttttttaactttttgactcttttgtaataacacttagcttaaaacacaaacacatcgtatagctgtataagcatctttctttatatccttattctgtgaggttttttctgtttttaaaaattgttattattttttcctttttaaactttttcttaaaaatgaagatggaggccgggcttggtggctgacgcctgtaatcccagcactttcggaggccgaggtgggtggatcacgaggtcaggagatcgagaccatcctggccaacatggtgaaaccctgtctctactaaaaatacaaaaattagctgggcatggtggcacacacctgtaatcccagctacttgggaggctgaggcaggagaatcgcttgaaccagggagttggaggttgcagtgagccgagatcacgccactgcactccagcctggcgacagagtaagactccgtctcaaaaaaaaaaaaaaaaaaaaaagaagatggaaacacacacattagcctaggcccacacagggttaggattatcaagatgtcacttagcaatgggaatttttcagctccattatcgtctaatgaaaccaccactgtgtatttggtctcttgttgaacaaagcatgttggaacattctatgaggtaccttatgttgcttttaaaaatataaacagatttctttcaatagaattacacatttctttattggtttgcattctaaaaacgatcaaatttagtacagttgtctctcagtaaaggggattggtcccaggacccctgagaataccaaaatctgtggatgctgaagtccctgacataaaatggcatagtatttgcatatgcacatcctcccttatactttaaatcacctctaggttacttatagtcctaatacaatgctatataaatcgttgtcatactgtgtttttaaaatttatattatttttcattgttgtattgttacttttattattttttgaacatttttgctctgtgattagttgaatccacagatgcagagctggtggatgggaagggccgactacagtttattgtttagccaaatggttctagactgctgtttacatgtttctgatcagaacaagcattgcaggactttagttacagaagtccatggaattgattgcatagatttaatggctgcccatgtctacccaaaggcctattttgactcttgattcttagccccattctgaagaggtaaggttattgtatagttaacagatggacaagacttttccttccttccttccttcctccctccctccctccctctctgctttcctttcttcctccctcctttcctttctccctccctcctcctttctccttcccctctctattcctccctcccccgtctattcctccctccctttccttcccttcctccctttcctctcttcttcttgctctgttgcccagactgcagtgcagtggcatgatcatggttcactgtaacctcgaactcttgggctcaagggatcctcctgcctctgcctcccaattagctaggactatgggtatgtgccaccatgtccacactgaagaaataaacaaagcttccttaaatatgtggtagaatttaccagtgaagccatctgggcttggagttttctttgtggaaaagttttaaattatagcttctgtttctttaacagataataagggctcttcaggttttctgtttctttgtcagttttgatgaatagtgcttttcaaagaatttgtccattttatctaaaatttaaaatttgttgttttaaagtgttcataatatcctctaattatcttctttataggatttgtaacgaggtcttcttttaattctttgttttggtaatttgtattttctctcatttatttcttgttcagtcttagtagggattaacagttttgttaattttttcaaagaaccaatgtttggctttgcttgttttctcttgttatctcttctatttcactagtatctgttattagtttctctcttctttgggtttagtttgctgttcatttcctaaccttttaagttggaagcttagagtggtggtttttactttttctattttcaataattttccctccagggacagttttggcaacccttcatgctatcgttcagtttagaatatttttctagttttcattgtgatttgacatgcggggttatttagaagtgtggtgctttatttcttaacatttggagattttctagttatttttctgttgttgcgtttcatgtaaattcggtagtggtggaatctatgggttgattttttttttctatcagatttgaaaattctcagccattggtttttctagtattgctgatttcccattctttctttctgttccttctgggcttttaattatgcccaatatctcatacttttttgtgtttgtctttttcattcatttttctctctgtgcttggtttggatattttctattgacctgccttcaagtttgtattgtgtgttgttatactcatccaatttagatatggtattttgcagttgtagaatgttcattttattcttttttatggattttatttctcataatacactatctttttatcccttttctttttttttctttaacatgtttatcatagtttgaagtccttacctagagatgctattctttggattacctctgggtctgcttctattgaatattttatctcttgattagtggctactttttcttgcttctttgcatgttcaataattttaaaatatgtgctgaacattgtggttgaaacgttgtagaagctgtgaattgtcttcttttgaaagatgtcacattttgttctaagaggcagttaaattatcagctcttcatctttgttctgtcaaggcctggtataatgttttcttaggttaggtctgtttgagctttgtttatatttcttcagtgtggtccatttttctaaggtgtggtctttgtggggtgtcacttgaatgtccatgatcttaccaagatttctcagctttggctgggctccaatgcgaacaactaactttccagcactgacgtttgggattttaatttaccagtatcagcttcctagtgggtctcctgtgtttttgtctaatcatgtgcagccctggaaatgagcaggaatggatgtgaatttctaagcagactggtggggttccctttcagtagctaccacgtgtcaaagcactctgacccctcaatcctggccagttttgttcagaactctgatctcttattttctctaacaagtaagatcaatgtttcctgtttagacttcactttagtacccattcctagaaaatgctcccagggtaaagtaagtcttgggggaaatgttggactacttcatgttttcttctttttcagggattgcagccttgtgttgatttcagtccagtgcctacaaagagttgttttttatgcaagttaggccattcttacattgctataaagtaaacttgaggctgggtaatttacaaagaaaagaggtttaattggctcatggttctgcagctgtacaagccatctgctcggcttctagtgaggtcttgggctgcttacagtcacagtggaaaacaaaagacgggcagcatgtcatgtggtgagagtgggagcaagagagacagagtgggaggtgccacacccttttaaaacagatctcatgagaactcactcactgttacaaggacagcactaagggaatggtgctaaaccattcatgagaaattcgccctcatgatccagtcaccttccaccaggtcccacctccaacactgggaatcacatttcagtgtgagatttggtggagacgacatccagactatatcagtatattttgttcggattttaaagttacttatggttggagattaggtctcatataagctgttctctgtggcctaaagctgatttcctttcattttgttttattgacacattaactgccttttacgttagatttattgctttgagttatactagaagaaactttggtttggttgtcattatagtataggtcctgtatttcagaaaacaaggttaattgggaaaacagcttatgtcagttaatttatgatgtaaaattggatctcttaattgtctgttgtgttctttgtgcttcaaggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaaggtaggaagttattttcatatgtggaaatatggacatcttttcatccacatgacataagaataaataggcagcatctttgagggggaaggaatggtaaaggacaaaccagattttaccatatcacaaacctcagacattgttgtagatatgtttgttctctttctctctcagaaacaggaattcaggctgactgctacaaaaaggaaacaattttaattagttcagccttcaagtatggcagtagctttctgttttcagcttttaatctttcttcccctcattcaacatatcagttcccatttaatcttgaaaagctctttttatcttattttaccaccacttgaatgcctcctcactgttctgcctgccatataaagcctgtgacaatttgaggcctaacctagtcatcccgccttattgctcacctctctgtctcagaagtcctgctctagcctccccactgttcctccagtacactgaggaattggcaaactacaactggcagatctaatctggcttgccacctgtttttgtaaataaaagttcacatacccaccctattctctgtgactgctttcattctacagtggcagagttgcatggttgtgacagaggccataggatccgtaaagtctaaattctacctggcccttcactaagaatgtttgccggcccctgttctatacctttccagactctatccagatcctcactattcatttgttatgttagaaaacactgtctcacatcacaaaagtgctatagcacttgttttctggactgttttgtatcccatttgcttaactgtttgatgaatatgtcagcttgtttaactttttgtttctgtatcttctttccagtgaagtttagagcaccttttaggcagaaactcttagacatctttggtatacccataccacacgtagtgcagagatgtgagtgtgtattaaacttagattgaaattagtttattagtacttaacgtgtttacatcttttaaagatatataaatttcacttatattttctactatgtctatccttagtctttttaccaattgacagttcttattgtagtattttttagcttgatggttaactgtttttcccctagcggaaccttttttcccaaatgaaattttacgataaaccataacgtataaaatagataaaacagattgttctgttccacctgacctccttctgcctattatccatggtggtctgtaggccccgagatacccccacagatccctgcaactttatgaaatagtttgagaatgactgtgttccttaattttaacattatatatggaatcatcagtgagagctaaattaacaaatttgtaaccattgacaaaattgaactcaataaattattaaactacctttccttcactcggcccttgggccaggtgtgtcttacttaagtcgttactattgcttctgggctaaacatggatagctcctaagggttgggaaaatttaagatgagttctatagtttggtcataccttggtagaaaagatgtaaccgaaacatttttaataaatgaactttcaagcttatttgcagtctctttctctgggaccaggacttcaattttgtgacttcccacaatttagccattacccagtaaccagtctgtcccactcctgttgtcccgatgggccattctttttcttttctgcttttctaagtgcatgttaagttgggattcttttttactttacttgctgaaaagatgccagtttacatacttttgccccttctacaattaataaagtctctctttttctttttaaaaaatacagtggattgtcctgtttgcggggttaacattccagaaagtcacattaataagcatttagacagctgtttatcacgcgaagagaagaaggaaagcctcagaaggtaaggaagttgagcagaaccattgagctactttagctgggtgcctcttgtgcttacttgggggaaaattacagtattccttttatcctggtgaccgtatttcctgctcttacttgctttcttctttactcctgttggccacttcttccaatccctctcctctgttctttcttcaactcccactttgccaaatatgattagctatattgaatatttgaactgctactaaattttgacttaataagaaattagtgacttcaaattcaattctttttaaacttgtttttttctcttagattttaaaaactaccaaaaagcctcttggccaaagaaagcaaggttagactctgaatataagatataaaaaacctttctctgatctttaggatgctcagaagttttaaaatttaaaattgaatttttcaaaaaattttgactaggaaattatataaatatatatgatataaaaaggtacaaaaatgcatatatgaaatgtaatgtcataccccacaccacccccccatcctccaggtattgtagctaataaattgtcagctcagtatttacatctaaacaactgtgctgttctacctcccttgtacatgaaaataactgtaatttctcatgctagtccactattgttacacatataagttgttcaggaatgaaatactagtcaaacttaaattgcaaggcattacggaatcagtggataataagcagaagacacaatttagatgagtctggtgatgaagggagaaagatgagatggtagtttggagaagcagtgagtggcataaagatcaagggttgttctttttaaaaataggagtttaagccttcagtctctttccttccactatttccagggagagagcagaggataaatggaagaaagtgaggagcacaagagcccagtaatgaggttatccttgacatgcagaaaggacccttctgaaacaggaggcaagggcaagataataggtgataattcagagagatttggaaaagaagaggagggaagctgaagaaattaatggtatctgagaagtggggatgaaagaatgatttgcttctatgttcagtctgttttgaaggactttgaagagtattttccaaaaaccatgttaataagacagagccatagtattattttttgtgattaaagaaaatacatcacttaatttttatgagtaaatttggagtgaatgcagattctgagggtcagattcatactgttacaacttacaaaagctaacatataagacacaatggtgctttattaaggtagacatacttgagtccaaacctggggcagttttacatgcacagtactcccacctagtgggtaagtttgttaatgagaataaaatttagatttttaggttgcttagtggtgatttggagtaaatgaatagtcctaaggattatttcccataagccacgagagtttgatgaactgcttttctctttagaaatgcatgagttgggaatatagaagctgagtatattcttttggaagagtaaggaatctgcactgattatcttgcatggactcccctttttctagatccatccatcagttcgaatacatttctgatacatcatttctgatgctgtcagtttgtttgaagacatactcgtccatgtgtaattaagttctaatagtggtttaaattcctgcttcaaagaacactatagtcctgccagtgctctgtagtgaacttataagcactacctcctggatccccctcttagtgtgttaaaggctttgagaagtcctacattaagggttactgttaggttttgtttaatttagtaatcctaaatttatttgaccgccaagcctttctgttctcatcacttccatcttacaaaactggtgtttgtggagattctgaagacaacactgggccatgttcttctttagttgtatcttggccacggagtcaggtcatagagaaaaggccctgtgagttttcctgtctcctccacaatattctgacaggccatctgctgaatgtgagtggcagcccttaacccttctatataaaaccatgtcagaactgcctcagattctgaggccccttaaatgtattactcagttccactaaatcatggaagaaaaatcaatgtcattttcgtgtttggggaaacatttatcaggtttcatgttttaaaattcctgatagaaattgttgatctctggtggtgctttttattgtaaatgccagtgaacagtacagttcttcactggaatttcacagtcacagtttaatcatctgtccttgataaaacaaatattttagatacagacgtaatgaatcatctctccctgtgtgcttctgtaaacacaaaatgattcagctgttgctacctactgagatttcattttgccataattttatcaaccttgtagagtcagatgggttgtcattgtaagaagagcaattttcagaaaaatataatctattgagagtttgcaggtcttttcacagttaattagttatttctggcttttagactttgttaatacagcataaaagacataatttatttggggaatggctctgttggttaatagagaaatttttgattgttttcagtctatacctgactgtaatatttctctgtttgattattggaccgtttatatcagatttactctggagaaccttgttgaaaatagagattttagagctccacttcagacctgaaccctaattggtggatggtgtggagaaggggatggagaatctgcgttttaaataaactctttaggtgcttcttaggtacactaacgtttgggacagccttgtgtgagctagttatatgcaaatcctttgtaaaaacttgttttttggataaacctattatttcaagtttctgttaattttcacctgaatctttgctattcttattttgaaatgatagcaagtgtaatgacctccttgagcacatttttgttaagcatctaattgccataaagctgagccaggtagagaacctgctataatcaggtgaaatgaattaaaactcactaagaagttcctgtttatggaattgcttaagtcattggtacttttatgtagcttgaattttagcccactagaatttctagcatgctttaaagaggtggaaaattgaataggtctatgtaagtgtgattctaagtgaagtcctcacagcatattccacaagcgttacatatatgtcttctaagtgtgcctctttaggtctgacctctttttgagacccaagtctctcacttctggtgccacctaggcccctgtgtctgaatgtcttaccagcacctcagatacatcatgtcagacactcaactttatccacaaacttgatttttctctcccctttttaatctaatggttctactattttcccggtcacccaggtgttgaatcagaatttatttgccattttacatgaaaagcatttgataattcacaataatcatcaggtatcttccccccttttcagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcaggtaaagtaataaaacagtgagttatgcttactttctggataaagcaattttgtgtagctcagaaattataaaccatagaaaaatattgtaaataaatacatttttgatagataagacgtgcaaatgtgttccttcaaaaggtacctagagtatgctatgataagccagccttcctctcagcctgccttccaatccccagatcccttctcagaggcaccccattgccagtttctcatgtgcctatctagggagaatgtggtggggaagagtggatctggagagcctgggttacagtgcccgtttttcagctttgtggcttggtgactgtgggcacgttacttgatatctctgtacctcagttttctccttcataaaataagggttataataactacccacttcataatgttgagtgaaataaatgataaaaggcatgaaaagtgcctaacacagtaccttagcaagtagttagctttcagtaaatgttgccattatgattattgtacacaaacatatatccttttcattactgtttttacaaaatgatagtattctgtgtagtgcactatttagtggttggttcttttcattaaaccacacacatacattggagttctttctattaacatatagaattgcctaatttttaaaaacttggagaataacatgcaaacattaaaacacacaaattataagtgtattgtttggtgaattatcacaaactaaatttcataaagtgaaatgtcattgtagccagtactgagatcactaccagcgtcccaaaagccctatctgccccctcccattcactccttcattctcacatttgaccactgtcttgacttctaaccccatatgttcattttgcctatgtttgatctttaaataaagggccaatagcttatgtattcttttgtgcctgccctcatttgtgcaacattataagattcattcatgtttttttatatggtcatgtttttttcatttttgttgctatatggtattccattgtataaacgtatcatcttatccattcagtgtttaataaacatttcattttgttcccacttttcctctattaataatgctgctacaaataatcttttatatatcttgtggtgcacataggtgcatgttgctgttggatatatatatacaggaatggaattggtgttatatatttgcagatattcagctttcatggatacagccccaaattcagtagtcatgtacactttcatcaggagggtgtgagggtgtcagttgttctgcacccttgacaacatcaccactgttaactctccattttagccattctagtgggtccatggtagtaccttgttattttaatttgcatttccttaatgacttataaattttatatgcttgttggccatctggatgtcctctgtagtgaaatacctgtttaaatctatgtccaattcttctgttctgtgggcctatttttattcttatttgtgggagtaattgaaatttcctggataaaaatcttttgctggatgtatgtacatttctaatttcaccttttcactctcttaatggcatcattgaagagtagaagttcctaaaatagtccaattcattacatttttccttttgatcagtgctttgccttagcctacttcaagatcatgtggatcttctcttgttttcttttaaaactttattgttcttgctcctaaattttgatgtacggtttatctggaattgattttagcatatgttgtgaggtagaggacaagattgtcttgttttctttccatatgaataaccaattgatgcagcaccactcattgaaatgccatcccttctcccactgaattgccagaagtcttggctgagaatcagctaattgtacatgtgtaggcctggacattgttttgttccattgggctattatttaccgttgagcaggataaataatgtgtgtcttaagtactttatgagtaatttataataggtcttgctgtctggtaatatagttcttccagttttgtttattgaggttgacttgttttttctaggccttttgtatttccatataagtttttaaattgggattacattgaatttatagatcaattttgagatagttgatatctgtatagtatttgagtcttccaattcatgaatatggtttgtccccttttttgtctttgatttttgtcagtaatgttttgcaattttcagtgtgaaggtctcacacatctttttaaagagttattctctgatatttttgatgcagtggtacacgatgttttattctaaaatgtcaatttttattagttgcttgtacacaaaaatacaactggtttttctatagtttccttatatccaatggcttgtcgctttttgtatgtgccctttttattgatgtataacttactcacatgtaatacatcctttgaaagtgtatagttagatgaatttaggcaaatgtatattgtcatttagccattgctctaactgaaatgtagaacatttccttcatcagcaaaagttccagtgcccctttgctgtatattccctctcttttactctaagacctcaggaaacactgatctctttttttgtccctataattttaccttttctagactgtcacataagtggaattacacaaattgtatagtatgtagcattttacatatggtatctgtcacttagcataatacttttgagatttttccatgttgttgcttttaccagtagtgcatttattttttattttattttatttatttatttatttttgagacagagtctctctctgtcggccaggctggagtgcaatggcgcgatctcggctcactgtaacctccgtctcccaggttgaagcgattctcctgcctcagcctcccgagtagctgggactacaggtgcctgccagcacgcccggctaatttttgtatttttagtagagatggggtttcaccatattggccaggctagtcttgaattcctgaccttgtgatctgcccgcctctgcctcccaaaatgctgggattacaggcatgagcccccgtgcccagccagtgcatttattttttattgccaagcagtgttctgctttatagccatgccacaatttgtatatcccttcacctgttgatggacaactggactgtgtccagtttttttattatcagtaaagctgttatgaacatgggttcacaggtctttatgtaaccatatgttttcatttctcttgggtggagtggaattgctggtcatatggtaaatgtaactataagaacctgccatacagtttttcaaatgactgaatcattttgcattgtgagagagtcccacttttgccacacccttgctaacacttggtattttcattcttcttaattttagccattctagtcaatgtgtagtagtggtatctcatgatggttttaatttgcattttcctgtgactagtggtgtctgctgtcttttgatagttttatttgctatttgtatattttctttgataaaggcttggttgaaatattctgccccttaactctttttattgatttgtaagttatttatatattctggatactgaatttttaaaatatatgtgttgtgaatattttatctttgtatgtggcttaccttgtcattttcttaatgatgtctttgaagagcagagagttttaattttgacgaaatttaatttactttttttatgatttatgcttcttgtgtatcatttcatgattttttatgtatacaattgtgttgcatgtcaacaaaatatttgcttatcctaagatcacaaaaaatttctcctgtgttattttctaggagttttataattttcgcttttatatttaaatctatgatccattttcatttagtttttctgtatggtggaaggtaaatgtcaaatgtcaaagtttatttaaaaaatatgtatatctagtttttcagcaccatttgttaaaaagactatcctttccccattgaattactttgccctcattgtcaaatcctaacggccatgtatatagcatgtgaatctatctagaatctattctgttccactgatctatatatctgtcctttcactcatgacacactcttgatttctgtaactttatagtaagtcttaaaattatcaggtagtataagtccttcaactgtgttctcaaaattgttctaggtcctttgcaatcccacataaatgttagactcagttttgttgttgttgttcccctaagaaatgtcaggctattatccattcttgttgttcagtgttttctgaacactgagtgtagaaatagccactttcacttcgccccgatgttacaggcatagcagagcatctgcatctgtgcagctggcaggtccaggacagcatctgcagggcagtcagtttattagtgtgtaccttttgggattttgagtgagattacatagatcagcttagaaatgatatcttaacaatattaagacttttaatgcacagtcgtggtatggctctttaggcctcctttactttctctcagtagtgctgtctacttttttatgtgtgtgtgttccatgtattttgttaaatgtatccttaaatatttcatgtcttttggtgctattgtgagtagttttaaaatttttatttctcattgtttattactattttaaagagtcattttgacatttatttttgtatatttacttgtatactattaactagtgaaactcatttctaattgcttttttatagatttcataggatttttatatacacaatcaagttacatgccaataaaaacagttttatttatttatttttttcagtcgatatgccttttatttatctttctacccttggttagttgcattggttagaacctccagtgtgatgtggaataaaagtggtgtgggcaaacatcctttcctttctccaatcttttttttaaatgaatttcttaagaaaggatctctgactttcatctgatttttcaagggtctgtctccccagaaggaagaataattgccttcaaaaatcatttgagtgacagtactattgcatcaatatatgttcttttaattctggaataccccaacttataggtaaaacatttagtctttcactattaagtgtgataggttttcatagatgccttttatgaggttgaggacatttcttcccttcctagtttattattatgaaggcgtgttgaattgtcatttccttattctacatctattgagattattatatttttatttattttgtgatatgatttataacattgagtattaatcagtttattgaaatataattcatataatactgagatataattcatacccacctgaagtgtacatacagttcagtggttttcagtatattcacagagttgtacaactatcatattaaattttagaacattttgttaccctgaaaagagcccagtatccattagcatcattatctaccaacccttccagccctagatagccactaatttacttctgtctctatagagttgtctattctggatattccatttaagtggaaccatatagcatgtggccttttataaactaacttctttcacttagtataatgttttcaaggtttatctgtggtcaatactcacttatttttcattgccaaataatattccattgtatgaatatgtcacatctttgtgtctgttcattagttcaaatctgacatttttccactttttggctattataaataatgctgttatgaacatttatgtacaaatttttatgtcgacatatgttttcatttctattgtgtctttacctaagagtagaattgctgagtagtatggtaattctattttaacattttgaggaattgctagactattgtccaaagtggctacaccattttacatcctactagcagtgtataagagttccagctgtgccgggcgcagtggctcatgcctgtaatcccagcactttgtttgggaggccgaggcaggtggatcacctgaggtcaggatttggagaccagcctggccaacagggtgaaaccccgtctctacttaaaatacaaaaaattagctgggcgtggtggcaggcgcctgtaatcccagctactcaggaggctgagacaggagaattgggtgaacccaggaggcggaggttgcagtgagctgagatcgtgccattgcactacagtctgggcaacagagtgagactccgtctcaaaaaaaaaaaaaaaattaattccagttgctccatgtccttgccaacacctgttagtctgtctttttcctagtgggtgtggtattgatttacattacagtgattaatttttgaatattaaactaaccattcatctttagcaaggaatgtgttcatttcatctaagttgttgaatctatagccagagggttctttttgtttttgtttttttaagtaacattttcttgttaaccttttaatatctatggggtttgtggtgatttactgtctttcattttctatactgaaaatgtgtcttcttttttcctgattgttctacctataagttattaatttttctcgtttttctaaagaatcatccttcagcttcatttttctcaaattgctttttctcagtttttgtctgttttcctatttcattgaattccagtcttttatgatttccttctttctacttactttaggtttaatttgctcttctttttttagcttattatggtggaagtttagataatttcagattgttctcgatgtatttaaaatacagatttttgtctaagtgctattttacctctattcacagacattgataggttgtatttaccttcccatccagttaaaatattttctaatttttgttgtgtattcttctttgattcatatgttaaatagaagtattgtttaatttttaaagattttggttatttcttagatacctttttattattcatttctaatttaattcaatgttggccaaagaacctgttctgtatcatttcagacctttcacatttactgagacatgcttcataacttaggtgttaggtcttcctggtgaatattgcataaatacttgaaaagtttgcttttttgtgcagtgatctgtaaatgctatgtaaatttacttgatagtatattcaagtcttcagcatccttgctgatattctgtttactgattctatcaattactgagaagctttttgaaatatccaactatatttatagatttttcattttccctgtcaatattttcagttttgttatattttgaatctcttagtattattatgtatcttcttgattagttagcctgtttattattatggcatatatgtctttgtctctggtaatattccttgcctcaaaaatctatctgatatgagtatagcagctactttatttcatttttctttaaacctattataccattatgtttaagctgtgttttattgtaagccgtatatggtttggattttattttataatttaatttgacaagctctaccattaaattgtagggtttaaactattttaatttcatttattctatttggttgggtttatatctgccatcttgcttgtttgctgttctatcattcttttgttttttcttcatttcctgcttttttttggattaactgagtattttttagttttttatgttatcttcattttacgagctatacttctttttgtttttttgtaggggtgattgttctagtttactatatgcatttttaacttatctcagtctaccttcaatgaatagtacactacttcatgtataatggaaggaccttaagactttcattcttttttttttttttttttaagttttagggtacatgtgcacaacgtgcaggtttgttacatatgtatacatgtgccatgttggtgtgctgcccccactaactcgtcatttacattaggtatatctcctaatgctatccctccccactccccccaccccaaaacaggccccagtgtgtgatgttcctcttcctgtgtccaagtgttgtcattgttcagttcccacctatgagtgagaacatgcggtgtttggctttctgtccttgcgacagtttgctgagaatgatggtttccagcttcatccatgtccctacaaaggacatgaactcatcattttttatggctgcatagtattccatggtatatacgtgccacattttcttaacccagtctatcattgttggacatttgggttggttcctagtctttgccattgtgaatagtgccacaataaacatatgtgtgcatgtgtcttaatagcagcatggtttataatcctttgggtatatacccagtaatgggatggctgggtcaaatggtatttctagctgtagatccctgaggaattgccacactgacttctacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatggtgagcattttttcatgtgtcttttggctgcataaatgtcttcttttgagaagtgtctgttcgtatccttcacccactttttgatgggtttgtttgtgtttttcttgtaaatttgttggagttcattgtagattctggatattagccctttgtcagatgagtagattgcaaaaattttctcccattctgtaggttgcctgctcactctgatggtagtttcttttgctgtgcagaagctctttagtttaattagatcccatttgtcatttttggcttttgttgccattgcttttggtgttttagacatgaagtccttgcccatgcctatgtcctgaatggtattgcctaggttttcttctagggtttttatggttataggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatagtcgtagatatgcggcattatttctgagggctctgttctgttccattggtctatatctctgttttggtaccagtaccatgctgttttggttactgtagccttgtagtatagtttgaagtcaagtagcatgatgcctccagctttgttctcttggcttaggattgacttggcaatgcgggttcctttttgattccatatgaactttaaagtagttttttccaattctgtgaagaaagtcattggtagcttaatggggatggcatagaatctataaattaccttgggcagtatggccattttcatgatattgattcttcctacccataagcatggaatgttcttccatttgtttgtatcctgttttatttcattgagcaatggtttgtagttctccttgaagaggtccttcacatcctttgtaagttgggttcctaggtattttattctctttgaagcaattgtgaatgggagttcactcatgatttggctctctgtctgttattggtgtataagaatgcttgtgatttttgcacattgattttgtatcctgagtctttgctgaagttgcttatcagcttaaggagattttgggctgagacgatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataaatagctcttcttattttgaggtacgtcccatgaatacctaatttattgagagtttttagcatgaagggctgttgaattttgtcaaatgccttttctgcatctattgagataatcatgtggtttttgtcattggttctgtttatatgctggattacatttattgatttgcatatgttgaaccagccttgcatcccagggatgaagcccacttgatcatggtggataagctttttgatgtgctgctggattcggtttgccaatattttattgaggatttttgcatcgatgttcatcaggggtattggtctaaaattctctttttttgttgtgtctttgccaggctttggtatcaggatgatgctggtctcataaaatgagttagggaggattctctttttttctattgattggaatagtttcagaaggaatggtaccagctcctccttgtacctctggtggaattcggctgtgaatctgtctggtcctggactttttttggttggtaggctattaattattgcctcaatttcagagcctgttattggtttattcagagattcaacttcttcctggtttagtcttgggagtgtgtatgtgtcgaggaatttatccatttcttctagattttctagtttatttgtgtagaggtgtttatagtattctctgatggtaatttgtatttctgtgggatcggtggtgatatcccctttatcattttttattgcgtctatttgattcttctctcttttcttctttattagtcttgctagcagtctattaattttcttgattttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgttaggatgtcaattttagatctttcctgctttctcttgtgggcatttagtgctataaatttccccctacacactgctttaaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaagagtgctttacttccaactatggtcaattttggaataagtgtgatgtggtgctgagaagagtgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggcctactttgtctcttttgatctttgtgggtttaaagtctgttttatcagagactaggattgcaacccctgcctttttttgttttccatttgcttggtagatcttcctccatccctttattttgagcctatgtgtgtctctgcatgtgagatgagtttcctgaatacagcacactgatgggtcttgactctttatccaatttgccagtctgtgtcttttaattggagcatttagcccatttacatttaaagttaatattatgtgtgaatttgattctgtcattatgatgttagctggttattttgcttgttagttgatgcagtttcttcctagccttgatggtctttacaatttggcatgtttttgcagtggctggtactggttgttcctttccacgtttagtgcttccttcaggagctcttttagggcaggcctggtggtaacagaatctcccagcatttgcttgtctgtaaagtattttatttctccttcacttacgaagcttagtttggctggatatgaaattctgggttgaaaattcttttctttaagaatgctgaatattggcccccactttcttctggcttgtaaagtttctgccaggagatcagctgttagtctgatgggcttccctttgtgggtaacccgacctttctctctggctgcccttaacgttttttccttcatttcaactttggtgaatctgtcaattatgtgtcttggagttgctcttctcgaggagtatctctgtggcgttctctgtatttcctgaatgtgaatgttgggctgccttgctagactggggaagttctcctggataatatcctgcagagtgttttccaacttggttccattctccccgtcactttcaggtacaccagtgagacgtagatttggtcttttcatatagtgccatatttcttggaggctttgttcatttctttttattctttgttctctaaacttctcttcttgcttcatttcattcatttgatcttccatcactgataccctttcttccaattgatcgaatcggctactgaggcttgtgcattcgtcacgtagtttttgtgccatggttttcagctccatcaggtcatttaaggacttctctgcattggttattctagttagccattcgtctaatcttttttcaaggttcttaacttctttgccatgggtttgaacttcctcctttagctcggggaagtttgatcatctgaagcgttcttctctcaactcgtcgaagtcattctctgtccagctgtgttctgttgctggtgaggagctgcattcctttggaggaagagaggcgctctgatttttagaattttcagcttttctgctgttttttccccatctttgtggttttatctaccttttgtctttgatgatggtgacgtacagatggggttttggtgtggatgacctttctgtttgttagttttccttctaacagtcaggaccctcagctgcaggtctgttggagtttgccagaggtccactccagaccctgtttgcctgggtatcaccagcggaggctgcagaacagcaaatattggtgaacagcaaatgttgctgcctgattgttcctctggaagttttgtttcagaggggtacctggccgtgtgaggtgtcagtctgcccctactgggaggtgcctcccagttaggctacttggggttcagggacccacttgaagaggcagtctgtccattctcagatctaaagctgcatgctggaagaaccactgctgtcttccaagctgtcagacagggacatttaagcctgcagaggtttctgctgccttttgtttggctatgccctgcccccagaggtggagtctacagaggcaggcaggcctccttgagctgtggtgggctccacccagtttgagcttcccagcctccagcaatggcaggcacccctcccccagcctcactgccaccttgcagtttgatctcagactgctgtgctagcaatgagcgaggctctgtgggcgtaggaccctccgagccaggcacgggatataatctcctggtgcgctgtttgctaagaccgttggagaagtgcagtagtagggtgggagtgacccaattttccaggtgccatctgtcatccctttccttggctaggaaagggaattccctgaccccttgtgcttccccggtgaggcgatgcctcgccctgcttcagctcactcccggtgcaccgctcccactgtcctgcacccactgtccgaaaatccccagtgagatgaacctggtacctcagttggaaatgcagaaatcatccgtcttctgcgtcgctcatgctgagagctgtagactggagctgttcctattcggccatcttggaactgcccctgactttcattctttgtactatttttgtcatagatttttcttctatgtattttaaacactctataataccttgttactatttttgctttaaactaaataaaaatggaaaagataaataaaaaatggaaaagaaggtctgtgtttacctacacatttaccattttcagcattctttgtttctttgtgtagatctgggtgttcatctggtgtcattttcttttgcctgaaaaaacttcattttttcctggatttccacagtgtttggacatttcctgaaaaactttatttgttcattctgtcttgtttttttttaaagatagggtcttgctctgtcacccaggttggagtgcagtggcgcaatgatagttcaccgcagcctcggactccaggaatcctcctgtttcagcctgccaggtagctaggactacaagcgcatgcccagctaatttttgtttgtttgttttgtagagacagggtctcactgtgttgcccaggctgatgttgaactcctagcctcaagagattcccctgctttagccccccaaagtgcagggattacaggcatgaacattgtgcctggattattcaatatttcttgtagtgcagatgtgctgttgagacagattctctcagcttctgtttgtctgaaaaagtcttaattttgcattcttttaaaaaactttttatttggaagtttataggaaagttgaaagactatcatagtgaatgcatagactgtaccctttgtacagatccacctattgttagcattttgcctcatttgctttatgaattactctgttcctctttctctctttttctgtgaatgtgtgtatgtgtccatataattacacacatattttcttctttaactgcctgaaaataagttatatagtgtttaccctttacccctaaatatgtccttgtattatttcttaagaaaaaaagattctcttttattgccactgtagttagtacttgtagtagatttaactttgttataatacttttattcatctatccagttttgttagtggacccaataataacctttgtagattttttttcctgcagtacatgatccagttttggatcacatattgcatttcgtggtaatatcttttcaatctctttcaatctagaataattcctcagcctttctttgtcttttatgacactggccttttaaaagaatacagtctttgttgtgtgtgtgtgtttttcaagtaaaatcttctcattctggcagaaaattcagattatgccttcctggccagaatactatataagtgatgttttgtcttcggaatattacatctagagccatttgacatctgtgtacccctcatttgtgatatcaggcctgatcacctggccagtttctctctggtttatactttacatccgctgccttgctactaataagaagtctgcagagacacttcaacactatgtagctattctatacctcattaagatttcacccctatatttagcatcctttggtaatttttctctaaactattcttttctgtgatagttgcaaaatgatgatttttcaactttagcattggtttcacagttgctaattgatacttggcatgattctgaaaacaagagcccttccctctgccttattattattttctttttcttttttttttttttttttttgagacggagtctcgctctgtcgtccaggctggagtgcagtggcacgatctcggctcactgcaagctccgcctcccaggttcacgccattctcctgcctcagcctcccgagtagctgggactacaggcgcatgccatgcctggctaatgttttgtatttttagtaaagatggcatttcaccgtgttagccaggaaggtctcaatctcctgacctcgtgatctgtctgccttggcctcccaaagtgctgggattacaggcgtgagccactgcgcccggcctgccttgttattttcttatttgtctcttatgaatatggattcacagatttttaactcattacttctcttaattattttcgtgtttgtatttttccacatttggccagcaggagtgtcttcattctaattcctgtcctcatgacatacacccccattattttcattaccgtcttcttatttctaacataacaagatattgcagacttttcttgctcttccatgccccagccctgaaatcagccatttctttgaggagcgctggtcctttttattggtgaaaccaagatatggctaccagctatgctcattgctacttggtgtctttgcttctaggctatttgagcagatgaagctgggaaatatatgcatatatgtgcatatatatacatacgcacacgtggatacatatatacatacacatgcatgtatgcatatatatacatgtaaatccatgtacacttacatgtttcaaggctctcaaaagtatttcatactgtagcagttttgttttgtctccagagcattaattgcctgttggatcatttttatgatggtagctttaaaattcttgtcagataattccagcaactgggttgtctcaggtattggcatcttgtcttttttcattcgagtcgtgattttcctggttcttaatatgtcaagtttttttttaaattgtattctgagtattttttatattctaatgacattctaggttctatttaaatattctaatttagcaggaagtcatcttgtttaagtttagcatgcagatcctggcctatttttgtaggctgtggttctaatgatgatttagttcccagatcccttgaaatgttattttggtctactttatttaattgctacctagagactgttgtgaatacctgatattccacactgtggttcagttttcaaaccttttggcatattaattgtaaacaatttcacatgttggtcggggatgccctgcacaggctgaaggaattcttttctccagtttccttctctttgatattctcttctcagttattagttgagagggtgcagttgtcagctgccatcattggatggggtgtagaagtctgagctcctcactaggcttccactgacattgttgctatgggaggacatcctgcactaggaccccttccacctctggttgatgggtagaagtccatgctccccacttgctctctgataatactgcacagggcagggagcatcagcagtgttttgcttgggtaggtcaagtattatcaaggtttctgggtaccctctttttcagtcctttgcttataaagagtagatttttcttgaggcttttttgtctgtttctcttgatggctctggacttctccagagcatagtctataagatacagaatacaaagacaccccagggtgacacacagtgtcattcctcacatgctgagatcttagccagtccatcttcctctttctactttccagagttctcttatagttgtctgttatatatcagggtttttagttgtacttagcggagaaatgagtctaatccatcttgtttggaagaagaaatactttttaatgtattttaaatttctgttttaggggcaaacacatttaagattatgtcttcttggtaaattgacccttttatcacgatataatttcccttttttttttttttttttttttgagatggagtttcactctagttgcccaggctggagtgcaatggcaccatctcagctcactacaacctcctcctcctggattcaagcgattctcctgcctcagcctcccaagtagctgggactacaggcatgagccaccatgccgtgctaatttttgtattttcagtagggacgggatttcaccatgttggtcaggctggtctcgaactcctgacctcaggtgatccactcgcctcggcctcccaaagtgctgggattacaggcatgacccactgcgcccggcccctaatttcactctttatccctgataacattcattgttctggagcctattgcgcctcatattaataaagctcctccaggtttcttttcatgactgtttacatgagacatctctttccatacttttatttttaacctatctttttatttaaaatgggttatttttgatagtatatagtttggtcttgcttttttatccaatctgacatcctctgtctcttaattggtgttttaaaaccctttctttaatgtaaatactggtgcagttggctttgaatttaatatcttgctgttttttcctttgttccgtctcctttttgttatctttttttgctgttttttggattgagcatttttattattatattttatttctattattgtcttattactttacctctttttcaaaaaattttagtgttctctctagggtttgcagtgtacatctttcattagttacagtcaagtaattatacagcctcacttgtaagaaacttttaacagcatactcccaactcctaattctttgtattgttattgtcatgaattccttttacatatactgttaaaccattacattgctattgtttgtccattaaacagttatcttttagagtagttaaaaacgagaaaaaagtatattttatacttatcttcatgtttaccattttcaccagttttcatttcttcttaggtaagtttctctctggttcttctaattgaagaacttgttttaatactttttgtaatggagggctgctaataatactttctctcagcttatgatttcctcagaaagtttttgtgtttcacttttgaaagatatttttattagaattctggattggcgggcttttttctaatgctttaaagatgtcactctattgttatctggcttgaataatttctgatgagaagtgtaatgtaattcttgatttttctttatataatgtgtctttttcctctgatggccacatgattttgtctttgtgtctatatgcatgttgttgtcattttgggtttgtttttatatctgtgttgcttgatctttgaaattcttgcatttgtggtttggtgtctttcttatatttggcaaattctagacagttcttcaacgatttcttctcctcccttttttcttcttctgtgatttctattatgtgtatatttcttgatattgtcccatagctcttagaggctctgttctgttacaattttttttctttttcctttttttctctctctgtgtttcagattggataataccaatccaattttaggttcactgattctttccttagctgagtcaagttatctgttactgtgttggttttatgtgtctatatctatatatctaacatttctattttattctttctaaaaaaaagtatttccattgaagtaatttctacagaaatgccccatctgttcatgtatgttgttcatcttttctactagatcctgtatcatcttaatcataatttgctgctttttcatgtttaagttttgattgaaagccagacagtgtaggtaagagtctgaggtgccagacttttttttaaaatgtagctatatatcactcacaacttaggttttccctatgagcctgtgcctcagagagggtctctctccatgttcatttctctcctagaagtagattgctgttacgtatcacttggatcatgctaggtttgtggcaggcagaaaaggagggttctctgttactctgatttagcttcagtcttaggcaggtctttcaatcctgcatctcagagctggggctttttcagcgatcctgcccctctctcactgccaggggcaggggtcctctatgggtcagggcccagaatggtttcctgatcctcctgaagggtagagggggttttttgtttgtttttgtttacttccctcagcaaccgatgctctggggataacatttttgctgacctttcgtcagtggcttaatgctttttttcttcagggataaagatgtgattggggcttcatgtccatcctgcagtgggggtggttctcttttgccaggaatggatctggaggaagatcttttctaatttgctgcccttccccagtgagctacagagagactgaggactcttgtgggtgcccactgaggtctgtagaaaatagcctgcaaggccaggtgcggtggctcacgcctgtaatcccagcactttgggaggccgaggcgggtggatcacgaggtcaggagatcgagaccatcctggctaacatggtgaaaccctgtctctactaaaaatacagaaaattagctgagcgtggtggcaggcacctgtagtcccagctactcgggaggctgaggcaggagaatggcgtgaacccggaaggcagagcttgcagtgagccgagatcgcgccactgcactccgtcctgggtgacagagcgagactcagtctcaaaaaaaaaaaaaaaaggaaaatagcctgcaaatggatgtgatgcccgctgtgtccaagccacccaaaatttttatattttcatggtagctcacccttggtcttttgcagttcatcaaaaagtttagctgagatcttacccagagatagggtggtaccaatttttctctggtgtactgtcctatgtcaaccagtgctcatgatccctctctcttctaaggcactcatctttgtttaggtttcaggctagttgattgccctcttactttagctctgatggattcaagaaaaattatagttttataagttatcccgctttttctcgtcattagggtgagagtgacattatttatagctctctacaacctaaacagaatcagaaatctccctgaagaagatttaagccactaaattctacccaatcctaatatagttttctttttttttttttttttgagacggagtctcgctttgtcgctgggctggagtgcagtggtgccatctcagttcactgcaagctccgcctcccgggttcacgccattctcctgcctcagcctcccaggtagctgggactataggcgccccccaccacacccggctaattttaaaaaatttttttttatttttagtggagacggggtttcatcgtgttagccaggatggtctcgatctcctgacctcgtgatccacccgcttcggcctctcaaagtgctgggattagaggcgtgagccactgcgcctggcctagttttcttaatatcttacaagaggacatgccagatgttctctgtctttagtgatacttgtattaatggattggatagaatgcaaatggtccctgtgtttttcatgttattccatgactcattttggaaaggagagaaccactagctggtcatcttcacagagagattgtttacattgtttctactgattttacaatatcaaggaggcaaaaggtacctctcagtgctcagaaaacgtaaactttgtattgagacagttgcattcttaaatgatcgtcataaggtctgtggtttaaaaaaaataaaactttaatggggattatttcaaacatatacagaaatagagaaaagagtttactgatttccccatatgcctactacccagcttaaacaattatcacactgtctgaatgttgttttatctaccatttacacccctttttcttccatggattattttgaagcaaattccagatataatttttaagtataaatgagggttagggattgtagatttttatttcctaccatatgcatttcagttttaatgtattgactttggatgcagaaagatagcatttgcaaattctgtgctgtttgcattcaaaggcatttaatgtttgacagggtgtattccagatctcttttatgtatgtaattggattggtaacatacctacagacaaaggttctggaggcaaggacatttttcctggtatttgtagacctttttctctccttgaacagtagcctgttgtactgcatttagtacattggaatttgagcagacatcccctaataattgaactcacactaaaaaattaattttcatatttcactgagacttctgtttagacctgtatattcaaaggagaaagcaaaatgacttgactcttgtggttatacgttgaacagcatgtgcatgtgtaagagttcagtgttttaactccatgttatttttttaaccttttgttttgaaatggtaattgattcacagaaaaattgtaaaaatagatcagggagttcacatatacccatcacccatcttcttctaatgttaacaacttaaataattattgtacagtgattaaaaaagacatgtgattaacctagtggttattttcttattttaacagctgctgaaatagttcgagaaatcgaaaatatagagaagactaggatgcgtcttgaagctagtaaactcaatgaaagtgtatgttaatgggctatttcagtatatggatagaaatgaagaaagtttaataccctacaaaaattaaagcaagccattattaaatttattcatttactaacacatttccacttagtgtattatgatttacttgcaactcattttaggacaatatttgattgtacttagcagtcttctagcacaaaatgcaatccaaagtagagtttgttcatgagctagagttctatagaaaatgcctgtgcctgtgcatcaggcagctttgatattggtcctttctctgctggttgtgtttgataagctacctctaaggacctctaagctactgctagggacctctatgatccctttttagctctggcattctgcaattctatgattatacttatggaaatgttaagtaattataagaggataaattaagtaatttgaggatggaatattctcttgagctttggagggaatcagagacctaaaattcttcactgttgccttccactagcttgatgccccaaacttgaagacaggataccagtgaagaaaatagtcattgtgtcctgtgacactggagaaagtgttttggtctcttccaagtagactttttttttttctaggccatttgtagtgtgtttgtaaggagaaagcaatggttaccttaagaaagtaagtttgtaaccaaataagtaggaaaaaaatgggatttacattgaccctattattacctgtgtgctaactgtaagatgggaactgcagtgaatcatggaagcagatttctgatcttttaagtctgaggtttaaaaagtggacctagaggcttaacttactgtgttttgtattattgcattttctatacatactgcttttctataatgacctggagaagttagattggaaaggagagaaggcagacaagaagatcagccttactaatagtcagctaagtgtcgttagtcttctggtttcaaatattgcctgttgtattaatgaatgtgggatattaaatattgaaaatagaaaatttattattttgttaatatataattgaatcatgttgcattttctactgatgagaaaaaataatgagtaaaatgtataccatttctggtatttaagggaagtacataggaatgattcttcctaggtctatataaaacagatgagagatcattttcctctattttaaacactcacatttgagatttgaaggtttgtaatatttccctttttgtcattttggggagatttttattaaggtctttttttgattattttaggtaatggtttttacaaaggaccaaacagaaaaggaaatagatgaaatccacagtaaatatcgtaagttgcacgactttatttaatttgtaaagagcttcagttgctgtttttcatcttaagtaatttttcagaataatgttttatattaaggttcaattcaaacttttgttaacattacttaagagattgaattttaattgggtgtttacttagtgactttttttgtattttatatgcctgctttttgatttttatgactagcattctactttgagcttatcactaagcactttgcaaatattaattagctgctctcaaagcatttctgtgaaaagaagctgggattaaaatggaaacattcgggactctatcctgtcctcaggccactcagtaacaatacttctgtataggatttcaatgcttctatagcttgcaaatttgtgccaaaaatagttttcattttattgcttgttagcaacctcccaactttatcacttccttttccttaaatggtcttcgtgtatatctttcccagggctaacacattactgttttgtcagatagctgttactctttgtgtggtggttggattttagtttaaatttaagtgcctgacgaacagtagatagttaatagatgttcattgaatcagtattcccaggcatggtatgttttaattgaggtaagataatttttttctctcttcatttcttaaactctgaagggccaggttctgtagtgatgtattgtgggagggaggatgaagcacacctgcgctggatgtaggtgtgattgcctgtgccttgctagagtaggaaaaggaccctagaggagtcttggattatggactgaacaacaaaagtcaccattgttctgttgctggacagataagtatgatgtgaacctctttgatcaacttgtaggatgtcagagtgatttttctttagaaaggagaacaaaagagaatatcaaatgatcagtgaattggcctggaaaaataaggatcactaaggcctgtgaaaataaggaaaccagaaaacttgcattgggagaaagtaatttaaataactgaaagggtggtatctaataatcctcccatattaagaaaaatttggactatattcagtcaagtaaatattcattgcccaccatttagatatctaaaaagtgtaactttactaaataggtggtattaatttatttagccttaaaataaacctcaaaagtcaagtgcttcacaaagcttagatgcttagccttttagtttattcatacattttgatttagtgtcaggttctaactatactattgatatatcttcatctttaaacattttattaatgttttacatgtagtttttaaaaaatcatttactttttatgagccttatcatataaaagagcagtctcttgcatcctccaacaacctgcctctattcccattccctagaggtaacaactatcaagccatttggtgctacttttggtaattaccttacaatttataaaaaagtattttttctgctacttcttgaagtttttcaatttcacattaactattgatgtgctaatatgaaagatggagatttagctcatttatatatcctgagccctacctttgcttcccttccatcctttaaatattatgtcataagtttttgtaagctcagtatttagttagatacattgtttatggctcaagccagacaatttgcataagatggttataattcctttcatcaaaacattctgttgttcttttttttttttttgagatggaggctcgctctgtccaggagtgcagtggcgctatcttggctcactgcaagctctgcctcctgggttcacgccattctcctgcctcagcctcctgagtagctggcgcctcctgagtacaggcgcctgccaccacgcctggctagttttttgtatttttagtagagacggggtttcaccgtgttagccaggatggtctcgatctcctgacctcgtgatccgcccgcctcagcctcccaaagtgctgggattacaggcgtgagccactgcacctggccttgtttttcttataactaataattctcttttgtttgtttaactatttacctagtactaatatatctctaaaccttccaacagaagtgtaaatcactttccaatacatttacacacattgattataactcattattttctcaagaacgtctctcctagggccacccctagcctctgttgtcctgttccagtctactatgcttgtcctttttgccttctgttaatacatggctgctcttctggaatttcttgtcaccaactttctgggaattctgctctcctccttcctgtgttggttcacttcttccaagttccaagtctccctcttctcttgccttgttttggtagaatacatttgccaggaaacttcctgagaaacggtgtatgcaagcttgtctaaactgcggcctaggatggcctttgaatgcagcccaaaacgaatttgtaaactttattaaacattatgataattttttttctctcatcagctattgttagtgttagtgtattttatgtgtggcccaagacaattcttcttccagtgtggcccagggaagccaaaagattggacacccctggtatagaggaatttcttgagatatataacattccatacataacaggaaataacccgtttattattgattgataatttggctgtttgtagaactttaggttaaaaagatacttttctccaaattttcaaaggtattcttccgctgttttctactttccatcactgttgctaataactagcttgccattctgattctttatctttcatttgttactttttttttttatctgcccatgttcagttcaccaccaagttctgtcagtctctatcttctaaatatcccccgagtccgtacacttcttatgtatcactttgctctctagtcatcccccatctactcttgccccttcctaatactcagaagccaaaactgtcttccaaaactgctgagtcttcacatcatgccatttctgccttgctgccctcctgccattgtaaagaactcttcagtgggctttcgatttctcttaagctacagtttgtaaagtctgttatttcctgtatctggacctgcctacctctctagccttgcctcttctcctccccttactccttgtattccaatcactctggttatcttttacctactttaccaagtccttcactgttttagggcatttgttaccctcttctctctttgtctggaactatctctttctctaattgcctctgacccccctatctatactccccactctcaaccagctcaactgtagtttccctgggaaacccattgtgatctctaggacaaggtaagattttctttctatgtgcacttacattatcttgtgttttttcgtagtactattccattcattcagccatcacaagtttgtcaagtacttagcacgtgccagacactgtgctcggagctggggatataggaatgaacaagacagacaagaagcctactctgttggagtttatatctttctagtattttaggaagtgataagtgaaaaaataaagcaaggaagagtataatggtcataatcattatttattgtgcaattaattacttatttctaattaatttctaattatgtgtttttattagtgtgctagggttgccaaaacaaaatactgcatgcagaccgcatggcttaaataacaaatttattgtcttgtggttctggaagctagaagtccaagatcaagatgtcagcagggttctggaggctagaagtctaagatcaaggtgtcccgagcttctcagggccatgcaggaaggatctgttctaggtctctcttcttggctatagatggccatcttctccctatgtctcttgacatcgtcttccctctatgttgtctctgtgtccaaatttcccccttttataaacatatcagtcatattggattagggctcatcctaatgacctcaggggtggctcctctgtcatttccctattataagcagagtcctgaggtaggaaaaaaactctctcacttagaaaagaaaaaaaaaaatgcttaaagtgaatagttgggggttgggggcctgggggaagagcctcttgctctctggaaatgggttcctttaatcactctatgtctacctcaattcagatcagctagacctccatgaagggaaacagaaccaacattcctttaacccaaaggaaagagagaggtggcagggtcttggaaaagagacggatccaacaattccacattttaactcaccctttgtcatatcctggatgagcccccgtattatgggatagttccctggaccttgaccccctttgtgggtgggaactggagtagatcctttcactcagcgcactgctggccactccttgcaagagggaacgaatgctggaaccagccagatgctcctctctggtgggagcaggctctgtgcaggccccgtagcagtgtcctagcccctgccctttcagcatgtgggttcttgtccagcgtcttagaaaattgaggttgcacaaaccgatagtgggtagtgtatgtggaggattttattgggtgatggctggcagcggatgggagttggaaaggggatgatgcgggaagaaggtgatctttccctgaagctgcaccatctgaagttagctgcatctgtctgtagtctctgatgctcagctgcttgtatccctgacgctcagcagcttgcatccctgaccgcttgcatcagccgcttgtgttgctctgccagctgaagtgtttttatgggcaaaggataggggcatggcagaccaaaaaggcaatatttgggcggtgagatggggtcagctgttttcacttagggccaaggtcccaggttaagggtggagtttagccaggagcccagccattctgtatctcaaggacaccaaagagcctttgtttatgtgggtcatatctgttgatatgtatcacattatcaattaaaacttagagggtgtctgtttccagccatggaataacttcatttattctcctacctaaaacaagcaaaatgaatgtacaaaacatatgaaatagcaattttcaagatactggccacaaaggacagggatccttgagaggtaagcaaaaaatgcgatgagccttataatacagtttcctggctgtagtatgggcaagtgggtattccaggcaaagcctggagactctaagttaaggagaaagagctgagagatcagaggaaccaaaggagttagagtttgcaggacatagtactggaaggagaaacccagtgatctgcagagagttcaccttgagtattcatttggcatgcaaaatacgttctctgaccacagtgaaattaaattagaaatcagtaacaaagcccttgggaaagtcaccaaatatttggaaattaaataatccatttcgaaataacccataggtcaaagaagaaattaaaaccaagaaatttcaaaaatattaacaataaacccattacatgttagcataaataacatattttgattaaaaaaaaaaaaactgtttccccctctccaaaaaatagaaatagagatttctattagcccagatggaataacagagactatatttactctcctccatgaaaaaaaaaaaaatctagaaaacgaggtgaatgttgaatggtttttcagataatgggaaacaggtagcacaggactgtgatctctgagatagagagaaaacaaatcatgacttaggccaaacgttgctgtgaacagacaacattacatttcacagagatagaagggaacaggagtttcacagcttggaagcagcaaaccttgacaagaccagccttattagagaggtcagaagtgtttagagttgattgagaccaaattggaggtgaggaaatgagaccattaaggtagacaacttttcgggggaggttttactgtgttaaggagagcaaaaaaatagggtcatagctggaggggggtgttgggtcaagggagggttttgtttgcttgttttttaaagtttgttatttaaattgggagatatttaactcagtggctttctgacctttttgactacaacccacagtgagagataaattttatattactactaactgtatacatacacatgactgaaacaaaagcttcacaaaatggtatttaccttttccatttttaacgcattctgatactttctattctctttattatttcattaagaaaaaaatgctggtctggatttactgagttattttcataattcacactctaggttcaaaggcacagtctctctgttcacagcttcatgatggaatcctgagcataagttagaggttagcctttaattatagcaaggacagttgtttcatggtaagaacaagggaaatagatcataagtgcacagacaaggtatattggtgcttggaagatgacagagtttctgttagaatgattctatatttttcaaagtagtgtgaggccaactaagaggggccacatggggagtgtcgaatatttgaatgaagagaagaaagtgtgagatagatattttggagaatagtagagcaaactttactagagaaaggtgcaagagttttatagcagtattgaatgcccatttgagaattatgatcatgaaattaaagtgtcactagtcagttcagggctagatgaataagcctgtagtgaacattagccataactgttaaactctgttcttcatccacatttagctggttggctatcataggtgatatgatggtgaaagaaatatatgggattttactttggaaaacactgactccaaactcatttcttgatttaaagtagaagaagtatctcagtggcatcactgtagaagggtgtgagtcttttctactcttgagagagcctgtttttagtcttttgtaccactgggttctgggttcttgggcagacccagagacactctgactgtaagggctggtctaaagaagagtagttaaagtgatcagggagtaaagggcttgatttcgttctaaaaaagattacatttaaacttagagaggcacaaaggatggtatgattcaggtattcaaaatctggaagaaaatgagttgattgaacgtgtacttagtcatggacactcccacgactagctgagccacttaaaacttttaagaggaaaatccaggacacatgcccaccagaactgagattttaaactctgcagtattccttgccaaatggcagatcttctaaaatgaagtaaagaagtaagtgggaacaatgttactagtcttgatctgttgacatttttcattttctgagtaggggttattggaattctctggctaaagccagagtagtggctgccatttacttttggtttccagcctagctgtggggtaattagatttaaatctgggattttattacttcagaagataataagtcattaagtctccttaactgttaatgtgattactttagcaaatttcttgactaattcttaaatctccagtctttatgtgtacagtggaatggccttagtaggaaaatagcttagacctggtctaactaaattatgtagatcccatagtactgtgtcaccctcgcctaatagaaactacataatgatgatggtagtgttagcccattgattctaagcagccagagaaatacaagataattatcctcaagtgcgtagagtgaaataggacctcaaagaaatcacctagcttgtgtcctagataggatctcacttgtttgtaaagagttagttttttccagtgatctttacggccagcatatatttcttttgctgacactttaattggtcttttatttaaaatatgccatacattttatagcccaacattagtttcactagaagttttcatacatgtaccatacacataaaaatattgtaattaggagcattctttcctgaatgtctttgctgtgcctgtcaatattcatgtataggaatccaactattttcttccttgtgcgtcacaatttagtgttttctctttttgcgttaaaagataattttcaaaaacaactaacatcattctcatatggatgtaaaatgaacatgtgtttttattaaagatttaaactcattagtagagagaagactgatattatgaggtgatcaaagaaggagccaaagaatcatcacatttacagatgaggaacattgaaatgaatgtataatgagcaaaaaactggcttcttccacattggaggaggaaagtcaattgaacctccacccaacaggattttgcatatctatagacaagaattattttccattgctctcagttatctacaacatacagagttataccatagctcaaaggcagtgaatggctggaatcttgggagagtagatttagacaatgccatagttcaactgaagcacaattttttccctacacccagtaaattccctatgccttagtattatgctaaggaaaatggaagaaaccaagtgataacaagtacattgttgatttttgtatgaaaacagtgtcaaaattttgttttaaccatttgtagtatggttctccctaaaaattttataggatttatgacattactttggactgtggcctaagtatttaacgttgctagataagtaaactgtgacctcagctgcatggttcagaatcacaaatacatgccctaaagtccatacagtaatgatgactggctgctctttattgaacagattggtacattaataatgatgatcttgaggtcagggttaattatattcaaaggtgttaaaatggtagtaaataaagattagagttagtatagtatcgtaagataaggtagaattggttgggagagatcttagaatcttaaaggggctctactgggaaaccggccggaaatgtgaagaaaaaaaggagagctggagtagacggacattcctttgttatgatgattcaactttcctagaagcttctattttagattcagcaaatactcttagttctcttgtatcttggaagttagaatggtatcatttgtatatatttaagaaagcgggcatctttcatgctcttatgattatgtaaaagcctttctagagaatggagtttgggaagaaacctagagtagctaactaggaatatcatgtttccatatttgtatttgaggaagggagaagataaaaagaaggttccatgacactccagccctttgtattcttatgcttggcagcttttaaatttattgcaagtgattcctaaggatgctgttcttgagcaagcttgtacacctctgttttttgttttttgttttttttttttgagacagagtcttgccctgttgcccaggctggagtgcagtggtgcaatctcgggtcactgaaacctctgcctcccaggttcaagtgactcttgtgcctcagcctcctaagtagctgggattataggcacacaataccacacctggctaatttttttgtacttttagtagagatagggtttcaccatgttggccaggctggtctcgaactcctgacaaatggtccacctacttcggcctcccaaagtgctgggattacaggcatgtgataccacacctggctaattttttttgtatttttagtagagatggggtttcaccatgctggccacgctggtttcgaactcctgacaagtgatccattcacttcaggctcctgaagtgctgggattacaggcgtaagccaccatgcccatcccttgtacacctcttgatattcagtttgtcagttgtagatggttaactttcatagtcctagctttactgagaagatcttttgaatttcaggtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggtaagagactataattaaaaacagacatatgtcgaatttcattatttacttttaatatgaaaaaattaaaccaaagaaatttactttggagttcttagttctttgaaatgagaaaaagtatttttagacaaacttcatgtagcagtttgtaaactagatttattactatggggaaagtggttggaagaatgtcctgaagaaacaatctctttttgtctatcgtcctttcagttaatgataaatcataaatttctttgttatttaagcttcaggatgttttctagatatagaatttattggtggagatcctgtaaagagagtgaattatttttgtgatagaacactggtgtttactttggatgaaatgttctgccaaacagtctaaagttaacatacctggtaggctaatacagagcacgttccttaactttgatccattttaaaatttgaaattgatattttaattctattgcctgggctttggaccagtgaacaaaaaagaatcataatgggggaaagtgcgcaagaaaattgcttattatgtttttctatattgtggtaaaatatacataacacaatgtttatctttttaacccttcataaatgtacaagtcattggcattaagtacattcacaatattgtgtaactatcaccactgtctatatccaaaacattttcatcattcccagcacaaactttgcactcatgaaatagcaactcttccgtcccctctgcctcatagccctggtaataacaattccactttctgtgtctatgagtttgcccattccaggtacctcatataaatggaattgtataatatttgtctttgtgtgttggcttctttctctaagcataatgttttcagagtccttcaatgttgtagcacattttaaaattttaaaatattttaaaatttttgattaaacagtattccatagtatgtatatgtcatattttgtttatccatttatctgctatggttatttccaccttttggttcttataaataatgctgctatgagcattggtggtcagatatttaagtttcagcttagagtgcgatttctgattcatatgctggttctatgtttagaaccttttgaggaatcgttaaacttttccatagtggctgcattatcttacattcccaccagcgaagcatgagggttccaatttcttcacatcctcatcaatgcttgttattttctgatttttaaattttttaaaaattgtagatgtgaagtggtatgtcattgtggttttgatttgcatttccctagtgactaataaacaatttgtgcataaagtgctgcctcagtatgtaactcatggtcattgaacaactcgaacttgttcatgcagttgttaaaggatatttctagaaactagtttagcacttgagaaaatctgactgaatatttcccattaagaaaagtttttttaattagttgaacctctcttgaatatcattgatggcttgtatgtatttatgaacatcaatattactctttccggggttcagaggtgattgctgcttttagattgctgtgcatgaatgagatgtctgagagggtaaggtatgtgagagagatgaagacagacacagactgactgaaaagatggattttgtatagcatcatacaaccaatataattgttgctctttagaacattgaagtgctcatgtaagtgaacaagttgcatattctctcaagtgaaaacttagcctgtttttgttgtgtgtctctggggagctctgatgtctgagcctcactcttcggggctctattttggagtcctgcattctgagatctaagggcaagtaggaaggataacttattttttatgcccacagattattgaatgctgtttgttcccaagagggaatatatcttctagaagtgtatgtaagagtggaagaagtaagaaaagaatacagacaatgtgcaaaaataaaagattgttttaagttgaattcctgttccctggtttgctagcttgcttgcatgcacctcactagttgagtaatatagtccctgggtgaaccgagttgactgggggattggctcctcttaatgtgattctggtatctgtttacaagaggagttcctagaggttcaggatggtcatcctggctaaattctttttcccttttccagatatacattagagggtgctgttttgttttgctaatgatagtttattgacagccagatgacattaggagcatatttttaggaattacactcttgtgaagtatgctgttctctcagtgtaacaaaaacttagaactatttctgaaaaaaatttaactgtatgaacttggcaaggttttttgaagaatttgttatgttctttccccataaattctctctgtataatcaaaccttgacaattgtatttttagtgtgctttgttgaagaccacttgcctctacaagtgcttgatgagtgatgtgtgaaagctctgtttctctgtgaggaaacacatgaaaggagctctgtagtattattagcacatgtagcttgcatgtgaggtacctcctcagttcctgaaagttaaggacagcacagatgaaaatcccagcagcgttcatgatgagtgggagaatcctgggcactaaagaatctttcacagatattcttccactcatatttgtagaaaattggccatacccatatgccacatttttgtaaacactgcatccttccagctttttggggtctttatttttatctgcaataagagaccttgaaatctgagaatatgacaaagaatgcacggaaatgtgatgtgtattggatcaaatggaaatattccttatgtctgtttagttgtccttttccatagagaataattagattctagttaacctagaaaaatgtttagaaaaatgtccagatagattcactatcatataatagtagcaaatattgtggttgtcttattagttgaatctgtagtctttttttggttatacttcttatgttggtttgtcagtgttctctgatctatgaaatatgcaagaattccttagtgatatgttaatagaggcctcattagaattacaagattcttcctgcttctggttttaaaataaattttatttttaaactaattaatcttggaaaaacatgggctggacagtataattagatagcaccattgtagtgttaattcttgctctctggctgtcactagagttctggaatctatgtgacatatacttcaactttactaagtgcacatggcagtattaagtgttgcagaagtaataggcatacagaagttgtagattttaaggtactcttaaatttattttttcctaggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaataggtaagaaacatgcagtagttgattattttaaatatctacttcatatgcacatgtagatagataggcagaaataattagaatgtagctttgaggcatggcatggtgtgtcactcttacatttcagtccccttttactgctgggtcttcttcacagtgataacaaggcaggatttgggaaggtagtgcagggatcacagggtgagtttggtctctactctatagcctttatgtagatacttttcctaccgttggaaaagaaagcatgatagacagtgaaatttttgtcaagacgatgagtaaaggagataaaaacaactatattggaaaacagaaatgatcagaaagacatggcgcataggagggttaagaaatgaaaaatttaactgagtaaatagaatagatggggaaactttaaaaatgagaagtttggtaatgagtcattttgaaaagatattttaaaaaatatatagggtttattttacacacacacacacacacacacacacacacacgcatgcacacacacataccagtttttgttccggtctttcacttaatgttatgtcataaatgttacgtttctataggttggcacaaaagtaattgaaaccacagttacttttgcaccaacataatagcttatgtttataattgttattttttaatgagtacagtattctgttatgtctctgcgctataatttaccagacccttcagtttctgttagagctctacatttttcccagtgttctacttatgtacctgatgctatggtaaagctcttcctttgtttctattgaatactttttttttcatttttttgagacggagtctcactctgttgcccagcctggagtgcggtggtgcgatttcggctcactgcaacctccacctcccaggttcaagcatttctcctacctcagcttcccaagtggctgggattacaggcctgtgccaccacgcctggctaatttttttttttgtacatttagtagagacagggtttcaccgtgttggccaggctggtctcaaactcctgacctcaagtgatccacccacctcggcctcccaaagtgctggaattacaggcatgagccaccgtacctggccacttatctttattattctgatatgtaggcattgccctctgaatgaattgtactgatttaaaatgcctacctatcagaatcattgcttattgccagtgttatttaatgacgctgaaacttagtcaagagagacacccatttgattctggtaactgataccatagaaatcaggaaaagattcaaacttagaagggactaccagtcaagaccaaattcctttagtagcatcatactatgtggtatttatttatctggtccaactgggcgttctcagggtggggttaatgagtatattacatagatttggccttgctgtgctgaagacatgccagtcttgtcaccagcttcatactcaacccctcagattctgttatcaaggacgcttgtaatcaaattgaagcttaagtggtagaggaaattttcattttggggatgttccttgtctttcacttcatttttccttgtggggttcagtgttgtaagcgatttctattatccccctacattttattatttgatttttatttgtgtcagtcatttatactgctgacagttgaaagaataaaaacagaatgaagcatccttattttgtttccctgcccatttaacttcagagtttggtttagtgtctagttgtagcagtggatattttgctaattaaaaaaaagaatttcctttgcattagactctcagagaggataatcttttgtttcttaagcttgtaagttaaatgtaagcacaaatgtttaattcttttttgaacttgaatttttgtagacatccatgagaactccaatatttggaactaacctaatgttcttattttttttttccttaaaaaaatacagcagtttactttttataagaatttaaagtgattgactaaaaggaatgtattctttctctctctttttcttctatctttaatacaatgtttcctaacccttttcttcagcacacatagcaaatgatagtatttctgtggcatgccaggataaagagatgatgccgccatgggtttcagccaccctgcgtctcactgtgggctagggattaatgcctagtgtacaactaccccgtgggtgagggagagaacacaccaaataggaagcttagcttttattatatgaatacaccgttgaacagttgaataggtgggacatacatggacaaataggctcatggtgcttctgtggtagaaaggacagcaagagcatttgaagcgcccctgttttggggcaggtaaggcaatgattgagtcagtcgaaaaagaaattaagtgacttaatctcatgatcctaatgaatggtaaagccagttttctgaattcagatataatgctttcttctgcttttttttgctgttctccaaatctcagaaggcactgaagccagattaaaagttaaatgaacaggtgacatattaaagttacaggtttatgagtttccccactccactgttttcatgtagctccagaaccttagaggataatggaagacagattcagtccaatgctgtttttcagagtagaatctatcatgtttttaaagttaaaaattatcagtgtacatattaaatacaagtttttcagatttagaatttgttcttctgaaaataagagtcctgaatgtctcctggacagaaaaccctggttctgggggttttaggatccagaagacagcatgcccagatgggcttgggttagttcacttgatttgcacgtgaaagatgtgagggtacaggaactgtgtgggttggggtggtcagaaaagagggaacagatatggctatagcaagagagaatttttgcaggttgttttttaggactagatctaaacattttaaaatcagcatttcaactaggattcctggataatgggaaagtccagtgttcggaacagcatgtatagcatgtgacctcttttctaaaagggggaggaatacttatatttgtttggttttgcataaagaaacactagaagactacacaacaaactaatgaaagtgattgcatgttggagatgagaaaacaggttggatgggaacaaaggaggaagtgggccaactcagtatacatcttttatgtcatttgattttgaaccatgtaaatatatcaatctactttaaacaaacaaacaaaaaaaaaagagagcaagtactgtttaaaccttactctttataaagttttggaaatcatctcatcagtgttaatcgtcatcataaattggttaataaagtttggtggtgtagacagtaaggaagacaaatatattaatgaaactttgtaatttagagggtattggaattattagaaaaactactaagtaagtgtttatgtttctggtcaaattgagagaaaaaacatcaaactagtggaacaatatcctaagttggaagtgaagtatcttactgtaagtcaatgatggctttgtattttttaaaatcttcataattgctgttggaaagttgacattatatttcattttataacttaaatgtgacattcgatgaatgtaatgttgccacaaaatctttttctactaaacctcattactgtgtgtattttattatagccttttttgtgggaatatttatgaactttagaataccctgaaagctaaatggttcattctgtttcaggtggtgagtttttttttttggaactttctagagaaaatgtgagaacatgaaacagttcttcagtatcttttccatttttgaaagagcttcggccggacacagtggctcacacctgtaatcccagcactttgggaggccaaggcaggtggatcacctgaagtcaggaagaccagcctggccacatggtgaaacctggcctttactaaaaatataaaaattagccaggcgcagtagcatgtgcctgtaatcccagctactcgggaggctgaggcagcagaattgcttgaacgtgggaggcggaggttgctgtgagccgatatcgcgccactgcactccagcctgggtgacaaagcgagactccatctcaaaaaaaaaaaaaaaaaaagcgcttaaactgggtgtggtgcatgaggcagaccatcttttggatgaatggaacatttgttttaggggaatgtatctttgtccaagatactgtgacatcaagtccttgaaatgtgtatgactccttgagatccatgtacctagcagtcagtcttccttgtttcattgtgggaggtcagctcagccattggctttatgactctggaaaggtgcctggcacatggaattttaaattaatctcccagagtttcagtttcctcattgaaaaaaatggaataatagctttttttgtttgtttgtccctctaacttccctggatgagtctacaaagcaaattagatgatcatatattgtgaatgctttgtaaatagaacgtaaacttattgttgcttggtttcatctcttgttaaggattttgcatatattagtaagttatttttattattttctcttaagctctcttcattttatctttctttagttctagtggagagcagtgaaactcttagccttgttttttccagaactgtgttgatgtttgtgcgacaaaaaccttattgataagtaggcaggagagcgtattcttaactctggtaaaatcaatagcatttgatttttctgctaccactattgaagcagcacaatgtggcaaaacaagatgagttttgcattcccattcctgtttttctacttactttaatttctctcagcctttgtcaagtggggagaaaacttagggtgcttctgtgaattaaagctaatgtgaaggctggatgtggtggctcacacctgtaatcccagcactttgagaagccaagcaaggcgggaggatcacttgagcctgggagtttgaaaccagcctgggcaacatagggagatgccatctctacaaaatatttaaaaattagccagacatggtggtatgcacctataactactcaggagatgtggtgggaggattccttgagcacaggaggttgaggctgcagtagctgtgattgtaccactgcactccagcctgagtgacagagcaacaccctgtctcaaaaaaaaaaaaaaaaaaaaaattaaaaaagctaatgtgtacaaagtaattatcactgtggcctgtagaggtagttgctcagaacatgataattttcgtcattgtcataattgaatgagttttttggaacctggaactttactattctaatacgttagccaactgctaaaatatttggcatataagctattgtttgtcttacagattactaaaaataggggtttgagggaagattcatggtagctgacagaatttatttaagtaccattgtctggtaggcatgttgtcctgcattgatcctccagtgatctacccttgaagagttattgttttaaattggatatactcaaccacgttcaaattagtgccacaattaagggaagaaatatgggcaggtaactactagatgctagaaaaattccacttgtaggtaatccttaatcctcaggatttttatagcagatgtttgcgttttttcctaccccgcagtaccctgtgtacctgccatgctggttctgatgaatttacaccctggtgtcatagaaacagtggaaatcaaagattaaaatagagcacatagtaatcaggttttctcgggcaaattggagcatggtgctgaggcaattattcagataattcagacccaaatctgttttatgaaaatggaactgacatttgttgaacatttactgcgtaccaagctctatgctaaatatttaatgtgttatattgaataagcttttaaaaagccctaaggaatacatgtatcattatcctgattttatatgtgaggatattgacacagaggaaagttaagtaactggcccaaaattacacagtaagtaacagaaatgggacctcaacttaactttgtctgacaccgaaatctgagggttttttctctaactaacattaccagtcatacatttgccgtaggtatttgacatcttacttttcagcttcagtagtaaattctttactagtagaatgaaataagatgctacaaaaggaatatgcgaagatagtgttttactttgctgaagaagctgtgctactttccgtcagagaatgacaagagtgagatattacagaaaaaccagcttggccaaggtgtgcatgtgtgtgtgcatgcacacacacagaattagcttacatttctgcaactttgacctgaaaataaggctaaaagctgactaaaaggtgtgaaaaataaattgcaggtgttctaaataagcctattaatatcttcctggaccaaggttgggaattccatcgaattcaagattcgattttgaatctttgccagtgagtctttctcacgtgtaatctatatattaatatccactgtagcctggaccagtagggacatcagagagggccatttgaatgcccttccataggggagctgtaacgttcatgtaccaaaccttacattcatccagcttcttgaagcgtggtcttccagaatgtttcaagaccaaatagtagacaagctgaaaaagttcctcgttctagactttaaagctgcagttgtgtaggcttgtatatgctctgaccccagaaatatcagaatgagtaattaattttctcctttggaagattttttaaatgtcttgaaagaatgttaaaggaatttttgatcctcaaggcatattaaaatgactaagacttcaaaaatattaattgcttttatccccagggaagcgatctgagtgataattttagtaacactgactgctatacctaagtgtctttttgtaaaatcctatttgtgaaactatgtttaattttaggaatgtggtttttgagcagatatggtaataagcacattacttgaaaaaggaatgagcagttctgtctggtattttaattgtattagcatcaactgtgtttttcagtggtgactagaattggaacagcagatatagcagataatcctgaaacttcattttagataaaattctgaacctcccaaattttgtatcagtccatttagtgatttggttatcattcaggtgagtgcctgaggtggggcagaaggaaagataatgggaattgaagacaccagggagctgtgcagcctggctgggcagtgacattgaagtcacagaggaagaggagattgcaggcaacttctgagatgtgttttttgttaaccacctctaacatctgttttcactgaggtagcatagcaaaaacctcttagatttatgtcattagtgtactgcaaatgttttcctttaacaaatcagtgatttgtgctggtgatttgaaagcccctaggtaaattgatcacagactctactaggttagttgacaggcttggccatcctcctttcttagctagaatagtagagatgctttgtaaccttcctgtttaaaaaaaaaattgtgtgtgttgtggagcacaggggggtgttggcaagaagcttactttactctttctccaactctgtgacccctgccaggccccagaactacgtgatcctccgcagctcccatttccctagctcgtgggttttcagtaggagcagtatcacccccaaagggtggaattttgtttttcgtgggggtgggaagtgggtaaaaaggttactgtgtgtatgcataaaacacagatatatatatatatatatatattttatatatatatgctttatacatgtgcgtgtatgtgtatctcaacacatgaacaaacagacatcatatttgtggtattaaaatttcatgggattgggggaaaagtgtaaaaaggctgcttaggaagatgatagttttaaaagcttgagaaacagtaccttaagcacatcaggtaaagaagaatggatgacactggagtagagagaagggaatgaaaaggttgggttaaaacagcttcagctttgtttaaattggagtagttctctccaaggtaaggagtagcaggagctggggtcttgtgaatagaagggtttagaacaacttctgttgaagtaggggtggcagggaatctcagcctccctggctagtggaaaatactaaagatggtaaaatctgcctcagtgtttttcagcgcctttggcctttgctcctcctctcctaatggaaactacatttggctctctctttccttgcccacccccactctccctccttcctcttactggtaaccactggtttgctttctgtcactatagactcatttgtttttttctagaattttatataaatgggacgatacagtcttcttgttgtctgtcaatactgatgtacatatccttttagttccagttcagacatcataagagatcttttagaagaagaggaagcctgggaagcatcacataagtgagttctcataatcatgaaataagcatgcactttgacctgagaaattatacttctatgcagctgattttcaaacaaaattatatttttgctttctggtttaaagaagtagtaatcctcatgcaaggtaaagattttcagtttactacttgtttctatatatttctgctaagaaatggaatcctatgtaataactgtagttatgtatcagatgttatttctgtatggataaattgttcttatgggcaattaatacagtcatgcatcacttaacaatggggatacgtcctgagaaatgtgatttcattgttgtgggaacatcagagtatacttacctagatggtatagcccaccacacagctgggctctagggtatagcatattgctgctaggctacaaacctgtacagcattttacagttaggcatttgtaacacaatggtacctgttagtgtatctaaacctggaaaaggtacagtaaaaacatggtattataatcttacgtaattgccataatgcagctagagcgatcttttcaaaatgcaaatctgatcactgttactcatccctctgctctaaaaatcttgaatggcttcttgttccttttaggttcaagaagggactctttaatatgcgtaaaaggtcctaaatgattggatctctttctccagactcatctcttattatttacttcatattctctctgcttcatcatatagatgtcttaggtcctcctgcatgaaaagctctctcccaccacagagcctttgaacttgtccctctacccagaatgttctttattttttcatctagtttacacccctactcagcagctcaagttcttcctggatccagtcctcctacagtaggcgcttacagcactgtgtccatctctttccagcacatttatatgattatttgtttgtccatcactcccactggcttataagttaggcattttaaccccactgtcaacatgagcctaactcatagtaaatacatgtgtgatctcatttaaatataacattatgatgttctattatccctgttttacagtgaggaaactgaggctcaaaggggtaagtctccagcccaaggtcatatagcaataagtaataagtgatggagatgagattctaacctaattgtcaaaagtcagcaccctcaaccattaaactctactatctttccaaaggtggagaggcttgctgtgcagttgacattttgtagtttcatagctgaatcactgggagagtggaaaagtatggtgtatccagggcacacatggttttattatgagatatttggtggttcaagcagtagcattttatgtaagtttgagattttggctgcattactgtctctcacctaagcattatttaactttgagttctggaagaggaggagactccttagctaactactttcctcttgtacctcttcatactgaactaaccctgacaccagtgactatgagcccagagttcctgagcccaagcctgctcttgataatgataacttcttaaagtgattactaccagaaagcacttagaaaacaaatcctatcatttcagtttttaaagcgagaaagatacaagagctcatctagcccaacccatttgttttatagagaaggaagctcggctccagagaggtaaactgacccttggtcaaggtccgaggactagttagtgatacctccaggatcagaatccaggcctcctgatttcagcagaatatagaatagtttaaacagccgcagttccttctaaggaagaacttctgctgtgatgtagttttaaaagcagaatcaggaaaagcctccagagctttacttttcaacaaaatgttgcagttctacaaatacccatcttaagcttataggcatttttttgtagtaccacaagtggcatatttgagatgttagtcttagaacataccatatcagttccgacacattctcttaattccacaaatgatttagaggtttcgttagcaacacatggctccatataaagcagggtttttgtaagcagcaggaaacttattttctgcagactggtcttggggtcttctatctacattttgtattcttttatgagatgattagtcagtgtggccacgagacacaggagaggctcaggaaaacttgtttcattatactcacaggtcctagagacagggcatggcacaccgtgcaggtccacaagggaaagacgctagcgtggtcaggaggcagaagacaggaacaagggaagtgctttaggctagaaccctgattggggttttctcaggaaaggcaaggcagggtggggtgaacagtgcaggactggctagtttgaataatttcagtggctccaagctataggagtggtccctagttacctagaacctggccctggcatgattaaggcagagggctattgccttttagggtgttggggccagatagaggagttgtgactctggattggttagtttgcatgtcacaggcatactcctggctgggcccgttgctgtctctgagaattgaccagcctctccttatgccagcaggggcaatctctccccagctagaaaggctatatattatgatgtcaaagcatcataatatataggaaacacacccacacaatttttacttagcctgtctgatggttccctgaagactctacttgcaagacttttactttacttgacttggagcttgctcaattcaaaaagccttttctctaagggtgtttgttgaaagtaatgagaggcatttgactagctttgcagctgtctgaggtggcggataacagttggggcaaatgatacgccaaccaaaaagcaacaacaacaagctacaagatatatttacattgaacagaatgaaaatagaaaatggtcctggtgttacttcacattttggggtctcagtttctttacacataaatgtgagtaaaatatatatgcttcagtgagtctaagccctttgctccagatctgcgtctcctccagtgtcccctcttctcagtgaatggtaggatcatagtcctccccactgttcaagccagaacctagcaattattttaaacttctcactctcccttaccactcacctgcagtcacttgcaaagtcctataaataagtggttcacagacttaaaatcacctggaggacttgttagactacagattagtgaactccacccctagagattctgattcagtagatttaggaaggggcttaatgattggcattttaacaagctcctaggtatagctggggcagcttctgtactgtctcaatccctttgtgccactgcttactcctgcaggccctttactttccagcttgcagcaaccactgtctagctgtctctctgccttggtctgttaccagttcattttgccagtgaaacgtaacatacaggtattttcccccttagactttaaagtagctctccaccatccaaggcttttcgtgttctggccccagcctacctggctggctcatggaattttattccctcacttccctaccccacaactgtggctttggccaagctgccaagctgcaccactcacagttgcctcatgagttacaccgccttgcctctggcctttgcacacgccgctgcttctgtccaaattgccctttcccctttattcatctagatagcagttgacattcctttcttcatactctgttcagaagcccctgattttgctccagcagcactctcaccctttctagtgagtaagtacactggattttaaatccctagcacctagcactgtgcctgggcagcccagcataggcactcaataaatatgtgaatgaatgaatgtgtctgtctgtcagtcagtcagtcagtgtttatgggatctgagtgtattcactagtagattctatgttcttacttggcttcaagaacctgtgaatgaataaggatcaccactgtaaactaaaaacaaaattttaagccatcagctgactgaagagactcccctattggccaaggggacccatagaaaccttaaaaacagtccctggccatgacagcacaggaggtcagacatgcctcattatacctcctcccttttgcagtgtagacataacaactggccaacattaatgttagaatagagatcataggactgacagaacagatttttttgtggcaataaaataccaaattatagacaagacctaaggccttgccaggcaagggttaagtaaatcaccccacacttaaagagtaattatgttctaattgccacaaggtttttctttttctctagcagctaaacaagcactggccttgagataaacaatgttaaaacaattgtagcacatctatacaactgccagatgctgactaactgacccacccttttccacaagctataactacagcattggtttgacaagagactgatttcaataactttctcctgataagagaccactgaccatggactggttctggctagttttatagtggctgagcagttgggtgcctttatgtcctagaaagaccttttgacatgtaaggcctaactgtaatatatttaaatgttaagtctccaccccagaatgaacatgggttgtgtgaaacatgcatgcatgcattaggacatgcattaggatccccctttatgaataatcatagctcctcctgtaacctgttgaatatgtatgtttggtccacacattcaccctaaatcccttttccctcttccctcccttacagtgcctgtcttttgggctctgccagagttaacacttctcagccttgtcagagtggtcacctttctggctgtaatcatttataagaaataaaggctcctttccaaagttgtaaatttgatttttaagctaacaccacttaaaaatcttgctaactctttgtctctatctcatagtgcctttaaaagaaaattttagaaaataactttctctaatcttataaaatcggaaaaggaagaatcattttctctattaatagtctacatttcatcttaaacccataagaagttgtttgcatgcacttatgagcctgtcatgtttgttaaatgatacaattactgtaattgaaagtacttgcagcaagaaaacagtgaatcccatctttaaaaaaatgaataaaaggaaactcaggcctgtttacagtggtccttgatctgaccactgtctctttaatcaacatgaggcaaggagagccacacaccaagagattctttctatgggcctaccaagaaggaaagtaggtcatcctggaaataatgtgtattggaagcaggctgatgatgaatggccagatctcctaaggcatgtttttgcattcagtagattcaacactttaacagtagatagatgcctcactgtggccctccccaggaatatcctcccatctggctaacatgctattgtcaaattttactaaaagaaattcattagtaatacctgctggagaccaagaatttaaaaacctgctgtacctgtgagatcttatgaagtgttattccagtaagtcaatgtgttacatgcatggaaaaaaatgtgggctgggttattctattaggattcttgcatcttaggggatgaggtgttttagagaattgttctgggagaaccgctgagatccttgccaggaactcccctgctaaggaagtggaagaagtatagatgacttcttgcactacctcaatagctgtgtctgttgccagctatcataaaggcaaatcaaagaggggaaacatggaaagaaaaattactgaaaattgttaaaggattattaaaaacaaggtatgagaatagagagtgataaaatagaagttaaaagtaaggaggaacatcccactaaaacttaagccttaaaaagagtcagaagtcaaataagtaaagatgataaaacattaagataaaaaatttgacatggtgaaagttgagagattttaagaacataaactaaaacatgaaaaaaaagtaaaaatgataagagtgatagcaaaaatggtggaaattctctgctccataaaagcaataacaaaactgcaaaaattgtcagaatcaacttttaggaaaactctgaaaattaaccaaaagcagcagcaatttaggtaggggtcatttattcaagaaaaatgtctgaatctcagtgagaacagtgagctttgtggtgattcgactggctttgttctcatccttctctctccagttcctctatggccttgggagccaacagtctgcagtcatggtgaggaccagcaggctgacagtccccagagaaggcagagcggggttggagcccctttaaagccacattcccagagaatttttacttagcctgtctaatggttccctggaagactctacttgcaagactatctttactttatttttacttagcctgtctaatggttccctggaagactctacttgcaagactatctttactttacctgacttggagcttgctgaattcaaaaagccttttatctaagggtgtttgttgaaagcaattagaggcatttgactagctttgcagctgtctgaggtggtagataacagttggggtaaatgatatgctaaccaaaaagcctaatggtaaaagctgaagaataagatttccatgggggttttgaacagctataaaatattcctgggaatctagagggtcactctcattcatagagcttccgtgcatgcttaggaaagacctaaggaagcgctaaactttcacctctggttaaccatgaggctgtgtgcaagcaggaagtaaaggctaaggcagagttgtccactgagtgttgagtgaatgttgattgcatgccccagcacagacacagaacccaccagcaaagactggttttgctgagtttctgtatgatattggttccagatgtctaaggaactgttcaatcattagtggactacaaagctaatcaagcagacacttttagttgccatatacaacaaagaatacatatttataggattggtttagaaaagtcactaaacaataatagcaaacagcaacaacaacaaatcctggagagatcttgtttgttggttgtttatttttggtatttctcatgactggggttctttgaccaactttgatcttgatttgaagtgtttcaacgtttttagaaaatccacagccatatatatttacatatttattatccatagttctttctctcctttcttccaggtattacagttatacacatgttatgccatttttattgtcccacagctcttggctgctctattctatgtgcaccccctcacatactcctttttctctttgtatcttaatctggtttttattgacataccttcaagttcactaagtctttttatcaactttgtgtattgcacttaaagcctattgaaggaatttccatctcgaaatgggtttttcccttgcttcattgtgtatcatactttttgaatgcgggccatgcagtgaaggaccatagggactgaggtcgatagtgtttgtgcctagaaatgcacatccttctactgggtcattagtgtggggagttgagctgggtaattcagagttgacctggattggagtttcctagtgactaatgtgaccttcagtgcatccacttcaagttactctagcaggtggctgctttgacttctgcttagtgttggggctggattgccagagggtttttctcattgattttgctcccattttcctttcagccatgcttgctttcctgcaccaaataggggcatatcttcaccatgtctgtgtctctccctcagccatttcctgctcctgcttattgcttgttgctaggctgatggtgggaaacagccggggttcactgttatctcagtctagcctgagtcttaggtaggccctgtgtgcctgagtctcaggggtgggcctttctcagcacttccacctcctcccatggtatctggctacttgaccaaacctctgcgtggtgtcagtgtaaggtcatcagctggagatgatttactgcccctcctgtaaggtagaggttttagtttctaccattccccctgcagcagtgaatctttgcctgcgttcctgcaaatgaggtcatatgcctccccttgaggcagactgatttcacctctgttccttccccagaggccataggtctttgctagagccccagggggagtttcctgtgtttccctcagcaactgaaaagcttatgcttcatgggagagaagcattcaggagagcaggcaggacttgacttcttcctgtcccccgtagccactgaagtggcccctctccattcacctgtcctgctcccagtctttcttgtgagcacctgacggaggctcgtggaaaagagctggcaagtgtgtgcagactctccttgtgtcaggggcctgcaatactagcctgtatttaagaaattaggaaaatcttagctgattcttcttacctgtttgtatggcagccacctcgttctccaacactctgccaaaagtgagagaagtgtggcccatctttggaggggcatatttttctttggaattttactttcttagttcctttaaaacctcaggtctctgaaggatcaaacagagttaagattttgttagactgtctggctttttcttgttaggatgggagcagctttttgtttgccgttttttcccagccctctacatgctaaacagaagcataaaactcctaaattttaattcagaaaaaggggttcagagctcatttactatctgtgatctttgctaactcactaattcataaagtggaaatactaataataacaattatgaattcatcaacagaatagaggattatttcgaggttttaatgaaataatatgtgtgaaaacacttgtaaactagaaactgctgtacaataatcattactttccaagatgtcatttcctttttctgtcttcagaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccaacccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgagggagcggtgagacccaagattgggaaagtaggcacatgagttcattcagcaaatatttggttatctatgtctgtcactgtgctgacactgggaatacaaaggtggccaaagatcatctagaacaatggttcccagtggggtgggcagaaagattttgccccccaggagacagctggcaatgtgtggagacacttttggaggtggagggtggtgaggggtactaccagtatcaatgggtggaggccagggatgaggctaaacacccaaccctcatggattagtttgccagggctgccgtcacaagatactgcagacggggaagcttacacaacagaaatgtgtattctcagaattctggaggctggaagtccaagatcagtagggtttcttcttcggcctctctccttggcttccactcatggtgtccttgcatggtcttttctctgtgtgcacatgactgtgcaggactggtgtcccgatttcttgtagggacagcagtcattggatcagggcccatgcgtatggcctcattttacttcagttacctcttttttagatagagggccctatctctaaatactgtcacattctgagataccggcagttaagacttccaacatatttagtggtaggggttaaggggcacgctttagactacaacactccacagtaaagaattatccagtctaacatgtcagttgtgccaagactgagaaacctgtaatgtaaaggaactcccaagtctacctgaaaagtaaggtctaaagagcatttattgagcactatctgttagcacttagcatatgtttaatattcatacattgaaagaaatgtatgttcatatccatctgacaaagattaaggaacttagagtaagtaatagatccaaaattgaaactgataaacttctggttctaaaattcaccttttagtgaaaatacagtttctcaccaaacttacagtaattcagagttattaactctttctacctcctcactcccctcaaagttataacatctcccatcaacatcagctcagaatggcagtgatgcttatggtttgtgggggtgcaggtgagctgctggatgcactttagatggcctagtatgccaggccgtcctttcatcctctactctcgtctttctttttcgacctcatgttgaggattactggtctagttgaaaaaagaattcatacacataagaccatgtatataatagagggaggtatgcctttaaaaacaaaattacatggtaaagactgatgtgtcaacagggatagacaacatagagaaggctagaactgtttctggaaaaaaacccaaaaacaatggatttcaaacttcttagcatccgataaaagaaagtagcaattattcaaatgagaaacacttctgtctgttatgtacatattatgaaagtatgaacataagagggaaaaccacaaccattacattttttaccatttcagtaatttttttttggtttttagtctgtttttagacatccttaagaacaactatctgaggctgtaaacaagtatttacattaacacccatgatactgactttatactccctacctgcattgagaccttaaagggggcatttctccattccttctgtgtatttctgggtatccccaggttcagatattcagaatacagatacaagtccatgcttgcatatgttgctgctccccccgacagacttctaccagcatctgccctcctcaccgctgctctgtcacgtgcactgcggctggccctgctggaaagtcctaccttgcctaggacgccatccccgatatagccccaagatgcaaacctgccaagtgctagggcagccctgccttcctgtccatttcagtctcttggccttgctgtgttccaagtggaaatgggagtgtgctttcctggtttgctagtgtactatcacccggaccacagcgtcctgtgcaaaaatttgcttcctctctcttcccctttcactctttctcttttctcttccccacccccttttttttctctttccccttacctttctttcctttccactcttcctgtccttccttccttcaactattaggactatatgtcaagtaatgtgcaaaacaaagacagttcctgccctgatggagcttgtagatcagaagggaagatgagcattaagtaattatatagattaatgtacaactgtgatgagtgcaacaaaagagaggttcatggcactatcaaacatgcaatggacggattttgtttttgcctataaactcttgccatagaaagcttgaaaatcagtccagggggacagcattaatcaccatgttctttccttatccctgtcttccccaaaattcatgtgttgaaacttaacaagaggtgggaactttaggatgtgattaagtcgtgagggcacagctcttatagatggggtcacggtccttctaaaagggcttgagggagtggttttgtttccttccatcccttccgccacatgaggacacagtcttcgttccctctggaggactcagcaacaacacaccatcttggaagcagagagcagtcctcaccagacacggaatctgccagtgccttgatcttggacttaccagcctccatacctgtgagaaataaatttctattgtctataagttacccagactgtggtattttcttctggcagcacaaatggacacccagaaactgatgcatgcatcttctgactcctttgattccaaaatacaaaatattagaataaagttatggaagtcagcttatgctagtaagtgcctgtgtgtctgccaacttcccaatagtatcaagagaagctggacaagtcagaatttcatatcacctatccaggatcacctccataaacacacaaacacacacacacacactcacacacacacacatacacatacacacacacagtgctttcatttgtcacagaaagattccacagtgcattaacaatactatttaatgattgtataacaatccatctggatcgtgtgccattttgcacagacattctacgcttggacacttacgttacttccagctttttccaattacaaataatttagaaggcatcatggtgcatatagttttttccatatatatgattacttccttagattacattctcggaaatggaattattgggaccttagcttttaataaaatatatggccaggttttcaaaacgggacaccaaagtattctaaaggaatttttttctctgggtcttaatgggttttaagaatcacattggagttcatcagtgtcaatgtcacagcaaatgcaaggctttcatttctgttaactatcaaagctgagagtccaaaattgaaagggactaaaacaaaacaattctatggagttacaagcaaacaaagaccaacaatacttttcatgttctaatgtaatagaaagttagataggttctaattatccctagtttcaaattagagatatacaataggttgcgtatccttaatttgaaaatctgaaattggaaatactctgaaattggaaactttttgagtgctgatatgacactcaaaccctcactggagcattttggatttcagattttttggattagggatgcttaactggtaagtatgatgcaaatattccaaaatgcaaaatctgaaacacttctggtcccaagcattttagataagggatactcaacttgtatttaagatctctgaggagaatggctaagaaatacttttatagtgtttcacacccagtctttggatagcagctggatacattttctggcaagattctagagctgctcttactctagtgctttccaaagaagccagctggcttggtgtcaaatgaatagacagcaaggctgacatgctattgtaaatgtcttttcttgaatggggttcaggtaggcagcaagcagggagttttttttggtccccataatataactttggaattacaagcacacaattgaaaccccaggattccacatgatgtttatttccatttgggtcacataagaactgcatcacagtcttaaaagaattgtatcatatcttttatgtaatagctgattttgagcagccctgactctcatgcctaataagtcttcactgcaaaatgcactttctagggaacattattgaatgagctattttaatataactatttgaattttaaagagtatctactgaaaacattttggcaacataaatattgaatttctgaaagcatgacatctacatagaatcatttgttttctatttgcaatacgtggtattgtgttacttaggttaaaaacctaaagaagggggtggggctaagagaacctatggtggcacaatgtaaggcccaaatctgattgtcaagagactgaccttacccactttgtcacagttttgtagaaatacaggcttcatggaagcatatttgtctaaatgtatttggggaccattgctgatttctatccagaaagggaaaatagttgaacaaatgctaaaagtcataacctggtcaggggctggtttttgttttttttctagcaaagtaaaagaatatcgtagtgatgaactgtgggatagttctgttttaaaccagctaagctcgtccttcatgcaagatatagtcagagatccagacttctgtttgttaagttgtgatgggcaaaagtacttactaaagggtgctctttagtaagaatggaatggaacccagaagaaaggggtggtatacaaaaagcagtggtgagcaaatatgttggtaaacacactggcaagttttaagtaaatatagatttaggggtggagagtggagagtggttaaaacaaggtggaaataaaatagtagataatcatgtgggacatgggagatcagaatatcaaggcattctgaagctcttggtattagtattgtttgggaggcatcgacctactttgaactcttaagaatccattttaaggttttaaaggcaactcttagtgaacacctgtttccagaaaatgggtttcaggaaaacttggtaaagccacggaggcagaaaagattagaaaaacaaggaaaagcacagtgaatagaaaatatgaaataagatggtccaataaccccaactatatcaataatcactatccctataaatgattacactgaactcttaagagtagctagtattaattaagtgtgtagtacatgccagggctaagggcttagccagtgttaactcagtcattgcaacaaccctgttttacagataaggaaaccaggacaaaggttaagacatgttcccacaataatatgtgacagtttcttaggttggatttttaggaaacaatctagctttatgcagtttacaagaaacaatcatacagaaagcaaaaaggtaggaaaagataccagacaaagctaattaagtgtagcaatggttgtaagaaattcaccatgtgtatatttttttcattttgctctggattcgtggaaacttgttatgagaaattgggacttggattagcttttaagaagagatgcagtttgcattttagcagaagggagtacagagaatgccggagatataaaatgacggtcagggtgaggtgaggaacagtcattgctggagggcactaagggctgcccatataggaatgtggtgtgctgccaccttccccttctctttcctattttcctcttggtgtgctcctttcaccaaatgccgtccttcaactgaaggagccaaagctcctctaatatgcctttctctcgccccattttcaccaaaatctccactccgtaacaatgtaattacgtggatattcatttaatgaatactgtgttagaatgtaataataaagaatctacaagaaggaagcattccctgtccagagagctgcctctctgactaatccagttctaggagtgggtcactttccctccccctggcccttgcttcctcatgttgatataaaatagggcatttgaactagactctagactaccaagagctggagggaacctcatctatcatctagctcaatcccctcatttaacaagttggaaaacagattcagtgggcgcctaagacatagggtgtcttctggctataatgtttcaatctaaggctcaggtggaagttctggccaagactctcctgcgtcgggtggagggagtagtggccctctccgtgtgctctgcccacaaataagacctgcacttagagggtggcacagaaggcagcaggggaaacccactgctccagctgagcggacaggaaagcagcacttggatgtttctatgtggtgtctttgaatactcctgagactagagatccagggaaatcaaggcccagccgtctgctagctctggtgactctgctcactccctgggttgagggtccaggaacctagcggcagcctcacggaagacaggactgtgccctctcttgcttctaaggagagtccatccaggccttgggtttcagacaggaagtgttgagggcaactgaccagcttcaaactcctcaagccctcttaggtgaaaaaggataatccttgtaaggggtgagaaagaggggtttgtatctccaggcctctctatccaatggattctttaaccattcaccaccgaccccttccaaacccaggccacctgattgtccatcactttttttttaagaggcggtatctcactatgttgcccaggctgcagagcagtggcgattgacaggtgccatcacagtgtactgcagtctcgaactcctgggctctagtgatcctcctgcctcagcctcctaagtagctaggactgcaggcaggggccaccatgtgcagctctttgatcacctctaacagattctttccccatcacacctctgcactggcccccagtcatgctcttgccctcttgtaccaccactgaatccctgcctcaggtttcccgctctgacctcctattcatagctgtccccacaccaacaattctttgacccccctagtgaccttcattcctgtaaccttgctacttttcactgttcatcatcccgggctccacatacatgtccttacatccatattatccagttcagattccatggtccctcacaaccattcccttgcctctcccctccaccacttttgcctggtgctcttggttttcctgccacctgtctagttacccttgctcagtctcctctgctcaaacctcattctctgtttgacttctagccatgaatgagaagtgccccagagactagtctctggctgtcttctctagctatgtcttctccctagttggtatcatctggtcacgtggctttaaattctatctctaggctaatgattctcaaaagcattcctctctgtctttgacctctcactttcctgtaaagcctgcttcccacttcctagtcattcattctccctaatgctttactgctctgcaaaataattgtctacattcctcatcttcccctccactcttctatgaaaatgagtatttttttaaaaaagtattcctctcccctgagtttcagactgatttacctgacatgtccacttggcttagaggcaccccaacctaacatgtccaaaggagaactcctgagctccttccctaccccaagcctgcttttcccaaatcttcctatttcagtccatcacaccctcattcacatagttgctcaggccaaaaactaagtaatgagttgttgaacaaacatttggggtttaattaggaagtaactatttttatctcctcatagcccttcaaaatgtattcagagggttgtctaccccaggatggaaattcctgtggtcccatgacttttgtgatcactcttaggtaataataaacaacaacaacaacaacaaaaacctatagtccaaagttaaaatacctggtctcatgtagtgataaaagtctgaccttgatttatagttacgtcttctccctaccctagccggagcttgctgtaatctggcttcttgcagtggatgtggctggccagtggtcaggggcttgtgcacttctctccctaccctaccctacgtcatgctttcacctaccctccagcatctggcagttggttcagggagtggagagagagaggagaagcaggggagcagggaagctcttttctgaaaggtactatcataagatggctcacccactgggcccagcaggtagttaaagttggctctcatggttccagccccactgagcaaggtctgccacagagcttataactcacgcgggaattttcctccaagtggcagctcttttcttcaatctgtggttttctctggtcaattctacacagactctgaggatcccactgcttctccggccagtcttcctgatgatttacaatgaccttactgttttccacagaagctgtactatttacattcccatcaacagtgcacaagggttccaatttcttcacatcctcaccaacacttgttattttctgggttttatttatttatgtatttatttatttatttatttaatagtggccattctaatagtgtgaggtgatacctcattgtggttttgatttgcatttctctaatgattagcaatattaagcatcttttaatatgcttgttggccatttgtatatcttctttggagaaatatctcctcaagtcctttgcccattttttaatcgggttttcttttcatgttgttttagaactcatctttgatctcttgtctttacccaatacatcctaccatcaccaggattcttcttggtgcacccttcagaatgtatcgtctatctctccactccttaggccctccaccgctaccatgtttatttcagccaccatcatctttcagtgatgctgctgttctagcttgctaattggtttctctcataatccacatttatcccgccatagctgattcttccccaacagccatcttttagaaatgtagatcaggccgagcgcggtggctcacgcctgtagtcccagcactttgggaggccgaggcgggtggctcacaaggtcagaagatcgagaccatcctggctaacacggtgaaaccccgtctatactaaaaaatacaaaaaattagccaggcgtggtggcgggcccccttagtcccagctactcgggaggctgaggcgggagaatggcgtgaacccgggaggcggagcttgcagtgagccaagatcgcgccactgcactccagcctgggcgacagagcgagactccgtctcaaaaaagaaaagaaaagaaaagaaaagaaatgtagatcaaatattattctcctccttcaagtcctccaatgaccacccaatgtatttcaactcaaccaaatttcttactatgatgtaaatgtcctggatggcccgggcttcatccacctcgctggcctgtgcccttccactcttttgctgttttctgggctacagccacacagcccttcttacggttgctaaacatgctaggcttgctcctgtttcagggcttcactctcatgcttcctcggtgtggaatcgtcttctctgggatcctcccacggctggctgcttctcatcatttgagagctgcacaaatgtcaccttctcattaaagccttcctggacctctctttctaaaagacctcctcgctcctccacatcagtatctgttccagactctgttttcttttcttcataatatgcactgtccagagttatttatttgcctgcttgtttgttgcttttctttccctactggaatgtaagccctgtggcaggagggactctgccatgtttgctactgtctgccaggcctagaatagtgtctggtacacagtaggcattcaaaaactatttgtgaaaagaaaaaaccaaaagactaatggttgactgaatgtcttctctccctggaatgtgatgtctgtgagatcagggaccttgcttgggtggtgttcacctctgcattccagtgctctgaacaacatctgagcgtattaggtgagcagcaaatcagtgtggaatgaatcatctctgagcaaagagatctgatcaagtgagtcagggacccattgaagcaatctcttcctttcttcagtttctgctcttctcagctgtccctgaaatgcttggctcaaccggatgaaactaacaccaactgttttatttatgtgaactactcacttttttctccaattcctatgactcaatgtatgcatgtgtcttcactgaagtgtacaataatctttattttaggcttattggacacaacactaaatgctttgtctggatgaaatttgttacttttctagtgtggacatgctctcccaactaacaaattgttacagggaccatcaataaggacctaaactatgggaataattttctgttttcatttaatacttatcttttgtcttatttcttagggcctaaacttaattttgctttggacctttgctttgaacctctgtgtcagatgcacaacatctttaaatcttcatttgaagatgactaagagactcagtaattaaaagctatcactccatcttcctgtgtaccttcaagggttttattaatagctttcctttctgttgaacagattatcctgcatctctgtgtcttattgaaatgctcagcactcacatcccttttctcgggagtttttacaacaagaagagcagaggtttttgttacggatacaaagctctgcttttgtgagcatgttgattcattctcatcagggaacagatgaggggttgtgtgaaggattggggcaaattgttatcacgaaaaaaaaaagaagcctgaaatattgttttacctttcttgacctaaagttcaagatgtcataaaatcaaccttaaagcttacctagtccaatgttattattatatagatgaggacacttagttcagggaggaaaaggggttctcccaaggccacacaattgaaacacaaaagtcagagtcaaactgaattccatctggatttgtgaagggctgattaccaaagtacagttaaaactgttaatggctcaccgtgggatcttgagtgagtcctctcacctttccatttatgtttttaaatctgtaaaatgggcctatctggagaaaagtccagatgcgtattatagttatcaccagattatttttattaggtgttcaattgcattttggctgttttacagcaactgcaataatatcatcataatacctttactttgtttatttacattataaaatattttatttttaagcagtatattatcatggtttattattcataaggcacaaaagaatatacagcaaaaagtcttcctgccgccacaactttccagccattgagttcttggaggcaaccagtttctaccaattcttagtgaagctttctagagatgtcttatgcacatgcaagaaaatatgcagtcctctttttttttttttttttacagaaatggtagcatactagatacattgttctgtactttgcttttctcttttaacattatatctttttatatattattgtttcctttttgtttttaaggctgaataggattgttctgtatggttgcacattgtttgaaccagtttcctactgagatatttttagatttccaatctttttctattataaatatagctaaaatatacatatgtatatatatgtatgcacattgtgtgtgtgtgtgtgtgtgtgtgtgtgtgtgtctttctgtgtgtgtgaatctgtaagacaaattcttaaaagtgaacttagtgggccaaagattttgatagcgtggccactttaatgccttggatttagatactgctttcaactttccctttttgaatgattattccataggctctgtccttttgaatcagaggcttaggatctgagataacaaaaacaggtctgaatatgtatctgcagaataaaaacaagggacagagagttccaagatccacaacttggaaggctcttcagaagagaataggttttaaggtgcttggaagcctttgggcagctcatgctgtcactgaaggcagtcgttgcttctggaacgcccacttcctgagcctctagaggactggcaactgcagaggatgccctgcagacccaagctggactgtaaaacccttgatctgggttgtctataaatgccaagggagggtataataaaattagtacaaaagcagtaaatatttgttgcatgaacgagtctattcttaggtaccttcctcttagaatcttggaacatcagggctagaagagtccgtggagaccctctagtctaccatttgagagggtgggagtggtgcagctcttacatctagtattggaactattgaactttgcccctaccactctatttatgtggaattgtgtatttggttgtgagtgccacattttaggggggaatgtagttgaaaaggatcctgtccagcatgtggggaataaatgaaagacccatatgtgttaggcttgggaggggagagggaactttagaaaggatatatacgtggcacttgtcttcatagcctcacagtgaagaaaatattctaagcacttcaagaactataactagagccagtggatggaagctataggggtacggattcagcttagtatggaaaatctttctagtaatcaaaaccacgtgaactcctggtgacgtggccacatcccagtggtagcagtgtttaggcagaggcctcatggccaccgtggagagatgaagttcaggggaaggccacgctgggggagatcagaccacctatcatcagatcaccaccaattcatattctgtgcttggattaacatccaaatggagctttgctttagtgtacacctcctttattatactttatcaaatatatttcttcgtgttcttattacacatgctccttgacttatgatggggctatgacccaataaacccatggtaagttgaaactgcgtctaatacacctaacccctcaaatgttttagcttagcctagcctgcgttgaatgtgctcagaaccctgagcagtgccattttggcagaaggtaatcaggtacagggacattattgtcttcgttttctgtaactgctctaacaaattaccgcaagcttagcggcttaaagcaacacctatttattacgtagagctccatgagttatgagtccaacatgagtctcactgtgctaaaatcgaggtgtgggcagggctgcattccctctggaggctctaggggagaatctcatttccttgctttttctagctgctaggggctgctcatatccctaagctgtagctcttccttcatctgcacagccagcaacaactggctgagtcctcatatcacctctctctgacctcctcttctgcctctctcttccactttaaggatcttgtgatgaaaatggggccacccagataatctaggataaccttcctattccatctgcagccttaattcttctttgccgtgcaacctaatgtaatcataggttctgggaattagggtgtggcccccctttgggggtcatcattctgcccaccttagttatgcatttggtctgttatttccctgcccagacacagggatatgggagcatcatctgcacttggattgcacctcttagtggctcgcccttggctgtgatcatttaggaaactggacctgcctttttgacagaatttctagggtcatgttgggtttttcttaaccttggtcctctgttgcttctaggtttgccttatgaatgtatgtgctccgttttagcacccacttctttgaatatttgggttagcacagaacttcactggaccctgccctcaccagtcctgagggcatgtgctaccagtaagagggtggcacaagtgggctgtgctgtgtgagctcccattaatcaacacagaaaaaatgaaacagaactacacacacacacacacacacacacacatgcacacacatgcacacacgcacacacacacatgcgcacacacacacacacacgtgcacgcacacacatacacatgtacacacacatatacacacacaggcatttctgtatgatcattacacatacagaccataaaatcacagctaccaaaaaaattgtttatgtgttttgctggactctcctttcaacaccccctcctgccccaggtgtgggttttggggtactgtggtgcaaccccagacatggccattcttctaaatatttcaggctgggtgcggtggctcatgtctgtaatctcagcactttgggaggctgaggtgggcagatcacttgaggccaggaattcaagaccagcctggctaacatggtgaaaccccgtctgtactaaaaatgcaaaaattagccagtcgtggtggtgtgagcctgtaatctcagctactggggaggctgaggcaggagaactgcttgaacccgggaggcagaggttgcagtgagccaagattgctccactgcactccagcctgggtgacagccagactgtgtctcgaaaaataaaaataaattaaaaaaataaacatttctactctgacaaaataaagtctaaaatgtggacattgaaaattaaggccaaaacaaaagaaaagagacaaaggaaaatcagtaactaggcacttaaactgtgactgaagttttaggtttccctgtagctaaggcaaactgggagctgggtaggaatacctcgttctcactggctaactctccgctgaggtttcggttttaagtttccagttttctgtagacattacgtatgtagtatctcattctagttaaagccatgggatttgatggtcacaaatgagtggttctgtccctgggctctgtctttcaagcctgtcccctgtcacagaacagctaatattggaaagtgccccctgcgggaggaataggtgtgcccacattcttacctccaccctccggtcacacgctgcaggtcctgactctggcctcgctggtggtagcccctcctgaccctcctgtcagctgctcaccctcccaaggcaagggtttcatccctgaggtcccttttatgcccctcttttcggaaaggatgaacttgagttggagtgacatggcagtcatttggattcagtttccagtttcacttctccaatctcctaattgctgcttggttgtgggccggggcttttagaattgattgggcaacatggcgtggaattgcctccgtgtatgtgccatccactctgtggttcagggagctcctgtgagttccttaagggaactaattaccagctagcacttcttatcgttagcgttttctcccatctgccagccaaactcacttcttttacaccttagataatgtagtgtgttttaaaatccagcccagatgtcccactttctaaccatttcaaactgatgaggaagccaagtgtcacagccaggaatgggaaagtcaggactttttgggcagagccgcctccccctgccctccttcgtgaatacccccagccatcacccccagcccctctgccaccctctatatcagtcccagttcttccagaggtagatgccaagatggaattagactggccagagatttattgagagaacatctgtgtcggacaaaaaggagagggagcaggaaaaggtggggagagacttccaaccacttttgcacccctgtggagagagagggggaagggagagtcatacataggaggaccctcgggcggtggtgcagcaccgagacagccttggccagacggatggggagtctggcagttacaggggcccttcctttcctaggtgcaaattgcctgtccagcagctttatcttcagatgggctggcactgtcacttcacaccttattgcttctctgttatcaccaaccaaacccccacagaaggggaggccaaaaccatgtgggaacagatgctacatcctaacagcaagcctgttctatatgtgttttgctggactctcctttcaacaccctctcctgccccaggggtgggtttgggggtactatggtgcaaccccagatatggccattcttctaaatatttcaggccaggcatggtgcagtcattccccagtcctctcccatgggcctgtagctctgctcagccagggaactgacagtagaatagaaagagccctgggtgtggacagagtgagagcagggtttggactctagctctgccatttggtccagcacattcatccggggctcccacaggctgtgcccttttctaacactaggaattcaaggacagctcaagcacagccctggcccatgaggagctcagtctggaagggagaccagcagccttgcaacaaacacaaggagagcaatgtgatgaggacactgatggacacactacgtgttcttgctgtgtatgctcactatgatgtgagcacatcctggtatctcttgtctatgttaagtataagtggggcccctaaatcaagaaaaatgttttcagtgcctggcaccaaagcagagggaggcagctgcttcagaacaaaagggcacaccatcatgggggtcttccccccttagacttgcccttgaagcctgaagagacctaacatggtccccgtggacagcctcttgggagcctccactggcccctgtgcacaatcagaggtctcgagaggagaatgactgctcctcacatcttggccctgctctcctggcctggggagtctctgcttttcttgttctgatctggggcaggaagggaaagaacaaggaaggggcccttcctctgatagaggaggaccctggcccatgtgggcgtctgagggaggtggaccactggactgtgtgggcgtctgagggaggtggaaggcagcccccgcgtccattctgtccatgttggtagcgcggctgtcctaagcccagaaatgagatctttgctctacttcctccgcaaggggttggttaactcatctcaggctggagggaacatgcccactttggaggcaggagtcgcagtgccttgcggaagtagatttgctgagggagaacttaagcgactgtcactcagtcattcaaggcctgagcttccccagtcataaaagaagggtgagttgagggcttcctgggttcctttgaggtcagccatctaatgtcctcatctggtctagcactgctctaggctggaggctgggtaaaggtggtggtcagggcctccagaagggctctctgagctggaacctgctacaggcttctctgttgctagcatcactggcttcctgtatgtgcctcccttgtgaaatgagagctggggtccagcccagtttccagctgcgagggctcctgggagtctctgagtacaccatcacacatggaagaagaggagctccctcccactcggctgtcagccgggaagggaacaggctccaggtgtttcagaggctagactggaaacacggtctctgaggctgggcagctcaaaggtggggaagagcctcctgaaccttaagagagataaatagtagtggggctgggtcaataaatttaaattaaagtctcgcactgttgcccgggctggagtgcaatggcgcgatctcagctcactgcaacctctgcctcccaggttcacacaattctcctgcctcagcctcccgagtatctgagataacaggcgcacaccaccactcccggctaatttttttatttttagtagaaacagggtttcactatattggccagacttgtctcgaactcctgacctcatgatccacctgcctcggtctcccaaagtgctgggattacaggcgtgagccaccacgcctggcccaataattttttattgggtgccagccgttgtgaattttaccttgtcagtagctgaatgttttgtattcttataaataatcttgatctttgttctagggcatagttgagttattcagaaacaatttgaatctttagagtcttgtttttaagattttttggagtctacaacaaggatcagtttagggctaattataccccaccatggaggcatgaccttcccaaatactctactgagtgcccagtgaatggtgagtttttgcggtctggctggtgggaacaggctgtgtccagctgtgggaatgaccagtttccagctgtgtgtaaatactagacactgttacctctaatcctttcaaatggttcttttccctgcctccagtagtattcctacacatcctaataagtattctcctgaagacccaagagataccttctgctggtctccaggttttgctttctctggggaaatctcccctctggtctctctcctatctctctagctgccacggtctctctgaactctaagctgcatttcctcaacagagtttgccaagctctgcctgggttcccatccctaagtcgtgacctggagactgtctcaagacagtgggctgggcagttgtagggctggctcaccttactggtttcttttctcttagggatctgtccttcctttcctgatgaccagtttcttgaaaatttctgttgcacaaattttgaatagtttaaaaactttttttccaggtgggagagtttattagtcagggttctccagagaaatggaacaaataggatagatggatggatggatgcatagatagatagataggtagatgatagacagatagatagagagatagatagatagacagacagacagatagatagttagatgctgagattcattataaggaattggcttgcttgattatgggggctgagaagtcccgtaatctaccatttgcaagctggagactcaggaaagctggtgttataaattccaggctgagcctgaagatctgagaaccaggggagctgatgatgtaagtcccaggccaagggcaggaaaagaccaatgtctcagctctcaccactgggtagagatagaattcaactctcctccacccttttgttgtatttgaggtctgaacagattggatgatgtccacccatactggggagagcaatctgctttactcagtttaccaagtcaaatgttaatctcttccagagacaccttaacagatacacctagaaataatatgtaaccaggtatctggcccagtagagttgacacataaaatgaacctgcatgaatctatcctttgtcaacttggcacccataagcacctccttaaaccatacttaatctccagataaagacaagaacaagttcataattccacctaacgtgatgcaactctcctgcattcaataaaaaatacactagcccctttcctagaaataaggtaaaatccttgatatctttttccttgatattacctaactaaaaatactatgatgtaaaattaacaatgcttaaatactatgatatttagtcaaaatttcttacgttgcatgctaagggaataagagaagaaataaaacaaagctatttatatataattaattaatataaataataaatataatgcacacatattcataacaaaggaaggaggaagtactcatgataattacaattcttgtgtctgtaactggtcacagggccgtagcaggtatttataactaccttcttccactactctctctgaattctctttgccttcagcaagcatcccagttggtcatatgtatttacctgggagagtgacccaactcttcattcctgaagaatctaggctgttcatagccctgcctggattgggttgttgtagttattcattgaccttaatcacagggcatggtaatactaaaacacgccgtaagggatctcctgtattccagacagtcttctttacctccattgtggagtagtagtccaatttgtccttgatagtctggaacaaccatcccaactatcactatacctccctcctcacctgttcattcatgggcatgacgggcccaaagtggcaaggtggcagtcttaacttccaattcagtggaatcattgttgtgattcctggtggaagcattctccctctgaaactaaaacttctaggagagtagagtataaagtcacaggtacaggaagtaaaacctttgctagtggattgctaagggtaatagtgagtggtgccacccccatttccacctcttggtttctggatccttgaatcctagctatgggagaaagagcaccatatgctggatgcagactcagagctatacaggcttctggagaaccttgcccccaccctataaggtattgcaacgtagctgatgctgtaaattagtctgcaaaaggccatcacactgttctacatatgccacctgctttaggatggtggggaatatggtaacttcagtaaattccatgaacgcaggcccagtgctgtacttcttttgctgtgaagtgagttccttggacagaagcaaatgctatgtagaataccatgacagtggataagcattctgtaattccatgggtggtagtttcagcaaaagtgttgtgtgcaaggaaggcaaacccataaccagagtaaatgtctattccaccaagaacaaaacgctgccccttccatgatagaagtggtccaatgtaatcaacctgcctctaggtagctggctgatcacctccagggaactgtgccatactgggaattcagtgttggtttctgctcctgtcagattggacactcagtggtgtccatagccagatcagccttggagagtggaagtccatgttgctgggtccatgtatagccttcatcccttccatgagggctgtttatttaatgagcccattgggcagtgacagagttatctgaaaaaagaggttgactaagccgggcgcagtggctcatgcctgtaatcctagcactgtgggaggctgaggcaggcggatcacttgaggtcaggagttcgagaccagcttggccaacatggtgagactctgtcactaccaaaaagtgcaaaaaaattagctgggtgtggtggcatgcacctgtaatcccagctacttgggagactgaggcgagagaattgcttgaacccaggaagtggaggttgcagtgagccgagatcacaccattgcactccagcctgggtgacagagtgagaccctgtatcaaaaaaaaaaaaaaaaaaaaaagttgactaatatctatagaatgagtcaccctattcacttgattattaaaatttgcctctgctgatatcaccctttggtgagcattcacatgggacacaaatctcttaatcttttgcacattcagagaggtttatccatatacctcttccccagatttccttgtcaccagttttcccatcatgttctttccaagtccctgatcatccagccaaatcatcggctacagcccatgaatcagtatattatcacatgtctggccatcggtcctgccaagcaaagtgcacgaccaggtgcactggctgaagttctgcccactgggaagatttccttcaccacagtccttcagggatgtcctagaaaggggctacagtgctacagcatccacttttgggtcgtgcctgcatatcctgcagaaccctctgtaaaccaggcctgagtcttctcatcctctgtcagctgatctggggaactccccatgaagccacaggtgcaggctgggagagagaaggcaacatagcagggttaggaaccgtgggcatttgggtcacttcttcatgtaacttacttgtgccttcggaacctgctcgggcctgatcacagatacaccacttccatttgatgatggagtcttgctttgtccacccaactttatggtgtggtgggtcagataacacccagcttatgacaggcagctcaagttgcatgataatgtcatggcccatgtcaagcgttcagtctctgctgaggcccgctagtaggccaagagctgtttctcagaaggggagtagttatctgcaaatgacagcaggctcttgccatgaaatcttatactctccactgtgattcacctataggggcctgccaaagcctccaagcagcatcgctacctgccactgacactttaagcgccactggatctgctgggtcatgtggcgcaaggggcagagcagcttgcacagcagcctggacctattgcagaaccttatcttattctgggcttcactcaaaactagcagctttgggagttactcagtaaaggggagaaacacacccaaatgaagaatatgttgcctccaaaatccaaagaagcccattgggcttattttggttgtagaaatggccagatgcaaaatcatatccttcacctagaagggctattttgacataccccataccactggatgctagaaatttcactgaggtagaggcctatgaattttaatcagatttgttttccaccctctgacacacaaatgttttactaataagtctagagtagttgctacttcttgctcactagcataatgtcattggtgtaatggatcagtgtggtaccttgtggaagggaaaggcaaacgagatccctgcaagctaactaatggacatagggctggagagttactgtatccctgctgcaaaataaccgaaggtacatttctggccttgccagctgaaagcaaactgcttctggtgggtcttattaacaggggtggagagaaggcatttgccagatcaatagctacataccaggtaccaggggctgtggtaatttgctcaagaaatgaaaccacacctgatacagcagctgcaattagagttattacctgcttacaataatccactgtcattctccaagatctatctgccttctgcacaggccaaataataagtgaattgaatgcagatgtggtaggaatcaccaccccgtgtcctttatgtccttgatggtggcatcagtctctacactctgtcaaggtatggctcttggtttactattttcctaagtagaggcagtcctgctggcttctacttgacttttctcaacataatagttctcattccacaggtcagggaactaatgtggggattctgccagttaccaagtatgtctattcgaattttgcattccagaaaaggagaagcaaccacaggatgagttcagggacccactggactcactgtgagatggaattgaactaaaactccatggatcagctgacctccacaagcctctcctctaactcctggaccacagtgacattttgggtctcctggaatcagtgagagttcagagccagtgtctactagtgcctgaaagttctgattatttcttttttctcaatgcatagttaatgctgtaaaaggctatatgtaggtccctttggggaaggctaggggaacattaacaggataaatttcgggtagtacaccagagtggttcctcaacggggcccatcttcccctttatccaaggggtttcgaggctgtaggctggctcaagtctgggaattgattgaggggctatgactctctgcttctacaattcacgttagatttttgttcacttaacctagaattttccacttgtacacatcaagtaagaatttggttggcttcctatctatttcacttctaggaacaccatggtcagctagccaacaccatatacatgcgcgtgcacccccccacacacacgcacacacacatccccggcaccaggccaggaatttttaattctgaaggaacatctccctcagctgtttctgccagtctgaggtgagcagtgggcatggggctggggagggaggggccaaggcgtgcatctgcgttactgcagacgtccacgttactgcatgtgtccacattactgcaggtgcaggttggagcccccacccagacccgcaccagctgctgccatctctcatgctcagtcccaggacagttattctcagctttcccggacacctccctgttcccactagatgcaacagcacagctagttcctgctgcatggtgctcccagcttctgagtctttaaagatttgtttttagagatgaggtcttgccatgttgcccaggctagtcttgaactcctggcttccagtcactggggtcaggccctgcaggaaattggtactgctcggatgggaggcaggaattggtacagctaggatggggcaggcaaggcaagtcccattcgatagactgtggcccaccgagtgtatgctctgcacttggaatccggaatgatgagggggctaaggaccatgacataaactggaaatatttaacctagaaagactgttcttagagacattgttatgtttgagtaataaaagctagtacttactgggctctaagtttgtgccaggcatagtgctaagtgtattatgtgcttaaaaaaattctcaaaggccccattttacagatgtggaaatcgaagcacagggaagtggaaaatcacggttactctaccacagtatgaattcccatgggcaggatcccccaatggatgctgaagtgaatgggcagagctaactcagagagctaggggtggcagggctaacatctgagctcaggtttttctgattccaattttttaactgccacatgtggggaattagatttttttttctttttttactacacctcatggtaaaatttggatccataggtggcagctacagggagatgtatttcacctcagtataaacaatatctttctatttccaccattcaaaaatggagtaggcaggcagctttaacaggtagtgagttcaccatcaatggtggcaaacaaactgagcatgtatcggggacactacagagggatccagcactgattagacaatcaggattgcagagtgacctttttggggtcatttagaaaatgtgtgagtggaagaagggaggaaggtaccagccaagggagactctaaaatctgcgagcagaatggcaaactgtgattgctgaaacgttatggccacagccaaggactctaggcactgccagagatggggggctgtaaggaggcagcatgtgacagggtgaagagtgggcagttttgggatcaagatcccaaggggcacaacgtctttgtaaatcctccacaaaaggccttccacagaaactttgtacttcaaaattccagccctggtaggtcattcccttggcttcagacttttttctttgttgagatggaagttgattggggctgagtcaacttagctaagtgggagctacatttcccacagttgccttcccaatatgcttccatttagggttggctataaagaggaatatacatgagattcggaaggtgaaatgaagaaacagcaattttcaagctctgaagcccagcgtaagatgccaaacactgtgactggtcatggctgttgcggtcctgctgcctggcctcattgacatgggcagcacccaagcccatatctcctgcagctccctccagccctgctactcagacttcacctagtcctgggccagatgcgagcgcagctccgtggtgaagtgctccagtgtctcttgtatcgtccaggttggatgtagttcaagacagctgtggctccagccagtgggcagcttgtgggctcagccacaattgtcctctcgggttgcagggcacctattgggtccctgtttgtcttactctcctccacctcacaccttgatttccctcctgattgccagcctggccaacctgtaatgcctacaggcccaacaccagaagtaaggaccacagttttgcccagacttctcttctttacatttgtttttagagatgaggtcttgccatgttgcccagggtagttttgaactcctggcctcaagtgattctcccactgaagcctcccctacatagtcttcttaaccgggtcttacaattgcataaggcctaatccttttgtcaaatgccttattctgtatcactcataacagttccgcttctctgactgaactctttcctaactcacacgtagctgtcttcctccacacactgccaatcttatcattctattctaccctggcatgttactgacttttattagtgccttgccattacctagaaaatcaagtccacatccctaagggtggcattcaaagccctccatcagctttaccaaagcctatcctcttagctgctacactgaactgctttccagaaggcctgggaatgaatctgcctctgcctcctattagctatgaagcctcgggctagtcaatttccactgaacgtcagttttcacatctataaaatggcaaaaccatcctgcaagactgatgttctgcccacaccacagttgtttactgcctgtgtgttctttgatgggttggttcccatttcttgccagttcttggatattttgaatagcaccccgaattatttttctgttgctgcataacaaattgccacaaacacagtggtttcacaatcctttattatttcgcagtttctatagttcagagtctgggcacagcagagctggattgcccgttcagggtctcacaaagcaacatcaaggcgttggctggggccccatggtgatctagaggatagggtcctcctctgagctcattcgggatgtgggcagaattcagttccttttgtctatggggcagagtccctgtattcttgctggctctcagctggaggttgatctcagcccctagaggccatgctcaagtcctagccatgtgggcctcttccagcacggctactcacatctgcaaagccagcaggagaatctctctccagcctgctaggacagagtcttacataacacaacccagtcagggaagtgactccccatcatgttcccagggcctgaccgctggggaggacccaatgggaggagattttacagagcatgtgcatcgggagctgggaatcttggggctaccttagaattctgtccagcacaaaccccgttacctctcagcactgtgagttgaaaaaaaaacaaaagggcttagcatagggcctggcctgctgtttgtcttttatatatattcattaaatctctttctctgacttattcatgattactggagggcaaaggatcccaccttgttgttttctctgtatctccagcacctggcatatggcacgcccaggacccatggtcccctgcgagtggaaggatagatacaaatggagacaggtaaggggcttcaggaggagccaaggagcagggtgggggctggagggcaggctcagatataagcaggcagagggtatctgtggtgacggaaggcacgttttgcctccctccgctgtctcagatcccatgctatgtcaccctcagccttggttgctgctgctactaacaaatgagctgttcatgccacccccacaagagtctctgtagaggatcctggaagagctgctccagaaaggaagggaggcaccgggcacctgcccaattagcttggtgacctctctggtgcagaggctgtcttctctcatcctgctctttcccccagaggggcccagtgggacagtcctgaaaatgcaatgtagaaatcccagctgaggtgccctccagaatccagggctccagctgtgaatacttcagcaagaaggagccttgtgccagggaaggtggcggagggcggggtggaagaattgacagggctggtgtgaggaattagggcgcttggataaccaggtgcaaagggagttctgcacccatgcctttgcttatgtccttcccccagagcccagtccttgcccacctccttcatggtgctttcctccaacacccctgaatgaaagcagctggctcttgttgttcatgggcagtgggtttcagtgaaggtctctggagcagagttcaggaccccctaggtcctactttgtctagtaacatgctatgcagatggggcatgtcagttacttcctctaggaatcaaatttttgtaccctttaaatgaaggatctggagcccaggacctctagggtgtctgtcagtttcacatttggaaacgcttcaattccaaagacctatcttatcttattctggtatcttgcttttgtcccttctcctgctggccttgagctagggctgtgcatggcctcgagctagggctgtgcatggcctcagtgcttccatgtgggctgaatttcataccacagatgtttgctgaatgaacatcatgcctgggactactggttctatttttaggagcgtgctggaatttctaaccagactgtgagcttcctgaggttagggtttggagtgtgccgcacctcagaacccagaggagactgagaaaggacccagggaacactggggatgaaaactttctatactctctccatctacataacaaacagaactcattcctgtattttggaaaacacagacatctgcactttgtccccagagatcctgatttaattggcctatggttggacctgggaggtgatgttatccggaagctaccctagatgattgagctggggtgagaagccctgggctcagttaatacctgagagcagttccacctctgccattctgtgactcctgcactccccatacgtgctgttggtacagggcagaggagccctatgtgtgaaaactacttagggctttacattttttactggtaataggagttgtgaatcttcttgatgaagctcatattttatgcttggttctttgtagacattctcttttaattgagtcttcatagcaactctgtgagatcaatttcatgattgccattttagagatgaggactcgggagctcagagaggggacttgatctgcacaaggtcacacaacgagctaatcagtggctgagctgggatttgaccccatatctgtctgacttcaaactccatgctcttttcaaactggaaagctcaagataagtagccatttaggtagttttttggaaatatgcaatttggagctactttagtacctaaccagggaaagggaagtctccctcttttctgttttggttatacattatccctaaagcatctggttctgctgcctttgacaaagatgctctcttcttgaaccaaactttagtccggctcctctgaacctgcttctcaactaggcctggacatttgtgcttttgcgtttgtctctatattgccttgaatggttaaaaaaaagcgcggctgggcgtggtggctcatgcctgtaatcccagcactttgggaggctgaggtgggcagatcacgaggtcaggagtttgagaccagcttgagccacatggtgaaaccccatctctactaaaaataacaaattagccaggtgtggtggcatgtgcctgtaatatcagatactcaggaggctgaggcaggagaatcgcttgaacccaggaggcagaggttgcagtgagccgaggccacagcactccagcctgggcgacagagcaagactctgtctcaaaaagaaagaaagagaaagaaagaaagagaaggaaggaagaaaggaaggaaggaagggagggagggagggagggaaagtgtggcatatatgcacaatggaatatactattcaggcttaagagagaaggaaatcaatcctgttgttttcaacagcatggatgaacctggaagacactatgctaagtgaaataagccagtcacagaaacacaaatactgcaagaccctgtttatatgtggaacctagaaaagttgaactcataaaagcagagagtagaatattggtcaccagaggatggaagagtgggtggttgaggaatggggagatattgatcaaggggtgtgcagtttcagtgagataagagaaatgagttttgctgatctattacacagagtagtgactatagttaataataatgtattgtgtatttcaaaattgctacaagaaggccaaggcaggaggattgcttgaggccaggagtttgagaccagcctgggcaacatagcaagacccccagctctaccaaaaaaaaaaaaaaaagttagccaggtatggtggctcatgcctgtagtcctagctactcagggtgctgaggtgagaggatcacttgagcccaggagtctgaagttagagtgagctatgatcatgccactgcactccagcatgggtgacatagtgagactgtctcaaaaaaaaaaaaaaaaagctaaatgagtagattttaagtaatttcataacccaaaaaatgttaagtatgtgaggtgatggatatgttaattagcttgatggaatcattctgcaatgtaaacatatatcaaaacatcaagcttgacccacataggaagaccccatctctccaaaggaaaaaaaaaaatgctggttgtggtggcacacgcctgtggtcccagctacatgagtgactgaggtgggaggatcactggggcccaagagatcgaggcagcagtgagctgagattgtgctgctgcactgcagctgggtgacagagcgagatcctgtctcaaaaaaaataaataaataaagataaaaacaccacactgtaccctataaatatatacaattattgtttgtcaattaaaaacaaaatttcagaaatcttactaagtcagtttagtgagaattcctcatacttggtatctgatcaaattctttatccttcaccctcagaatctgatcatcctggcctaccttcagtgagatgttgagtaggtttagccagaatccactcctacccctgatgtttcctttcactgaccgtcccgccacgaccactcctgggctgtaaatcctcacttgtccttgctgtatttggaatggagtccagttctaaggttcaagagttctaagagtcctgagggctcatttctcctattgaaatagttcctgagtaaaatctgcttttatggctctaattactgtctggctctggttttctttaacacttatatttgtagaatgttgacaagctagaacgtttttgaatgagtgaggtcagccaggagactgagaggatcctgctgtcacgtggagaaccatggaggtgttacaggctttagtgcagaagcagagacagggaggcaagagagctgtcttcacatgcatctggctgtgcaagaagagagaggagttctaaagcaaaggatctgggcatcctgaatactgttaggacagctcttactaagtaggagtgaacaggaactggtttatacttagttttaaagatgaagtcagtgctaaggaatgggcccctttcctgcatgctctatatgtttctgggacatttgctgtcggatgactctggccctcttccagtgggaggactgggggaaacgctgcaggggatgctcactgtggcccacgtgacccatggtgctgctcagtaacatgtcaaggatgcagattctttctgcgcatgcttgaaactagaaggcaaatggagtgcacagcctcccacctagctaggcacacatttcatgtttccttaaactgtttgttgggtgtgctagatgggtacttggatctcacttggtgtaaaaaactctggtggtttcaagtaaacaaatacagagcacctatcgggtgctagctagagagccagatgctgggaactggaacaggaactgggcatattggctgtcccatagaagctcacagtcttgttttgggaagatgaaaaacacacaattgactaaaagaggagactgacaatggcaagtgtgacagtgatatgggacacaggacaggatggggtcctgactgaggaaggagttcccagtgagcttcacagacgtggtgatgttccccaagtaagacccacctaacgagaatttcttctgcctgcatagactggaaaacaggctcattaaaaagagactgtcattcagttggggtaagtgctaaagatctagaagtggtagaggtaagggatgtggtttttgttgtaggggaagggagtaatgtcaaggtatggggtacctaggtgtagcaatgctttcattaataccatatattcccctctgcctttctgatagaactctgcttccatttggttaatctacccttcacacggtcatgcccttcatgacagcatggcaatttcattccctttggcagtaactggtttaggcatgaccattcagtagaactatggtcatggagatgtgagaagtgttctagtgggcttctgggaaaggcttccttattgtcaaaaggagacaaactcaaggatggaaagtctgttctttttctggacatcattgtgtctggatgtgatgctgccaagggggcaaccatcttaccaccttgaagggagtgagtccaagggcagagcctcagactaaagatggcagagcacaaagatggagagaattcacgtccttgaagatggcattgagcagctgaatttgcccatctggctctggaattcatatgttaaataatatatgtctttaatgttattttgagatggggttgtctattacatgcagctgagagcatcataccctaaacaaaggaaaccgagagaggacattcagaggagtatcacacacccgggacttttactgagtgtgaacgtccctcctcaaaatggatccctgctagtgggacagtcggccatcttcttctgccctcaaatgttttctagcctatgtccagatcggggcaatcaactgggaacctctctattttagacaaattcctttttttctaagaccagctggaattgcacaggagaattattaactaccacttaatgtattaaaatctgccgctactcagcccgaggtcttgctacacagagctggccaagtgaggagctgctctgttagcaaccaacacctacaggcaaagtgtctgcctttgagactttaggtttcatgttgacttttgaaagccctctgtctcttccagtgaacagcacacaagcctgtcattgtagcttagttttagttggaagataaccatctatcttttctggaagataaccacctatattttccagttccctctgggacctccaagagtgaattctgggtaaatcaaggagcctatatttaatgttgggccagctaacatacccttcacatttactttaaattcatcaagcacttaaaaaaaatacactgtggttaaaagacaaacttacttttatttagaggtatctggatgctcagaatttcaccttgagaaatcatttcctcccacgcaggacctggctctcagaggagccttgaatatttgtgtactctgtttgcatgtcaatatctcgaccacgcttaaatgcagccaatggagatcttgtttatttttaattactcacattattacaatcattaattatttaacattacagaattttgggaaattgaaaaataaagtcagtcttaatcacttcatctgatgcatcaatgaattaatttcatcctgatcttccactgttatccacatacaagtatatttgtatgctgcaattctagcacgcatacatttttgtctcttaatttttttatcttattaaattaaaagactatccatgttgccacaatgtttttataataattttaatacttgcataataggatcagcaaatagatggaatggaataatctaactttgtaaaaacactggtagtagtttagggaactgttgtttctctcctcccccttctcttttgttttgttgcccatctctccactgggagcaagaattcaggaatgagtgagcccatccccagctccaggggcaagtcctgactggtctgagcccatcatggtggttccattccccttgctggagattggtttaggcatctgcatgtgttgctagtctgccaagggacatgagggggacttctgggaaaagcttttatccttgtaaaaagaaacatgttggaagagatgttccctccttccactggacaccattgcgtcggcatgcagtgcctgtaaatgtggcaggcaaatgttacccaaccgaatcaactttctctcctgttgataaacattaaagcctattgtaggctgtagctataaagcctattattagaaaaacctcactttcttggcatttggggtgctgagacctggaacttcttcctggacagtaggatttctcaccttagcaaaagtgagacaccaaactctgagacacttccccagggttttaccataaatgtcccatttgtcattgatatgaaaggatggggaacaaagcaggtcagccaagttgctatttttttctgttgtcccaagtgagtcagggcacaaacagtctgatcattgggaatgagctgacaagtgtgactcagagccagagacatggaaagacacaggatgctgggtccctaagatgccctaggaaagcgcttcatcctgaagggccaaaagccataggagataatcctccttagtcttctgagatgaggaacacttactccagacctaggctgcagacttgccctcctgtttttctttagtggacccaacttttggataggctccattcagactcagttcacagcccttaggctcttgtaagactataagatttaggctaagaggacctggattaagattctaattctattattggagccatctcaggataattgtaattttgggctaccttttctgattttcaatttgtataactataaaatgacgttggtggaaatacctctatcatagaattgttgagaatgttaagtgacagaatatgtatgaaattgagtgtagcaacagcaatttttgggccacttactatgtgttagcctctgtgaataaaaagataaatcagaattctttcttgttcttaacaagcttacagtccaatggagaaagcagtttataaagtattggctattatcactactacccaggatccacatatttgaaggtcaagtaaggattttcttggcatatgattgtcttagtcagtttgtgctgctgtaacaaaataccatagaaaacacaaaatttctatgcgcaatagacatttattcctctcagttgtggaagccctaggtcaaggtgctgtcaggtttgttatctggtgaaggaagctctctgcttccaacacgacgtctttttgttgcatcctctggagaggacgaagactgtgttctcacatggtgaaaggtagaagggataaaaggggatgagggctgtgtgaagcctcttataagggccttaatcccgttcacaagggaagagtcctcatgacctaatcatctcctaatggccccacctcttaatactgttgcattggagattaagttttaacatgaattttggaggggatacaaacattcaaagcataagttacctattgctgtcctgtcaggacaaacaagaattcataactgcaagaatgcagattgcaagacctccgtgggctaggaccttatctgcagggttgcgtgggcatttctttcatgactttcttttttaatggctaagctttgggcagttttacttctgagctgaggagtgatgacatcctatttcttattcccaaagcttcatatctggattgacaagagcaggaactgatgaggttgcaggagtctggggtggatggagagaggtctcaggtccgtcccttcatgggctgcatagattctgaagggatatgtggcaccaaagggaagcatccttctggatgacaccctaggtgtcagctcctcttcttcccagcagctggagacaagccctcccccttgataaaggaagtatcaagatttatttgtttagcaaaatgatctagttaggttgtttcaaagtatttttttgaaaaaagcaaagtccattttttcaatggaaagacctggacatggaatatgtaaaatggataaccatggagtgctcttggttgatgctagttttgggggcagggtatcctgcccatttaacccaccctctccacgaagacccttctctccatggagatccttcaggcatcttggtggaagccacagggctctgaagaacacagcttgactaacttcagcaagatggtgtaggtacggtccctgtgtatatcacacctagtatgaattgagaactgttgaggtttcctagccctaaggaatctcccttgccagccacctatcaggtgcctgaaattctatctcttgggggctttagagttttttgctcttcacaaaaatgccctcatagagatgtaagcatttctggaaaaactacaacaagcccatgaccaatttctactcacattcactcatccattcattatattcaatgaatatttactgagcatctactaagtgccaggtattattctacatattggagatatggttctgagcaaaacagacaaaagacctaccctcttgaagtctgcattccagtagaaggacagtcactgacggctgggccctaggggactggagtacaatgctggaggtagactgtgcccagaatatgttgcagacatgctgtgctcacctccgtgctgctggccctactcagctggagctaaacagcgttctgagttgaaccagcttggcaggacattttggacaaacactggggtcagttcgtttgtacactgtcttgaagtcctttgggtttggttgtaatgactcaggggccacctggggcacagaagagaagaggtgggaggggtaaggagaggccaccggggacctcacttggatctagctaagggcttctcacacttcgctgcacgttacagcatcttgggagttctcagaaatccagatgctcagctgaccccaggagtttttggcgctactgaggcccaggacccactaccacagaacctgatgtaataggtcctgtggtggtgggccctgggcctcagtagggccaaaaactcctcgggtgagtacagtgcacagccaagattaagaacccctgaactaacttgtataataggtctatgtaaaattcttctctcgctgaatattctcctgggctataaacacatttggacagtgattagtccattctcatgctgctataaagaactgcccaagtgtgagtaatttataaagaaaagagctttaattgattcacagttctgcatgactggggaggcctcagggaacttacaatcatggcagaaggtacctcttcacagggtggcaggagagagaatgagagccaaacgaagggggaggccccttataaaaccatcagatctcatgagaactcactcactatcacgagaacagcatgggggaaaccacccccatggttcaattatctccccctggtcccacactcgacacgcggggattattacaattcaaggtgagatttgggtggggacacagagctaaaccatatcagacagtgttctctatctttgggctgtattggactcatctgggggaatttggtgaaaacaggcaggccaagcctctctctcctacatcaatgagccgaggcctctgagttctttatctgctctccaggggattcaggtacacatgaaagttggagaaccactgggtaagagaatgtctgacagcagggagtataaggatcactggccagaggcagctcactaatctgtgaccttttgggcctagagccaggaaggaaaacaggtattcatatataggtttcactgttgtgaaactctacatcctacattactgcattggaacataacgccttgtaaggtattattgtccccattttacagatgagaaaactgaggcacaaagatagaaagcaacttgcctaaggccacatgggattcaaactctgatgtgtctgacttcagatcctggggagactgagttctgatttctcttctgtgacctggaatctgttacaaggagcactagagaattctgttatctcttagctcaggtgatgctctcattgttctttagaagtgccgccagaagttcatgctcggagactattttgtgttcacaggaaactgctctttcattcatgccccttttgttctcccgagtcagggatctcagctccctcttttctcctggaaccctctaattagcctaactgtaaatcgaataagcagatttttcagtgacataatgcagtttggaactatatacctcttatgggctgcatctattttccctttccagtacctctgcaactacaaaaatcttatgttgacaatagagatcatgtcatgtttcctttggtttgagattctgtgtgacctgagtactttaggcaattatctatgaacatctaaactaagaaaagagcaaaaagggcaaaagagtgcaagattgttcccattcccattaaagaagacattctcttctgtgtttaacatgggcaaaataaaagtctgtttattagacttcaaacacgtattttcacaacacatttattgtgtgcagcaaagttcaactctattttgtgcctgtacatataagtatcaaaggaagcgccttcattcctagttgctgacaaatatgaagttgctttcaagaaaacacatgcaaaagcaattacgattatgaatggctttggcagccaccatcttacattattaattttgtaatacagtccacctcctcttcattcatgtttgataggaagcctgtgtggtcaataaggaagcccagtgcaggatttatgaagttgtttgtaaggtttcaagaccctggtggtgctcgttctgcattcagggttgtgcttttcctgccctccatgaccttgcttgcctttgagatagcaactgctcttttggaattcatcaacaggtatgatcagtaaccagcaggatgttatctaaaggaaacaaaataagctttgagcatcatttggaattggccacatttcctctgcagtggcaaggtgctgggagtacagagtatttgtgggaaagggtctctgcaataacctctgatgagaaggaaacacattagccgcaatatccagcatttatatcaagctcaagctcaagcttgataccattcgcaaggtgtttccaaacctgtagtccatttgaatgcatgataatccttaaggtggacagaatagctatgattagataccttttcccaatggagaaaagaacctcaggttaaatgacatttagtcttttctagcctcgtctacacaataatcccctcactcccttgccccctgcttactcccacaagcagcccttctcctgccctgttccacaggtccctaccccatattgtatttttaaaggcccttgcattttgcctgctgctggctggcacctaccaatgcataactttgcagttcctagctatgctgaggtgcccagggtgctgttgtgaactcacaggagtccggcgaggtattttaaatttttgagggaagcaaagcaatgcctgacgtctatccaaccccacgtgacaggggtaaacagatcactctacattccttcagattatgtcatatctttgcaaagctaggttttcagtgattacaaggatgaaaaaaagtactactgaaaatcagcgtgggacaggagttgagggtggcagtgtccaatctgattgcagggcttgagaattctgcagtgcccaacagagacacatgttttgttaggaagtaattgtgtctctttaggagtgaaataaaataatatttttcttttaacttatgtatattattttctgttaataaggacacatttattaagttgcttatacataactacttgataaatggaattgttaggtatttcttttggcctaagggtatcctgagataccaagggcaccatgaacctagcttctggtgtaatgaaaatccctaaaggtgttgcttttcttgcttttttttttttttttcttcagaggactttacatttgaaagccttttaaactccaagactgaacaactgccagagggattttgctgctgtgaccagacactttcagctggagagacactttcaggtgggggttttcctagctcttctgagccacagttggttgtccatgactggatttgtccctgaatgtacacaggttggcctgaaacaataggaccatgagtcacccaagagtggatagtgagtgaatcgggtgtccgttatctccaggcatccaggggacaaaatgaaaagccatgtagtccatctgtctccgacagagaagacaaagcaccaacctctgttcagtccttttactcaaaaatatttcttcagtgtccctctacacaccttgcctccaagaaaaaatatgggcagcctggaatagtgggtgggacctggaatctgtgtcaaatgttggctgagctcctcaatgacgcaaacttagctccttcccgtttcctggtgctgcccgactccagagatgctctggcgtccctccttactggttgccatgctgagatgatggggatcacgggtgctgaccaatgttaaagataggtatgaggtaaaaagcattcagggaagtcttaagtgtctgccatttccacatttccacctaaggaagcaaccccagggcgattccttggcattggttgccaggctgtgagtgttggctgatcctggtgccctagccaccactgggggactcgtgattacccagttactccctgcaaatgctgggtgggactagaaccaaccacttgcagtgacattgagatttagaatcagatattcctggttcaaatcctgcctctaccttgtactagctgtgtgactttgggaaagtcatttaacctatctaatatttgttttcctcacttggaaaatggaaataataataagccacctgtgacaattcattggaagtacttggtgtggtgtctaaactaagccttctttatatggtagcaattgatcatcatcatcatcaccatcttaatggaaacaaccaacatgtgaagtaggatgaagagaggttcatcctaatccccattctgcagatgtggaaactgaggctcagagaggttaaatctgacttgctttgggttacatacacaagtacagctggaacttcaaacctgggtgttcattaacctggcacctccttgattgcatcctgttgacccccacttcatgggcctctccttcccatctcctggcccactccgactgtggaggtcataggtaacccttactaagtttatgtgtatgtcctgctgctctcgcttcctggatcctgcacagcagacagccaagtgtaggctgggacagctccaagcaggaaaggggatgttggctggatgcagtggctcacgcctataatcccagcactctgagatgccaaggcagaggattgcctaagcccaggagttcaagaccagcctggggcaacatagtgagaccctgtctctacaaaaaatagaaaattagccacatgcctctagtcccagctacttggaaggctgaggtgggaggatcgcttgaggtcaggaggtcaaggctacagtgagccatgaccacatcactgcactccagtctaggcgacaaagcaagaacctgtctgaaaaagaaaaacaaatgggaatgccttcttggcttgggtgtgtctcctgagcccatacatacttgcctacctgtttttgtgacccttggccctcctggaaaaattggttttgttttcagcgactcggcagccagcatcctgaggagtgagacacatttgtccctgtgtaaccccattgccactgtcatcaccatgcatagcatcagccagtagtaatgagcagctattttgaggctgggggacagctgtttcccctaagctttcagagggctgggattctgcgtgcagagacttccctccccatctgtctgtcacctgacagaataggctgtgacttggtaataccttctcgccaccccaaaattgtcctactttcacccctcactccaccaggagggagatggaacatgcctgggaccagtcagaggccagttttgggtcatcttctgcatccatctttgctgtgtaacagaccactcccaaactcagtggcttgaaacatcaatgatttatttctcaccattctgcaggttggttggatggtgtttctggtcctcactggtttggctgggactggatggtctggagtccctcactcacatgtctgagtcctcagctgggacagtgtattcatcatgcctttttattttctgtatttttgattatttgacatcttggggtcttcctgaccctggagagactggtccgtctagggtgagccaattcctacagatggtaaatgactctcccttccatatgcaaactgaacaagacagagcccatagccccagccactctgttacagagctctgataccctgtgccattattttcctaccccaatcaccttacagccaagtaccagacaactagagacagcccttatacctcagagccaaatgaaattatccaaactagcccatcttaaacctgcttacccttcctcacctgttccttcccaggaaaccaaaatagaggttcttgccccattttcctctcactccctctgcccctggatggaccctggtgcttccccatttggtcccctgcaatgtgggatgctccatcttttaggatctgtgggtaacaagccatttttttccaatggcagtcatctcctgatctgataccctcatcatccctgagtaataatacagccaacatttaaaacagacagcagctgggatggctgcatctttctctccacgtggcctctcatgctccagggagctaacctgggcttctccctatgtgatctccacgttcccagctcaagagagggcaaacctcaatgtgtcagcactttcaaaacttctgcctgagtcacacttgctaatgtcctatggggcagagtatatcacatggctgagcccagattcaaagaatggaaagctatagactcctcatcttaatgagaggaacggcaaagtcccatcaaagggatgtgcatatagatgggaagaatttgttgtcatttcataaagtctaccatatgctgtgctcactgtgcctttgggcaagtggcttcctattccttaacctcattttcagcagcttcataatggaaagataatccctgatcctcacagggctgctgagagggtcaaaacaccaaaacaccacagtccagagagtgccatggtaatgtaaaggtttgctgttatctgacattcataccatagatgtcacattttgagttaagaaagatccaggcgtttggatcttaaaaaatgattttttccagcctgggcaacatggcaaaaccttgtctctacaaaaaatacaaaaatgagcagggcatagtggcacgtgccagctactcaggaggctgaggcaagtggattgattgagccggggaggtcaaggctgcagtgagctgtgatcgtgccatggtactccagcctgggagacagaaagagaccctgtttaaaaaaaaaagaaaagaaaaagaaaaatatttttgttatcaaaatcatatagcttagtttcttaaaatttaggttggagagatcctcacaagtgcttgacaagatgtcacccatctttataagaatgtgttctagataagaacacatatacttatggtattagttgaggttcttgatcctatcagtgtcccacttctagatcctgggaaagaaaatctggatggccaagtttgaagcaagtggataaacctggtcaaaccatgccaatcaaaggggcatgccatgggtaccaaatattgttttaagtctgtattgactctactcctttaagccagctggacacgctcataatcatgcaaccaacagaccataaaagcaagtggtcaatacccactcactgtcttcttgccccagacctttcttgctgcgttctgacttgctctgacttccctccaggtcctgtctaattcctgacccctggctctcttgcatttgttaccttgcccttgtaccctcccacttggtgtttttcctctggaatttccagaaggctttttgcttacagacaccttctagctcttttggatttgcttgagattcggaaaggctgcttgggacttcacctgcagcctttgtcctcccactccactacgagatgcagggagttagactacctatgtgtctgtttctctgattagactaaaatccccttgagagcaggaaccatctctctaaataaccagatattacttgtcactttgttccttcatacagaactaagggaatcaagtgaaacatagaaccaagatattctagatttgtgctggaattgctaatagatgtgtgttgttttgtggctcccagctttccaaactcccgtttttcaggaatcctttgttggcgacaggcacagtcctgtctccctcttcagagggctaagggggccagacattcccttttctcagcccctggcctcttggccatatgggacctatgcttggccaaccagatgctcccaacttgaactttgaatcttaagggagtctcacagggacaagggccacgtgagaaattcagtggttatatgtgattcatgcaggagcagcgggtaagcagaaggctcagcacaggtctctagcagcagctgtgccagcataagtgatctaacccagctatttcagtggccccacctggggagtgttttgccacctggcctcctagtttcctgactactttttgagcgtggttctccattattctgatagattcagagaccagtgcaatatcctattaataaatgccatctttcggtgcagcaagtcagagtaaatttctgttttttgtctttgtttttgttttttgcaaccgagaacctgattgatgcaggccacaaataataataaacgcttgcttccactcaccatggacatatcacatgccacatggagcactgagtacttcgtattgatgatatttaatcctcaccacagtcctgggtgggaattattactcttctcagtttgcaattagactcagagaggcttttatgaataatgttgctgtgagtattcttgcatatgtctccctggcattcatgtgaatgcatttctgttgggcgtatatttaggaatggaactcccgagtcataaagtactgatatgtttatcttcattagctaatgttcaactgttttctaaagtttttattcccaccagcacttgcgtgagattctggtttcagtagatgaatggatcttggccaattcgatattttctttttactattagtccccatggcaggcatttagtggtatttcgttatagcttaatttgtatttccatcatgcccaatgaggttgaacatctttaaaaatttatttacgctgggcacagtggctcacgcctgtaatcccagcactttgggaggctgagacgggtggatcacctgagatcaagagttcgagaccagcctggccaacatgacgaaaccccgtctctactaaaaatacaaaaattatctcggcatggtggcctgcacctggaatcccagttactcgggaagctgaggcaggaacccaggaggcagatgttgtagtgagccgagatcacaccattgcactccagcctgggtaacagagcgagactctgtctcaaaaaaaaaaaaaaaattattaaaaaaaatatttaacacatagtacagagaattcccatataccctctccctcacacaacacagtttttcctataactaacatcttgcattggtgtggtacatttgttataactaatgaaccaatactgatacattactattaactaaagttcactatgtatattaaggttcactcttcgtgaaccttaatttgtataattctatgggttttaccaatgcataatgtcatgtattcaccattataacatcatgcggagtagttttaccattctaaaaatctgtgcataacctatccataccttttcacatcccccaaatctttgggaaccagtgatctttttttcagtctatagttttgccttcttgggaatgtcatatagttggactcatacagtaagtagacttttcagattggcttctttcacttagtaatatgcacttaagtttcctccatgtttttttttgtgtgactcgatagttaatttgtttttatcacttttttatcattttttaatagtctatcatttgggttaatattccacagtttgtttttccattcacatattgaagaacatcttgtttgcttccactttttggcaattatgggtaaagctgctataaacattcatgtgcaggtttttgtgtggatgtaagttctcatctcatttgggtaaataccaggaagggtcattgtggggtcgtatggtaagaacatgaacacttttttgagaaactgccaaactgtcttccaaagtggctgtactattttttcattcctatcagcaatgaatgagacttcctggtactgtcagtttggggattttagccattataacatgtggtagtgtatctgattgctttcatttgaagttctccaagagcataaaaatttgagcatctttttatatgcttatttgccatctgtatatcttcactgatgaattgtttgtttagatctttctctactttaaaattgggttgttttcttattgttgagttcaagagttctttctatattttgaatagaagtcttttatctgatatatcttttgcaattcttttatttccccagtctgtggcttgtcttttcattcacttaacagcagcttttataaagcagaagtttttaattttaatgaattcctacttacagatttttctccatagatcttacttttgatgttgtatctaaaaccccatcatcaagcttagattttctcctatgttatcttttagaaattttatagttttgcattttatgtttaggtttatgattcattttgggttaagttttgtgcagggcataggtctgcatttagatttactttttttttatatttgcatagggatgtccagctgttccagcactgtttattgaaacgttatcctttcttcattagaattgcctttgctcctttgtcaaagatcagttgactctgtttgtgtgggtctattccttggctctctattctgtcgcattgatctatttttctattttttttttccaccaaatactacactttttcttttcttttctttttttttttcttgagacaaggtctgtctctgtcacccaggctgaatgcagtggcataatctcagctcactgcaatctctacctcccagacgtaaaccatcctcccacctcagcctcccaagtagctgggactacaggcatgcaccaccacacctggctaatttttgtagagacggagtttcaccatattgcccaggctgttctcaaactcaagcaatctgccagcctctgcctcccaaagttctgggattataggcgtgagtcactgcacccagcccgcgctgtcttgattactgtatctctatactaaatcttgaagccaggccatgtcagtcctctccttctccttcaacgttgtgttggctattttgggtcttgagcttttccatataaactttagaatccagtttgtcagtgcccacaatataccttgccaggattttgattgggaatgcattgaatctatagattaatttggaagaattggcattgctgagcactttttgatttatttgccatttgggtgttctttttttggggtgctgtgacatacctattccaacctcttgaccattttaatttttcttattgatttgtatacattctttgtatattctgcaaaagagtcgtttgttcttatatatgttacaaatatcttctttcattctgtggtttgccttttcagtcttctgaataatgtcttttgaaaaatagaagttcttaatttaagctttgttcaattcatcttcccgattatatttcatgacctggtcaagatcccaagattacaaataaattctccctgttatcttctagagtcgaggtctgcaaactttcactgaaaagggtaagatagtaaatattttaggctttgtgggtcatatgatctctctcacaacttctcaactctgccattgtagtgtaaaagtagccataaacaacaagtgaatgaatgggtatgcgtgtattccaataaaactttatttatcaaaacatccggtgggccatagtttgctgaaccctgttttagattgctgctctccaatataactttctgtgatgatggaaaggttctgtgtgtgtggtagctaagagccacatgtggctattgtgtacttgaaatgtcactagtgcaactgagaaactgcgcaacttttaactgagaaaattttaattgtatttagttttgattaatctaaaaacttaaatagctacatatgactagtggctactatataggatagtgcagttctagaagcttattgctttatcttttctttagagctatcatccacttggaattgattttcatggatggtgggaagtagggaataggtggctatccagtttacccaaaaccatttaatttaaacactgtcttttccccatagctcatcggtgccacctttgtcccatattaagtatcttacatgactcattatctatgtgtatttatctatccttgcaccaatatcatagtgtcttaaatactgaagctcaatcatgaggaagactggatgtctggtagatttaatcctccatttttttttcttcttcaagaatatcttagcattttaaaattgttttcatttacatataaattttataattagcttgtcagtttccacacacacacacacacacacacacacacacacacacacacacacacatgcacccctgcttgaatttttattggaattacattgaacttatagatcaaattgaagaaattaaatgccatagaaaaatgccatagatattggatatatctatagcagttaattttctaatccatgtacttgatataacaaatctcctttaattaattaattaattagttaattgctttttgagacagggtcttgctctgttgtggtgcagagtcatgatcacggctcgcttgcagccttgacctgggcccaagcgatcctcccacctcagcctccagagtagttgggactacaggcatgtgccaccatgctctgtcaatttttatttttattttttttttgtagagataatgtctcactatgttgcccaggctggtctcaaactcctgggctcaaagattctcctgcctttgcctcctaaactgctgggattatgggtgtaagccactgcatctggtcagtcttctttaatttctgtcaataacattttatagtttttagtgcagacatcttctgtatctttctgtagatttattcttaggtattaaatactttttgatgctattgtaagtgatagctttaaaaatattttctaattgtttgtggctgctatataaatacacacttgattttgactgttgacccatgtccaaaccttgctcaattgactattaatggtaatcgtaatagtttatgcataaaaatatataatttttatatgttttttcttttctttcttttttttttggaaacagggtctcattatgttgtctaggctggagtgcagttgtctaggctggaacctctgcctcccaggttccagcgattcttgtgcctcagcctcctgagtagctgggactacaggcatgtgccaccatgcctggctaatttttttttttttttgtatttttagtagagatggggtctcgccgtgttgcccaggctggtctcaatctcctgagctcaggcaatccacctgccttggcctcccaaagtgctaggattatagtcatgagctactgcacctggcccattgatatttcttttatcctgtttttttccttctctgtatttccttttgttgcattggcaagaacccccagcgaatgttgaacagaagtggtgatagatagcagagccaacactcttatttcacgttcagtctcagaggggaaactttcatcatgtttgttccaggttaccctctatcagtacattttaacttattgcttttctagcattaaccaaacttgcattgctgtagcacccaacttgattgtgtagcatttttcctgattcttactattctcactggattaattttgctaatactttgactgtgattttgcatctatattaataaacaagattggcctgtaattttcctttctcatatctttgttgattttggactcaaagtgatgcaggtcccataaaactagctaggaagaatttcttcttttcctgttttctggtagagttcttgtaatatctggcattatttctttctttagtatttggcataatttactcataattttaggattcttcagaatttctacttcatcttgagtcagcttttataagttatatttttctgtactgtgtccattttatctaagttttgaaatttattgtgataaagttattaatactatctttatgattctcaagtgtctgatgaatctgtagtgatgatcactttcatgttctctaaattatctacttatgtattctctcttttccttaattagtttctctgggtttttcttcaaagaaccaactttggcctgttgattttctatattgtgcatttgttttctaatttattaagttcttctcttatcttattttcttccttctactttgcatttaattttttacgtatttattgaagtgtagtataccataaagataaaaaggcacaaatagtaagtatacaattaatgcattttcagaaaatgaacatatctacttaagaaatagaacttaacaatacaagcccctcattattctctgcagccattgacccctttctgtctggaagataaccactatcctgccttctaatactatagattagttttacctatttttgaaacttatacaaacgcaatcatgtaggtattcatttgtgtcttgcttctttccctgaacattatttttatgagattagcccattatgttgtacatagctaatatttattttaattctgcaaagaatgccattgtgtaaatataacataattggtttgtgtcttctattattgatggacatttaggttgattccagtttgaggatattatgcataatgctgctatgaacattgttgtacacactttttgagtgcacaaatgtacacagtactattgggtacatagctaggagtagaattgctggatcctagggtatacgtgtgttcactgccaaatggttttccagaatgggtgtaaaaacctttccttagtagcagtatatgagtgttcatttctccatgtccttggccaatacttggtattgtcaatctttaattttaaccattctggtgggagaataatggtacctcattatagttttagttagctttattttaatgactaatgagatagagcatcttttcatatgtttatcggacatttggatatcttcttttgtgaagttcaagtccattgcctatttttcccccgatgggttgtctgtttctcgtgatttgtataggttctttatacactttagataagagtcttctaatttttatatgagttggaaatatcttctgctcttgcccttttcttccctttttggtgatttttgaacagaaaattttaattttaatatagtttactcgatgaatctttttcttcattgttgatgcttttggtgtcctttttcatcaatctttacctatcctgaggtcaaacatatatttcctgtgttatcgtctaaaagcctttttgctttacctttcccattttgatctacagatgaccttcaacttaggatggggctacatcttgataaacccatcctaagttgaaaatataagtaaaaaatgcatttaatacatctaacttactggacatcatagcctagcctagcctaccttaaatgtgctcagaacacttacattagcccacagttgggaaaaaatcatttaacacaaagcctactttgtgttgaatatctatttgttttgttgaatatctcatgtcatttattaaacactgtactgaaagtgaaaaacagaatggttgcatgggtactcaaagtatacaatttctactgaatacgtgccactctcacaccattgtaaagtcagaaaatcctaactcaaaccagacccacatcagggaccatctgcactatggatgttccactgatggagctgattagcatagggtttctcagtctctgcaccatggacatttctgagtgagtaattctttgttgtgggggctgtcctgtgcattgttggatatttagtggcatccctagcttctgcccgctagatgccagttatgtcaataaaattgtccctagaattgccaaatgttcccttatgggggttggggaggggttgcaaaattcctttcagttgagaatcagtaatttaacatatagtgtagaggtcaagtttcatttattttctcatatgttgctcaactgaaatttttttttttttttttttgagatggggttctgccatattggccagcctggtctctaaatcctgacctcagctgatccacccacctgggcctcccaaagttctggaattacaggcatgagccaccacgcctggcctgctcaactgattttatttcttcctttatcatctttataccttttatttatttttctttattgcactggcttgaacctcaagtacaatgttgaatagaaatgatgatcaggggaaaactccatctttcatcataaatttaattttttttacagtgggcttgctgaaaatatccattatctcattcagaaagttatcttctattcctcatttgttaggagtttttttttttaactaactaattgttgattttttaaaaaatgctttttctgtatctatgcagataatcacatgaattccccttaattaagttaatgttgtattgaaaaaatatgttatattaattgattttccaacataaacccaataactaaggtcttggattatattatcttcttcctccggggaagtccacctgactcacaaaagtgtcaagagcactgtttggactctcagactgtcagcctcctcttctagaattaacaaattacctggggggaaagtagcctcaaattcttggattatatcttcttttaaagcatgacctggttatcctttctgctttattcatcctctgaaggcttcaaacattttctttattaaaatatttatttaaaaataattattattgttgtcattattattgtgtttagcttttgtagctgttctcagtggagaggttggtctcaatgatctgatcagtcattactagaaatagaagtttcttttcttagagaaataaatatcaagtatacaaagtacacaaagaaaaagaaaacatatatatatatatccatctgtactataatgtgttattatatattataatcaaacaacctatgcatcaccacgtaggttaagaataaaacatttaatggcatgaacccgggaggcggagcttccagtgagccaagattgcaccactgcactccagcctgggcgacagagtgagactccgtctcaaaaaaaaataaaaataaaaaaaatttaaaaaaaaaataaaacatttaaaattttgttattatcatttcaaaattgtttttatttaagaaagaaaattatcacttcttctaagaagaaacctctatgtgtcccgctctgattacatttttctctctctgccatcactaacttttagcttcatttttgtgttcagctttccttgctcttctttacagttttagaacctgtactttattcccaattatattgtttagttttgtctgttttggagcagtacataaatgacatcttctaagtgtatgcttttgtgtctccattttttttgctcaaggttatgttttttaagtttatccaagatgatgtttattttccctgctccatagttttccactgatattcagtgtatttttccattttactgtagatggacatttgtattttttctggttttcatgtattataaactatagatacatataatataaacaatatagtagtgaatgttcttctacacatttcttggtgtgcaagaagggttataggatatacatatcttcaattttacttagtcatacaaactcttttccaaagtgattgtaccaatttacaatctcaaagcagtgtgtgactttctattgtgctataatattgctatcacttggtattgactttgccaaaatggtgagcatgaaataatttacgttgtgtatatctctgatgtctgttgagggttgaggttgcatatttcttcgtatgggaccaaaagcctttacttttctctgaaatacttgttcttttatcttgctcatttttttttgaccgggctatgtattagtcagggttctccagagaaacagaacaaataggagatacatagggagagatttattgtgaggaattggctcacatgtttacagagactgaaatgtcccatgatctgctgtccacaagctgaagacccaggaaagctggtggtgtaattccattctgagtccaaaggcctgagtactaggagagctgatagttttatactagtctatgggcaggagaaggcagttgtctcagctcagtcaaagacattaagcaaaaattcctccttcctctgccttttttgtttatctaggctctcaatgggttgaatgatgcccaccaacattgaggaggcaatctactttactgggtccactgattcaaatactaatcttatcttggaaaaccctcacagacacactcagaagcagtgtttggtctgggcaccccatggtgcagtcaagttgatacataaaattaaccattgtgggctatttgctttttttcttagtgatttctaggagctgttctatattctagataagggcttctcaacagaactttctgtgatgatagaaatgttctctgtctgcactgtccaatatggtagccactagccacatgctactgagcatttgaaactagtgcagcagaggaactaaattttcaatattatttttagtgtgtttatttatttatgtatttattttgagatggagttttgctcttgttgcccaggctggagtgtagtggcgcgatcttggctcactgcaacttctgtctctcaggttcaagtgattcacctgcctcagcctcccaagaagctggattacagaggcatgtaccacgacacccagctaatttttttatttttggtagatatggggtttcaccatgttggtgaggctggtctcaaaatcctgacctcaggtgatccacccaccttggcctcccaaagtgctggtattacaggcgtgagccactgtgcccagtctatttttagttttaatagccatatatctaatagctgccatcttggacagcagaggtctaagtaacaattatttgttggctttaagttttgcaaatgtcttctccaagtttgtgaactgtcttttcactcctttcaagttgcttttgatgaacagaagtccttaattttaatgtattgaatattattaacctgttcctttacagttggtgtatttatatatcttgtttataaaatcctttctcatactttcttatcttagtatattttcttatactgaggtctgaggaactgatttttgtgtttataattttcttccctcatgagtcatcagttttcctagcacagtttactgaatgagccttcttttcctcaccaatctgcaggactgcctgtatcaatcagggtactggcgagaaacagaaggcacactcaaacattaacattaaagagagtttaaaaaaggcagtatttacaaaggagaggctgaggtaagggaaactaataggtgatgaagcacctattagtgaagcatcactaataggtgatgaagcagtttcaactggcaagagctgaaacccttaccacttctaaccttgagagtcaaggaaaggcaggagttactggacccagagggaggagtggaggaagacctccaaatagaaggggagacttccacagagaaacataccaatcaccttgacccaggagagacagagttggccagaggactaaacacctgtctgctcaacctcatgctgtccctcctgtagatttggtggtaaatccaccataacccagctggaagccagagggcagggaacccaccaatgcaggccacagaggtctgctctggagtacagaactgagtggagcaggttggagactgcatctgggtgaacaaataaaccatcaagcacacctgcatggttataaatctattttccataaatgcatgggtaggtacaagatctctctccatactgtgccactgatctatttgcagcactccacgctgctttaagtattaaagctttaaatatattttcatatttgagagggcaagaatcatcaccttgtttttcctcttcaggaatgtcttggccattccctgccttttgttcttccatttatatttcagaatcagcttgccagtattcatgaagaactctgttggaattgtgacgggagttgcaatgagtctctagatcaattggaagagagctgacatatttacaattccttccacggatagggtttatgtctccacatacttaggtcttatttaatatatttcttaataaggttttatcatactctctataaagagcttcctttttttgttattttttttctaggtacctatttttgttgctatggtaaatatcttttttttttaaataaaaaagtcactttttgcctgatgcttgtatataaaaatgaaattatttttgtctattttggactgagcaaccttactaaattatcttagtaattctaatgatttacctgagagttctttggagttttctttgcgacagacgtattatctgcaaataatgatagtgttgtttcttcctttacaatccatatatctttactttttaatcttctgtaccatttaggacttctagttaagtgtagaatagaagttgatattagcatacatccttaactttcaggctcctgattttcaggggaatgctttcaatatttcaacattaattataatgccctctgtaacttcttgtagaagcactttatcacgttaatcaaatgccccctactatttctaggttaagtgtttttgtttttaacatgaaagtaagtcgaattttattaaatgctcttactgcattaattggggttatcataggagttttcttccaaccgcatttggaatagtccaatttctaattgctaaattcctacccagttttcaagggtaggatcattccccactccccatcataaggcatcccttttcctctccctttatttcatagtccctttgtagaaggaaatcatatattcacttatgcatcccccaatgcccagcacacaagcacatagtaaatgctaacaaaatgtcggttgaattatggagcgagtcattcttgtggcactttatagctttgattttatactttcatatccacgtttcttttctcgcctctggactggaagctttagaggacagagtccacatctgatgattctcgttattcctctaggacacaatccagggactgattcagaaccttgttcaccaatagatgattccttgctttccttggtaaactccatcatcaaaaccatccaaccagtcttccaggagtagccaatctctcttcatagtccgctctgcagagagagaggtttatttcactctcaccctcagggaaccaggccagttctgatgactaagggcaaaataatttgctcctttgctgagattaatttctaaaaaatgattttgcaatagcctgggcttgactggccaggggtgaaggaaggagaaagaagccataaagagcatttcttccctctaatgaaactgaaccaaggacaggacaataagccagggagtcagccattgatgggtctttactcagcccttactttgttcccggccctattgctaggcattgtagaagtgggagagacatgctggcctctttcctgaatgcttggaatttatttttcaccttggaaacagaaatttcacatttgacaagttaaacaatacgacaaggccgtctgtttactcattcatccatttattcttccgttcatttattcatatagtgttaaacaatacgacaaggccatctgtttactcgttcatccatttattcttccattcatttattcatgtagtatttcaaagcctctgccatgtggtaggtattgtgctaagcactggggaattcagggttgaagagatgcctcccctggccttaggctgaataagggagttggttaattaaacagctccagtaccgtgtgatatatgtggtggtcaaggtatgttttcaagcactgaattggggaacaacaggatacagggactctcagagggagtaatgaatggattatcagaggacatgaatttggtgtagaagtttattatcaggataagagagaaggatatatgaaaagttggggcgacatggagagcacaggaagtttggaagatgatgactggcatgactagagttcagggacaggatggaggatgagaaggaagaaggccaggaaggcaggcagggaccaggcccttaactcacagtgagaagttgtgggagccttcacctcagggcatcagaagtcatttaaacatttcagcagggagtaatgtgatctgattcgtgttttaggttccaaaaggtcagagcagagagaatggatagggagagcggaaactggaatgaggaaggcaaatgaagaagagtgtttgagctgggacttgaaggatgcacaggattgactgagtaaggatgagagggtgtggcatcccaggcaaaagggatggcaaaacttccagtatagaaattgggaagcagtgggaggtcaaggtaccagtgaagagatcaggctgattagaatccaaggaaggtcataaagtttggaagtgggtggcacgcattagggggacatctgggggctcagaagcctgtagaaccaagtgaaaaggggtccagcaaagattccaaaatcttagaaattggagataaagcagtgggtagtgggaagagattagctggagatgaaaaaacctagattctagactcagctctgtcactaacttgctacatgagtttgagcaaattatttctcctctctaggtctcggttttctcacttataaaatgaaagtgctggcctagatctcttctagcactggtgatttaggatgccaagcactagcctctatccttccattcccaagtgtgtttgcatttgccccaggccatctcagaccgtgctcactgcctcactgcagcctgccaagctgcatctcagccagaggaagcagaattagtggatgagacaaaacaagacaaaaatacgcataatataaaccctcaaagaaggaaggaaggctgttaaagcatgaggcagggagaaccagtgatgaagataattaggaaaacctaattattggaataacagactcaatatataggttgcacaacagaaaggaaaagctgaagaatagtatatctgttagcttttgctgtgtaacaaaccactgctaaacttactggccatttattactgctcattgttcacatgtcacataagcactgctgttgagctggtcagacacagttgatctcagccttgctcatgcatttgtggctggctggaaggtctgctgggggctagctggtttgggatcatctcattcacgtgtctgacaattgtctggatgtcagctgggacaaaggagctgactgggtcacatgtcttttaagattattcagtatgcacaccagggcttgtctacatggtgctatgtttgaatgtgtcccctccaaaattcatgttgaaatttgatccccgttgtggtggtcttatgaggtggggcctttggaagttgattagaccattaaggccccactctcatgaatgggttaatgaccttaggaaagaaggttttagagagtttgccttccaccagatgaggacaaacaaaaaggtaccatcttgaaagcagagagcagctctcaccagacaccaatgggagcaccttggtcttggacttccagcttccagaactgtgagacataaatttctattgtttctaaactactgagtctgtggtattttatcatagcagcttgaacaactaagacatatggtggtatcaggattctaagagagagactggaagtgtacaaatggtcagaatatgtcacaaggccagccaagagtcaaggatggggaaatagattccattgatgatgcagagtagcactacaaaatggcatagacagaggaaggaatgagggattgtggaaattttttccccaatttattaaattgaattctctggccggagttattcacattcttcccaaatgcaaatatacctactcccattccagtaccccacaaaattctcactgaactatgacatcaaacttggagtcaagcttggatctcatgatctctctcagtttccaatgagacttttcaaatgtggctcctcttcacttgaagacccctgaatgaagaagataagtgacttgacccacacctcactaaaacacattggtgagacaggtaaagtgtagatgtaatgaaaacttttattcagaagggggaaataagaagcaaataacactcactggtctatagcactactgaaatccagctgggctaatattaacaggttttcctactgaagaggaggaaatattccttgattagacctaaactctgctccgtgggagtgacttctcagtctgttttttacctctgtcttttgaggccactttttgggattaccaagactggcctcatttgcagctgggtagctttctcaatttgattcctttctgtagaaagttggggaccagaagccctcttatatttgagccaccttagatttcagtccacatcttaatgtaggctggtagcacttttacatattcagctccattaaaaaccatgtgggtttcctataaatctgattcaagtccaacctatttgacaaaagtcatgccaattttctttgagatatgaccctctctttagacttattcacagctactttgggtttgtccagacagctataagatgatgtccttaaagttcctagaatttttttttgtctagaataaagggtctacttaagatgcagtaacttaattctgttgattttaacaaaggatgtctgtagggaaaattgcacaaagcttccccgggcttgaaaactacctgcctggatcatgacagttcctttggccattactaaggagccatggtgttcaaagcaggctcttcctacggacaggcagtataagtattgcctatgaagtgtgctaagagaggaaccaggaagattccacctcagactcaaaaatcttttttatttctcccattccttaagttccttcaatgtagatggattgcttttggtcaattgcatcaattgcattaatctgtcacagagggtctatcatgcatggccattgtcatggataaagtaccttaattactttgctcagtgccttgcccttagaaagtgctcaggatatcttagttccctcctcccagttcattcctacttttcctgaggcttccgtcttgcaatttacgttacaccacaggagggaatagagtaagggtctatcacctccatgtaagtgagtttgttggttggttccttgaacaaatatttatggagtgactaccctgtgccaggcactgggactatgttcctgaatgaagtccctgcctttatggagcttacaacaacgtaggggacagagagacagaaaataagtcaacaacccataaaataatcacagactgtgataacactaggatggaaacaaggtggggggctgagactgggcagctggggaaccctgtatgactgatgatagctgcgaatgaggaggagggaagggaaggctggagaggaatgagaaaaggaggctgaggacaaacaggcttcctgtgcctcctccacgattttgccccatgactgtggaaaggacactttagttcaagtaaacacataaatctggagaaatatgatctgtcatagcaaatgcaacacatttagtcaggattccctcaaggattggagcaatagacttgggtgtcaggagccctcagttttaatgctagcatagccccctattccctgtgtgtctttgagagagtcccctcccttctctggactcctggatcctggagtctatactgagtgggtgggactcagtgctgtctgaccacctacggcttgatgaaatgaccagcaccttccatgggagttttagcatagctccagaaggcttatggctctgtcattgctgcccatagctgttagaattcctccttctctgcccggttgtgcaattctctgcctcacttcattgggttccagctctaggccatcttttcttttaagtgtttagtcagagcccagacagttggcaattcacagtgcccctggtgcaatgatgatttggcctggatgctgttccagaaagtcattgataactcttagttcaatcagaatgcttgaggagtaccatgttctgtgcatttaaaacattcttctccaagaataagaacaagcaatcaaaatacacatcaaaacaaaagccaccatttatttagtgcctactatgtgtcaatgagctaagatcagtgcatttcattcttgcatcagtcacaggaaattgccacaatttcatagattagaaacttaagctcagagactttaaaccagccaggggtggaggcatgatcctgatccatgaacatccaactctggaagtccagtctctaccatcatgctgttttacaattcttttcaccagctgcatggaagaacagcaggaaggccaggtaagggtgggatctgcctctgcctgactctccttgtctgaatcttccctttttgctgggctccaccagcaaaggagtgttgctattttgaggtgactttctcaagctcacctagcaagcactcctgggaaagtattactcaaccgtatctgtggtcacaacctcgaagctgatatctcctttccactttcctaaaaccatcgagtaaagtagagaccctgctcttcacataacttcctataagttggtgacataattcatttgaacttcaaatacagacccttagatggcaccatggccatgggatgcaagaagtgagaaccaacatgacaggtgtgattgtgccgggtccctttaggaataaacctcccaagagcagggatgttcaaccatcagccatcagccatctcaatgatatataattcaagcaacactgttacatttatctctgcctctagaccttcgatcaatcatctgtatacgtcatggggacagggcttcccaagatatagccctttcagctgataagaattggatgttgggatatttcagtgacacagaactgcactagaggaagttgaggggcacgacagggcttgggatttgctcttctaacagcagaatcatgtcttccagctccggaatcattccacgtctccattctcttaacccaatgtcagctgcatccaaggctggttttgctctcggtcagaggacagcggccaatggcagcaggggctgtactcttagacgaaagactgtttttcaaggttttatattaagagacttagaaatcccccaggaagcttttccttggacttcattgaccagaagattaatagactctccattgtggtttacagcagtcaaagcccacacatcttccctgagtcactcatgagtgatattgagaggttaagacctgaacacattcaggcttcggtaaggatggagtaagatggctgccaagaggcagccaacagcgtccacagttcaattccctgctggtctagttatagaaactccaaattcctgaacttagattctttggacccgcacatgagcttattaattaacctgtgattctgtggtgtgcagtagcttgttctgaaatttgggtacagggtgtgagggtcagttcaccatagcccaggcagatagagaggaaatgacgtggtgagctggggcttgggacaatatccagaagggcaggacaggcacttggacacatttttctcaaagcttaggtcttagttcctctgaattagaatcacatgactgtgggggggagtgagatggggtgggacagaccttacaacatagattcatagaccttttgttcagactctctggggcgagggtccaggaagttgcatgattgacaggctctctgggtgattcttaagcaccctggagcagagcttatgctgagctgtagagactgactctggaaatataactaagagggtaagtccagggcaggagtcttcatcacaattcatcaaatagttggtatttggggtccaaggtgagggaattggtcccaatatagtgacaaagaatttaagctgggttgaattgtcctgggtcaggccaggcagtgagcgatgatatttattcattgcatttttcaaccaacatttattcaagccccttacatgataatccctgaagatacagatcaaaaagtccctgtttcaaagagtcccagtgcagtgtgttggggagatgcagacaagtggacaggtattcacattacatgacaagggtcatggtgacacacaggggctctggaagcactcaggagaggcctagtccagtctagtggggtggattaacttcctgggcctgcaaattaacaagctattacagacctggtggcataaaatcacagaaatttattcttacacttttggagcccagaatctgaaatcagtttcactgggtcaaaatcaaggtgtcaggcctccctccagaggctccaggggaggatttattccttggtcttccagcttctggtggcagccagcactccttggcttatggctgcatcactccagtctctgcctctatggtcacattgcccccgcctcttctgtgtctactcttttccaccttcctcttacgtgaatacatgtaattgcatttaggtcccaagtgggtaacccaggataatctccccgtcacaagatccttaatcacatctgtaaagctatttttgccctttaaggtgacatttacaggttcatggatcaggaactagatatctttgggggatgttatttagtctaccactgggggcaaggggaaaggaggctcttgacatgagtcaataaggagaagtaagaggtagccccatgcagtagataagaaagaacattctagaaagagctagagcatgcacataagcgcccagatctgggaactgcgaataggttttatgaatggaggctcacagcacagaggaagggtgctgaggtgcgagaagaggtggaggaggtgggctagggtcaaaggatggagctcctggggcgtgggctatggtccacagctcatggggagtcatcaaaggtgtgtgagcacatgagtgacagcagcagacttgcattctgcctgtgctgtggagaatggattccagggggaccattcagtaggatattgcagtggtgctaggtggaatatagttagacctgaacaaagcaggtgaatcgagacaagtggaaggatctgattggtggggagaatcaacacaagactcccaggtgtctgacatccatggataaaaaggggcccctgagggagcatctgggagaggaggggacggatgaagccttgcccaatggacatgttgatttgaggtgttcattatgggtcgccaggtgtctgggaagcagaggaatgtatgggcctggaaacaaggagaggaatctgggctggagacttggattcggatgcccacacatgtaggtggtaggtaaagctgtggctgtgaatgttgtcatctcagaagacaaggagtaaggggatggattgacaaaaaaggccttcacaagggagactggaaagatacagctgtggaggcaggagaagtctcagaacttagggcttaatacagcgtgcatggctgggatctttgcattttaaagagagattggggaaaggatagtgctaacaccaatagcgctaggtttgtaatggtgaaatctgggggctctgtgggaggaatatagggtaactgcctatacacatgacttaaattgtgtatacaggcagttaccctgtctgtttgctggcccagccagttgtcagcttgttggcagcctctgtgatacctgagtgcctgtttgggactcagggaggccccagtagcatcaggaagccagctgcacttgttgttgactcttagcacgcattatacaccaacagcatggctgaagtagaatccagggttgcaggatgggcaaagagagagccatctatgcttctcaaatgtcttgtggctattggacctgtgaagtaagcctcttcccagagtccttttctgtttctgctcctccttatctcacaggaatgttgaggaattcagagtttcagattgctaaagcaggtacttaggtgagcaatctgagatccagagggtggaagttctttctttcagaggagctggtactgattatgtgacagccttgagtccccccatcagagcccactggtgtcttcttcagggtctggtctctggtactgagatgatgatcacaattattaacaatgacatacttgctttcagttttttttttttttttttttttttttgatggagtctcgctctgtcgcccaggctggagtgcagtggcccgaactcagctcactgcaagctccgcctcccaggttcacgccattctcctgcctcaacctcctgagtagctgggactacaggagcccgccaccacgcctggctaattttttgtattttttagtagagacagggtttcaccatgttagccaggatggtcgcgatctcctgacttcgtgatctgcccgcctcggcctcccaaagtgctgggatcacaggcgtgagccacctcaccaggccaacaataacatactttcttaccatcttaggagggtctttataccttcatatttgctcaatctccaaacccatctgataagtatgaaaaatgctgtttatagctgaagaatcaggctcaggatcagggatttgtctaagacccaggcccagaacacaggtcctcttgactctaaatcccgcgatcctccccatccctgtgcagctctaccacagggttgcagggctccgggttgcaaggcccagtgctgatgacacctggatggcttgctggagactccaggaccatgctacaggctgttgagaactgctgggcacctgccaggtggctctatcagaaagtggggaagccccacagaaaggcagggaggggccacaaacacagacgacttcccacctttgttttggaccaactctgggctatctgacagagcagaatgctttgctgcagctgagaacatgtttctcggccttaagaaataagctcttaagctttcagcttttaaaaatgtaaagcaagtaatgcattcaacagacatcaccccatcactgaggtcttccctgtcatccgtccctaagtctcaaaccatccatctttgagcctccgtggagcctgaccattgcttgcccaaatccggagcctcagcctggcacatacataaacccttcccttacccctacccaaagatgaaggctcactcttcttgtaccttgcccattcttcaccacagacctgatctgtccctaccaaatcttgagcctcatcccagccttgacactaactgcatcccttacccaaatactcaccttcagtccatatcagaccccatctcatccctcaccccatacccaaatctaccaccatgcctcacaccaacaatccgtcccttacccaaaccccaagacctaactgtacccccattacaccttaatttcattcttgagcctcggtgctaggggtgaagggggttattgcacacatcaccaggaaatttcagaaatgcccaaaggttaatcatttctttttgaggctctcaaaataagtgtggctatcactttgtccaagagtcaaagtggctgcattaaaacaacactgcccaaaactgaggccaaggtgtgagaagacactgtgcaatctccctctgcagtcctgttgttctcagatcagaaggagagagttgttttgcgttcagtaaattcagtcaccatgtgagtactacgaatggagcctgagacaagtgcagtcattattttgtgtaatgacatggtgttggagccaccgctgagaaggaaaatgcaggcacaaaccatccatcttttcaagcaaatgagaaaggttcatttttcagatctgctactgttccttaggaacttggtattttctatccttccaattgctcattggattgtcttccctatgcctttctaaatgattgactttccaaagtgctttggctccctgaaaaatgaaaggggtctggaaatatcaggtgtgttataattacctctggcagcaccattgggtaggccaggcgactctcatctcaacgtgtctgcattaactctagccatctttctttggaaaaatgtcagcatgattagcaatggctcccacaatgaattggagggaaaaaaatcaccagtcattatatttttttaaatgaatttttctttttttgtatcagccccaagttagaattttaatttgcagaaactcccaagaaatttcagtcagtgttgtagttagaccaaagcttgatttaggttggcacattaaaactcactcctgcttttaaagtgctgtacactttccagaataatgatgctatccatccctcacaatatccctgtatggaaggcactgttacctgcttttcacagatgagggaatggaggctcaggggcttcagtgacttgtccagataggggagggtttctggtgccccatctcctgagcacggacctgcactcttgccagcatggtgctgactgccctggggagggcagctaaagcccacgaaggcctgggtgacatgtcaggtatgactgccctggaagaggcagtgtagatatcagccaggacatgatgacaaacttagaaattcagttcactttgctattaccaaatatctagaggcttcatgtgatgccaactgaatatccagatttttgacccacttgttttttgtctgggtcattgttaatatgtgatcttttgtaacagaaagagccccatgctcgatctccatgatcttgtttaattcttgcaataacactttgagagatagatacaattatcctcattttactaataagaagttaaataacttgcctgagattgcacaacttcggggcagagtcaagatttgaaccaagatctggattactcttacccactacagtaaacctattctctgtaggtcagaagaaaatggaattctagtttgagctttttctttttagttctgtgtcctcagatgagttaacaaattcattgaatatttattgagtatatgttgtttttttttttgttttgttttatttttgttttttgttttgaaacagggtcttactctgttgctcagcttggagtgcaatggcgtgatctcagttcacagcagtctccacctcctgggttcaagcgatctcatgtctcagcctcctgagggctgggactagaggtgcaagccaccattcctggctaatttttgtattttttggtagagacaggtttcactatgttggccaggctggtcttgaactcctgacctcaaatgagtccacctcggcctcccaaagtactgggactacaggtgtgagccaccatgtctggctgagaatacatttttaaacaactgatgagcaagcaactcagttgcaatgactgacaaacaagtaaattccttcatctcatggatgagaatccatccataaacaagtgagttgggcaagtttttctcaaaggttctttctagagctcatatagtatgagtctgtgatgttgacagtttagatttgcaacagagtcgtgcccaaatctctcagatgtgcatctcggttttcacaatgtcaaaggtgatctctcccacacttcagagagattccctgaattcagcacctgtgagaagttatttatctcctctatgtactatttttatacagctacctgatttaatccctaacaccaaaaactcgagctgtgttattatcatcttaaaaatgagaaaatggagacttggtgattatagccacttgcacaatgtcatagaactaatacaagacaaagctgggtcttgacgttagaagaatcaacacaacagctgctgcaacctagcatgcactgtgggagtagctcaggcccctggagaagctggcttagcctgagaatgcatcaagctcattcacccaagcttctagaagcaccattcagagacgtttggtggggtcacaggtcacctgcctccccacagaccatctgacatttgtcacactagatcttttttattctccttgcgaccttgtctgtgagtcagcccttgtcatatggtaagacagactagcaagaaatggagctgtccaggtgatcttttagaacctctgagattcctgctgcatgacacaaggatactcagtctccctgaagcccacctgtctcgggctaagaaatgaatgcagccttcaggaaacaaatgtccccactacttgaatgatgtcacttgtatttcctgaagtgtgacagcctctcgctcctgacaggtggtcattatgcctcatcctgggctacatcactgtccttgtaaagaaatgaggttgaagcaagtttcttcatttccacagctaaagagcttctggataatatctctgccatgactaaaaccatgcaggggaacaaaataagagttgatttatcaaacattcagtaactgaaaaaacagagttggagaatctatcaaatgactacgtggtaaccaattctagctagtagtttaaggtggctttgttttctgtttgtagctagaggcccagagggaggaccctgagctcaggaagtgaggatgctggtaacatagcatcacacagaaaagaatggaaaggccaggcattattattacggctgacccctttcattctttcttttactttccaacttctttctgcctgacttccccaggaaagtcttcccattttccttcactgtgaatcaagaagcaattgtaatcatggtcagcacatactataatcatcagggtacagacacttatcaagacaagggacgtggccatttcactttgaaatcaaagtgaaatcaggtaattcctgaaagttcccagactttcctcttagaaatattgccaaaaaaacttcctactcatcctgctttaattacacacaacacagttcttcatcaagtgtcaatattcataagtagaaaatgaagtctttttcaacattattatgtttccaatggatttagtttctactgtggtaagagcattactttgcaaacatatttgaacaaaatcctatagtattttgatgaccttcttccttctagcttttgtgggctagcctgggcatctgatggacatttaggacattacttcctgtggacactgggttctgcattcaaccagccaatttacaaatgattctttggaatatagcttatctgctgttgtgtgtagaaaaataaaattgtcatctcagtttctcgatgtggaaattaagaaataaaatctggagtgttggagctcttgtaccaatgcagtggcagctattccttttcccttctttctctgaacaccaacagggagaagccacctgcccatctttgctggtcttctcggccagttcttgtgtcttcactgagaaggagctgtgactggaggcagaggccaggcccattcactgtttttaaatggaaatataacttacatacagcaaatcatatacaactgaaatgtacagctcaatgaaattttgcaaatttatacagctatgtaacacaatctacatcaaaatgtagaataacacagcatggcagcaggtttcctcctcaatcccgtgccagtcaataccctccgccccagtggtagcccgctattctgacttcttttaacatagattagtttttggtccacttacttagaaaactttcttaggttgaggtataattgagaaacagtaaattgtacagatcttaactgttaactttaatgagttgtgacaacatatacctgtgtaaccagtgcccagaacaaaatgtagaacatctccatcaccattggcaattcccaatgctccttccaataaatcctcatccctttttgttttgacagggtctcactctgtcacccaggctggagtgcagtggcatgatcttggctcactgcaacctccacttcctgggttcaagtgattcttgtgccttagcctcctgagtagctgggattataggcacccaccaccacacctgggtctttttttttttttttttttgtattttttgttttcttcgtagagatggggtttcactatgttggccaggctggtctcgaactcctgacctcaaatgatccacccacctcgggcctcccaaagtgctgggattacaggcgtgagctcttcctttccttagcaactacttcctgatttcaaacactgtatagtagttgggcttgttctccgatttcacataaatagaatcatccagcatgtgctctttagggtctggcttcattcacttgacatatagacatatacgtatttttagcttcacctacagtgttgcatgtatcagtagttaattcttttttcccactaaggaaagtttttttggctccatttcttagattcagaagctaacaccacaataacaaaaatgtcaaatacatataatttgaccccaattgtttaaaaaaagctcaaatatacacttataccactgagacaggaaaagataaatactgtgtactaaaaagtgctcctggtaaactctagacagtgagagattatggatgattgctcttcttctttttattttctgagtatttcagtttctacattagcatttttttgcatttttaattgtggtaaaatacacatttcaaggatgtaatgtatagtgcctatttccggacttgctagtcttttctattgatttatttacctatccttacaccaacatcaccctatcttgattattgaagttttataatgagtcttaaaatcaggtagtcaaaaggcttccaaatttgttcttcattttcaaaattgttttggctattttagatgacttgcatgtccacatacattttagaactagtttatctatttcttcaaaagagattgcttatatgtgatatggattatgttaaatctatacattaatttagggaggatggaaatcttaaacaatattgagtttccaatttacggacgtgctatatctctccacttaggaatattttaattttgcaaagcaatattttataattttcagtttatagatctcacatacctttcattagatttattcctgggtattttattttggctagtgttttgatgctattgtcagtggtatttgttttgtaatataattttccaattcttactagaatattgaaatgtaatttatttttgtacattgatgttacatcctgaaaccttgctaaattcacttattctagtaattgtttaatagactctatatgatttctaaaacagcttgattgagacataattgacataccatttaattcacccatttaaagtgtgttcttattatattcccagagctgtgtgactatctccacaatccagttttagaacattctcatcacccccacaagaaaccctgtgtgatgaggagcagttaggtctcatcctcctctcatctccacctcacagccctagacaatcaccaatctactctttgtctctatggatttctctcttctgaacatttcatataagagcaatgatacaacatgtagtcttttggggcataatgttttcaaggttcctacatgttgtagcatgtatcattcatttttatggcagaataacattccgttgtatagatggaacagattttatttatgtatacatcagttgatgaggatttgggttgtttccacattttgggtattatgaatactgttgaatgaacatgcgtgtgcaagtttttctgtggacatgtttttgcttgcctcatttttatcctttgaggaactgccagactatttttcaaagcagccatactgttttgcattctcattagcagtgtatgaggttccaaatttctccacattcttgccaacacttgttattatctgtctttttttactatattatctgtctttttttactttttttactatattatctgtcttttttttactacttttttaccagtagaaccaccagttctactggtgggtgtgaagaggctttcactgtgcttttgaattacatttccttggtaggtaatgacattgagaatcctctcatgtactttttggtcatttgtatattttttgtagaaatgtctactcatatgttttgctcatttttaaactaggttatttgcctacttattattgagttgtaaaaattttattttttaagaagtattctgaaagtttcttatcagatatatgacttgcaaatatagtctgtgggttgcctttttactttcttgatgacgctctttgaagcacaaaacttttaaattttgatgaagttcaatttatctatttttcttgtttgtgcttttggtgtcatgcctcagaaccagagttttatacatatacaatcttgttgtctatgaataaggcagttttacttattttcccaatacttatacctcttatttatttttcttgctcactttcactggctaggacctctactacaatgtagaataaaatcaatcagagcatattcttgccttattaccaatcttaggggaaaatacttcaatattttattattaagtctgatgctagctgtgtgtcctctatcatattgaggaagttcccttctagtctggcttgctgaattttcttttcttttctttttaaatagactttatctttttaaagatcagttttagtttcacagcaaaattaagagaaatttacacaatttcccatatgttcttgccttgacacattcatagtcgcccgcattttcaacatcccccaccagagtggtgcatttgctacaactgatgactctatattgacacatcatgatcatatccaaagactatagttggcattaggaatcactcttggagttgtacattttatggatttgtataaatgaataataacatgtgtccactattacagtatcattgagggtagtttttctgccctaaatcgtctatgatctacctgtttgtcccttcctccctctaacctctggcaactactgatctttttactgtctccatagtcttgacgtttccagaatgtcatattcgaatcttacagaatgtagcttggagcttcattcatgtggtaatatgcatctacgtttcctatatgttttttttattcctttttagtgctaaataatatttcactatctggatatatcacattttatttacctattcacttactgaagaatatcttggttgctttcaagtttttgcagtaatgaataaggtgctataaacacctatgtgcaggtttttgtgaggacatcttttcaacttcttaaagtaaatactatggagcatgattgctggatcatatggttagagtatgtttagttttgtaagaaactgccaaactgtcttacaaagtagttgtaccattttgctttcccaccagcaatggatgagactttcttttgctccacatcctcaccagcatttggtgttttcagtgttttggattttggccattctaataggtgtgtaatgacatgtcattattttaatttgcattattttgatttgcatttaatttgcatcgatgatatatgatgttgagcatcttttcaaatgcttatttgccatctgtatatcttctttggtgaagtgtctgctaagatctttggcccattttttaattgagttgtttgtttttttattgttcacttttaagagttctttgtgtattctggacaacagtcctttatcagttatgtcttttgcaaatattttctctcagtctgtggattgcctttttgttctcttgatagtgtcttttgcagagcagaaatattaaattttaataaagtctaggttatcaattatttctttcatggattatacttttggtgtcatatataaaaagtcattgccaaacccaggatcaactagattatctcctatgttatcttctggggttttatagttttgcatttacatatttggagttaatttttgtgaaggatataaggtctgcatttagattcttttttttttttttttttttttgcttgtggatgtccagttgttccagcaccatttgttgaacaactatcttttctccattctcttgccttttctcttttgtcaaagattagttggctatatttatgtgggcctatttctgggcattctgttctgttctattgatctatttgtctattttttcataataccatgctgtcttgatgactgtagctttataataagtcttgaaattgggtaatatcagtcctataaatgtattcttttgagttttctttttttcagtgtagtataaccagatttttgtttattgaccttatttacactgattatatagagactgaaattctactcaaacaaatatattaaaagctctaggtttttagggtataggagatgtatttttttctgtaaacccaaatttcaaaagaaaaagaaaaaccagcagtctatgaagttactgaaatatcagattctatttttggcatgaggactattccttactagaggtaaagcagaaaagaaatgggagaaaatttttgcaacctactcatctgacaaagggctaatatccagaatctacaatgaactcagacaaatttacaagaaaaaaacaaccccatcaaaaagttgagttttctttttaaaccagaatggtgttgagttgcgtcaaatgttattttgcatctattaagatgatattgatattttgggctatataactctctgatgaaagggggttgtcctgtgcattatagaatgcttagtttcatgcttgacctctatcactagatgccagtagtaatccaattgtgacaaccaaaaatattctgacattgctaaattcccctgcagggcaaaatcacccgtggttgagaatcattgctttaatacatcactatgaagtttaaaaagtatgtttcaatctattttatactcctccttcattagttggagcttaattgctctgtcttgagtgtggactggcttagtaactacctctagttggtagagtgtggtggaagtaactgtgtgacacttccaagactaaattataaagggcattatggttttctcctagctatcactccgggggaagccaggtgccatcttgtaagtacactcaagttgtcctaaggacagatccacatggtgaggaatgaaggcctgctgccagtaactagcactgacctgccaggtgtgtgagtgagccatcctgtaagcagatcttccaagcacagtcaagcattaagataactacagcctctaacattatcttgactgcaatgtcgtgagagatgctgagccagaatcatccagttaagctactcctaaatcctgacccatagaaactgtgtgagatgataaatattcattgttgtaagccacgaaaggtttggagtaatatgttgtgcagcagtagataactaatacacttacactgactgattgtcaaatattaaaccaactttgcattactgggacaaaccccactcagtcatggtgggagttttaatccttttgtacaaaaaggattaaatatatgtgtatgtatatgtatatgtatatgtatattatgatatatagttgattttaagtctcctatattggtatttattttctttttgccttatttattctgctttcctctattttttcccttccttcctttgggcaaattgtgtgtgtgtgtgtgtgtgtgtgtgtgtgtgtgtgtgtgtgtgtgtgtcttgtatttgattttatctcctatattgacattttagctgtacctgattttatctcctatattgacattttagttgtacctgtttatgttctttttaatggctgttctagagattataatacttatctttaagttagcacaggttacttgcaaacagtgatgtagaaaattacaacagtataattttatttatgcccctcctgctattcgtgctcatattatcttatattttactttcatacatggctcaaatcctataacatattgttattatttttgctttaaaaatgatatccttttaaagaaaaaatataatataaacaagtcttttatacctatccagatactgaccacttctagtgttcttttattcctgccaatctagttcaatcttgtatcatatcctttcagtgtaaaaaccttcttttggcatttgcagctttaaatgtatctgctggggatgaagtctctcaacttatgactactaagaagtctttattttcccttgctatttgatgtatattttcactggatatgaaattgtaggtcaatggcttttcaacctgttgttcttttgtttaaagatctcattctgtcgtcttctggcccccatttcctgctaggtcagccgtcattggattgttgctcctctgtatgtaatgtgtctttctgctctgcatgttttaaagatttgccttttatctttggttttcagcaatttgcatatgatgtacctagaggtgattttatttgtatttgtactgcttgggttttagtaagaatttttggctttgtgggattgatggcttcatcagttttggaaagttcatggccattatcgcttcaaatatttattctgcttttttttctcctctcctcctggactccagtgatatgtattttggacatttcatattctcctttggattccatttgctttattctgtcttttaatttcactctttttctctttgtgtttcagcttttatactttctactgctccatcttcaagttcatgataatttcttgtgctgtgttcaatccattgttaggttcatctaatgaattacttatttctaattttacaggtttcatttctagcacatgcatttgattcttctttgtttttttttcaagagtctgctaaaatttcccatttattctcatatgctacccatcttttccactacatcttttagcatcgttttcacagctattttaatgtccctatttgatcatttaatcgtctgggtcatctttagttctgcttctattgaccatttcccctcttgaccataaatcacatttattgctttttcatatgtcttgttatcttcagttatagaaaaagcattttgtattaaagaacttagagattaaaaaaatactatttctgttaggctgctagtgtgggggctgacttaattggatttgaaattaagcagggtttgggctgtgttatagccttcccttgatttagttcactattggcttcaaattatttgagggcaagatcattaatttcctttcagcataggttaaatcattggccatgtgcttgaattcaatctccagccctcatccttctccagaggtcaggctggcccaaagttctgaccctctttgtggtgaccagccactaacttgaagctatctaggagcctaccgggagtcaattcagtagcattccaaagacagctctatcactgagaaatacctagggtttttgaaactctgccaagaagccaggccaaagacctgatatattctccattgcactacaaattttctctcagctttcctgctcatacctgcccttctgagggggacttgcactaggggagcgatcccggcctcatgtaccttattatagacccctctttgctcttctctggcctcattcactgttttgggtgtgttacccccaacacttgctgaagactcacagggtaggagatagtgagtgagtatacattcactctgtaagtagtgctcttcaggtttctaatcagtcatgccagtccaaacaccggtgttataagtttgttaaaagttcagctgatttctccttacttatttctatggaagattactttttccttcacagttccaccaactatggaggaactctgtgttttttctctcctgtgaagggctcatcactttccagagtttagttcatttacatttctttgtgttcatgctctctgttgagttttttaaaactaagatattttagcttttattatatatacacacacgtgctgtatatatgtgccacacacacacacacacacacacacacacagaggctcggggaagtttgttagtaatggtcttttgataactttccacatctgaacacagcctgttcacttttacaaggaataaactaggagtagttaattttttttttttttttttaggcagagtcttgctctgtcacccaggctggagtgcagtggcgcaatctcggctcactgcaagcccggcctcccaggttcacgccattctcctgcctcagcctcccgagtagctgggactacaggcgcccaccgcacctggctaattttttgtatttttagtagagactgggtttcaccatgttagccaggatggtctcgatctcctgatctcatgatcctcccatctttggcctcccaaagtgctgggaattacaggcataagccaccgcgcccggccaaaaattttttaagtggaaattgcatttattttaactttattttattcaatacatgataaggcctcttttgagtagctcttaactctttagagacccctttaatggctcccttctttggatctctatacacaccattcattttgtctcagcaatagcaaacatcaggcatgcaatttgcattctggcactgtagactaccgctatccacacacacacacacacacacacacacacacacacacacacacacggcagccagggcagaaattgctaatccatctgtaagcattctttcttgttgagactggatgagtcctccctatcctcaacacaatgtaccaggcaataaatttgatttggtccataggagtagatgtatttgtcaccctggtttcaactcagagatggttttcccccaagttgagtacttgggtgtgctccaagaaaaggtttgtaatgtggggcatccataggttgtaggttactttcacaactagacatttcaaagaggatcagtggatatggagttcaaaacaaaatgaaaatgaatttgtagacactagggtgaaatgatctgagaggagtttgtgctggtatcatgaaatgcacgttgagagctggagaatatgagcctaatcttggcctttcaggttgtagtattcttatctgcacagttagtgggtgggaatgggagcagcaagaccccttatgctacatatctctaggtccttcctggcacttgcatcaaataatggagaacactgtaataagatgacattgctaagcttcattttattccactctgttaacccctattctccccatcaccattcaagcagcagcaaaggttttgcatatatacttctctatgagacaaagaaaatagagtcaaattcttgtaaatcttcacttattagctggaatgctcctgtaaagagaagctttctctcacctgctatctggtcagagctagagctgttacggaaaagacaggataaaaatgctgaattctttccttctatttaaaatgcttgattctttctatttgccagttttcaaagtaacaagttgattgcatctctagcatcttcctacagttgttacttttttttaaagcttcattgtgaacttctgaattttaacgcattcaatttttatatgtggatataaaaatatggatgtagccgggtgcagtggcttgtagccgggtgcagtggctcagacctttaatcccagcactttgggaggctgaggtgggcggattgcaaggtcaggagttctagaccagcctggccaatatggtgaaacccatctccagtagaaatacaaaaattagccaggcatggtggtgggcgcctgtagtcccagctactcaggaggctgagacaggagaattgcttgaacccgggaggcagaagttgtagtgagccaagatcatgccactgcactccagcctgggtgacagagcgagactgtgtctcaaaaaaaaaaaaaaaaaaaaggatgtacttgatatttctatgggttcttagatctcaaatactaattgtcaagtaaaaactctcaatgcaaattgatttttctctactatctaacactaataatagctactgtttactgaatattttctgtgggtcaagacctatatgaagatctttttatgcatcatgttatttcatctttctaaaaatcctatgagctacaaatattactactattactacaacttgttttaaagaggaagaaatgaaggttgaagaggataaatcacctgcccaagatcacaagcaaattgaagttgaactggaatttttaactctaaaaccagatgtcttaatcacaatttaagtttccaagtcacttggttgatggcgaattagggaatgatggagtttggatgagaaatgtaccaattgctatattaagctgaccatggtgagaaggatacctgggagccaagatggaaaggggtgggggctcagcagggttaggcagaaatgaggatgaggaggacagacctggtgccagttccaggaggtgaagaaggcttgaggctgggagtgagctcatggctctgaggagagagctcgatggggccgttccaatgagacctggcagtcccggctccagtcctctctgtctgtcatgtacctgctgcatggaccttggcaaatctcctgcatctttgagcttgtatcttaaaaaattttttttttatttccgtagggttttggggaagaggtggtatttagttacatgaataagttctttagcggtgatttgtgagattttggtgcacgcagcactcaagcagtatacactgaacccaatttgtagtcttttatccctcatccctttcccaccctttccccccaagtctcaaaggaattgtatctttcttatgcctttacatcctcatagcttagcttccacttatgagtgagaactacgatgtttgattttccattcctgagtcacttcacttagaataatgtctctgatctcatctggattgctgcaaatgccattaattcattcctttttatggctgagtagtattcctttgtgtgtgtgtgtgtgtgtgtgtgtgtgtgtgtgtgtgtatgtgtgtgtgtatatatatatatatatatatatatatatatatatatatatatatatatatatcacagtttctttatccactcattgattgatgggcatttgggctggttccacatttttgcagttgtgaattgtgctgctataaatgtgtgtgaaagtacctttttcatatgccttgttttcctcaggtagatacccagtggtggcattgctggatcaattggtagttccactttttgttctttaaggaatctccacaccgagcttgtatctttatccctgctttaccttccctgaagttgttatgagggacaaatgaggaattgatgtggccaggacccacgactcaatcattttacctgttggaaattattacatgaagataagagaaggggagaagctatgtgctgatcagtttggtttctcacccacagagagctttttcatatcactttatgtctcctactctcacctcaagcctccctaacacatccccctccacgctggctactggccagcagatgaactcaccttgttcttcactgagaaaatagagctgatccagacagaaactgtcccctcccctatccaatccacctgcatctgtgcctgtgctctgtgcctgcccgcctagtcttgctcctatcagaggccacccctcacctgagttctgggtcctgttcccttcctcctcaaggccttctctcctgcagtcaccccactctgctggagcatcctaagaatattcaaacatgctctagaaccttccatcttgagaaagagccacaaaggagactcaaccgaccactctctctgtccccatggaaagcattctcctcccatgctctcacactatctcattctgctggttttcttcccacctggctgcgtgcgtctatgcactctcctcggctccctctctgctacctgccccctaaatgatgaggtgccagggccctggcctgaacctccctctctaccaaccttctcttcatggatgtaagtgttttctttctgctcataacatcttgagtgcacaccttccctggagtttcagaccattcacctggtgaactctatgaaatctccgctcagatgtttaataggcctctgaaaatacacatgtcaaaaatatgaccctctgtttttctgccttcctgccgccagtcaaacctgtgcttcctcatctcagtgagtgacattgggcaatcactattcatagggttgctcaggccagagtcttggaaataatctctgattcctcccatgtgttcctccaccacatcccattgattggcaagttgtattggttcaacttcaaagacatctgcagtcagtccattcctgccatgcccccttcacccatcaccatccaagtcaccaccatctctcgccggtgtcctgctcccagccttgccctttttaccatcgttttcccacccagcagccagagacatctgttaaaaatataagccggctcctggaagctggctgctgtggaaggcagcttgggtgagagcactgaatgatgagaggccacaagcaggggcaccgaagtgcattcccccaatgaaaagctgacactgacaccccagacctgtgagtgagtccattgtggatcctgcactcctgtcgaccctccccagctgacaactggtggagctgagatgaaccgtcccactgggatctgcttggatccctgacccagggagtcatgaacaaccaaatggctgctgcttcaggccacagagaaaagtgtacaatagatcctgaccctttgctcgttatccctcatgagtgatttcctgatgcacttgtgttaaaatcctaattccatgccatgccttgtaggcctttgatagttcctgcctgctgctttcctcttttgctccatgctgtggtcatacagctgctttctgttcctcggtcttgccgcctgcgtgcctatctcagggcctttgaacctccccttctctcagcctttcttgcagctcttggcatgtctggattctttttatttttcaagaccccactcagaggccatttcttcgagaggctttctctgatcaccctaaacactcagaaacatcaccctgtctattttcttcataacacttcctacagtctggagcaatcttatctgtagaatgcatgtgttatctgtctctcccctgctctctttgagagcaggatttggtctgtcttgcacctgcatctttgggggtcaacagcttgacataatgtagacctctaacaaactgcaataaacgtgttattgggaaacaacttaataggcaaatgattatgtgtattagggcagcgcttaaacttcagtaagaatgtagattacctgacaacctcattaaaatacagattctgattctgtaattctgggagctctagggtgggcctgagactctgcattgctcacaagcacccaagtgatgccagtgcagctggcccatggagtacactttgagcaagcaaggcaaggctgttcgacctttgtatacccacggtgctatttaacagttgcacaaacgtatttgtttcagcaggaagggaaaataacgacagaatccttatcctctgttcaagtatcatttccaggtatttgcaattggtacctttatgacatccagggatgtctttgggggccacctgttttttttttaatttttaatttttatttatttatttatttgagatggagtctcgctctgtcgcccaggctggagtgcagtggcgtgatctcggctcactgcaagctccacctcccaggttcacgccattctcctgcctcagcctccggagtagttgggactatgggcgcctgccaccacgcccggctaatttttttgtagtagagacgggattttaccgtgttagccaggatggtctcgatctcctgacttcatgatttgcccgcctcagtctcccatagtgctgggattacaggcgtcagccaccgcgctcggccggggccacctgttttttaagtgtgttgcatctgtctttaaaagctaaggctgcttatccgaattcaatctctgactgctttctgtgccttcagggatggctgcagctgcccactgagtggcctggagcttgccgtgacacagggaagggaccatgcctgcctgaggatctgactgatgtccagggttgatgttagcctggcgtgggggatcccagtcactgatggcctgcagtcatgttcatgattagctaatgtctgtaagactttgagtcaccactcacggtgattcagagtccattgtgtccatcgggtttcctcaagcagcgttgccatctggcctctgtctggggataatttctctgtcccttggtgccagaattagcctgtctcttccctataggcaagcagagtgatgcccagtgcatcccaggcatcgtgccttccttcgcctcctgggttggacaccgtgacttcggccgtctctctgcctctagccttagcgttcatgcatgctcactagaactggaggggatggctggctccccaaatgaggcctcagaaacaggagctcagggtcatagagacgctgagaaggctgtctttgctaggggcatgttctagggcttgttatccccaaatgcaactctgacactccctcaaccagctcaggtcttgagctggaaaatttctcatcaattgtctccccacatccttccaacagtgatggcaagatggccttcctgacacaggaagatgtagccaagagaggtgggtggcttgctgagggccctgcagctgctgagtggctgagccaagactgcagggcattgtctgacccacactgcagtccaaagctgctgtggctgctttatggcagataccatcacagagggtcccttagggaagaaggaactgaggctcttctgccgatcctgggcttactcaggggttgggggagatggagagggaaaggccagcaggatcagggaggaggcttctttctgggggaagcacaggatgcattctgttgtgagagttgctcctgcccaggtcagcatttttcttggagtgctctgtggccagcctccctagacattctcccatggcatggccttatacagaggttctgattcgcacactaggaaatcccaccttttccccagtctctctccaaattcacctcaatgctcctttctgttgggtaagcagtttctgcatctgtaggtcttgctcacttgaaattatatgtagatgttaaatttatagcatctctacacgaatgccttgatcagaccatttctgagagaggctgccttggtcactgtggaaggtggaaggtgaagaaggagggatgttgttcctgagttgtcattcccctaagggcaaggctgatgaaggcagaagaaaaggggcaatgttcagagaaaatcaggaggttggcagctgggcaagggcccaacccatgcctcaaacagaatgaggagcaaagtaaagtgaacatttatttatagagttcttaccacttgcccggcaccatgctgagcacctagaatttattatttcatcaatttctcaaaatgatacagtgcagaggctcagagaagctgggagacttggtctcacagccagtaagtctcagagctgtggttccatctactcaaagccccactgccttcatgggaaggaagccaaggggcagagtgagggaggcccagtgatgagaatagggcctgaggagccagttctggagctttgggtatagatctcaacctttgttagtgcctggccctcatgctttgctgaatggaagacagactctttctttcttccttccttcctcccttccattccttcattcattcaactaacatattgcctacatgtttaccagtccagacagtgctgaaatgtataaagcaaaatgctgtagttccctcacctaacaccagtctagctgttggaggtaactcaccactgttaacaatgtgatatcttctctatgatcatataagtaaataccattcgaaaacattttttgtttttttttaaattaaattaaattaaatttttagagatggagtcttgctctgtcgcccaggctggagtgcaatggcacaatctcggctcactgcaacctctgcctcccaggttcaagcgattctcctgcctcagcctcccgagaagccaggactagaggcgcacgccaccacgcctggctaacttttgtatttttagtagagatggagtttcaccatgttggccaggctggtcttgaactcctgactcaggtgatccacctgctttggccttccatagtgttgggattaccggtgtgagccaccatgcccagctgattttttgtttttgaaaaaaaaaaaaaaaaagccataccgtactctctatgccatttttcaatgtgcttttccccatcactatggagcatttcccattcagccataagaatccctaaggggtaaactcctaaggggcaaggcacagctggattgtctgagagtcctgggaaaatgtggagaaagtatcaaggaagcaaggttgaggggcaccaggactagtttctatccacccaggaaggtgccaggacatccttgcatttggcagtatccctgccaggcaagtgctggtggagagtcaccctgtggtctcaccttggggttcttcttccccagttgtcacacccaattcccttcctcttcaccattagtccaaagcgtcattctctctctagctgtggtagctcttagctggttactctgcttacactcttgacctgtgtgtagattgcaaatcatcctaattttttttttcactattgcctgtcttctcatcctttgcaagcatttttcagctgtcacgaaaaggatggaatgtatatccctacccctcaattttgtgtttgatcatgtgacttgtgcaagaatttgtggctcactttgaccaatgtaacaaggcatatccttaaaatatttgtttttccttaacctctgaagcttctgctgtcaccagaagaaggacatgtctacacactagcctgctggtccaaggaaaaggatccagccaggctcagcttagagcagtccaccctcagctaattcacacatgcataagctaaataaatgcttattattgcagtggttctccaagaatggactacagacacctttcaaggggtctgtgaggtcaaaactatttttaaacaatataaatacatataggtctttttcataatgttgacaaatacactgatatttaaaaagcaattgtgaactggataaaaaagatccaactacatgttgttttcaagagacacactttagattcaaagataaaaggttgaagggaaaatgatgtaaaaaatatatcatgcaaatagcaaccatgagaaagccagagtggctatattaatatcagacaaatatatatatttttcagagataaggtttacctctgtcatccaggctggagtacagtggcatgatcatagcttactgcagcctctaactcctgggctcaagcattcctccacttcagtctcccgtagctgggactataggtatttgacaccatgcctggttaattttttcatttttaaagaaatggggccttgctgtgttgccctggatggtcttgaatgcctggcctcaagagatctttttgcttcagcctcctgagttgctaggattataagtgtaagccactgctcctggctaacacaaatagattttaaaacaaaaaattattagagatagtgagagacatttataatgatgaaagcgtaaattcatcaggaaaatataacgattataaacatatatgcatctaataacaaagccccaaaataaatgaaacaaattgaagagacaaatagacaattcaacaattatagttgatgactttaatatcccagtttgaacaactaggcagaagatcaataaagagacagaagacttgaacaacattataaacaaactagacctaataggtatctatagaacactctacccaccagcagaagaatacacattcttctcaaatgcacatggagcattctccaagatagatcgtatgttaggtcataaaacaagtctcaataactttaaaaggatggaaatgacacaaagtgtgttctgtggacataagagagtaaaattagaaatcaatagagaagaacatttggaaaattcacaaatatgtggaaacttaagaatatactcctaaatagccaatggaccaaataaagaaatcctaaagatgaatcaaaaatactttgaaatgaacgaaaatgaagacaaaaacatgtcataatttatgggatgcagacaaagcagtacttagaggaaaatttatagttgtaaatatgtatattataaagaaagacctcaaatcaataacatgtccttccaccttaagatactagaaaaagaagagtaaactaaaaccaagcaagctaaataaaggaaataataaagattagagtagaaatttataaaatagggaataaaattcatagagaaaaataaacagaaccaaaagttaggttacttgaaaagatcaacaaaattgacaaaactttaattcgattgaccaagttgaaaagaaagagaagtctcaaattattaaaatcaggaataaaagacttcacagacctactgacagaaattaaaaggatcataagggaatatgatgaacaactgtatgacaattaagttcaaaaagttagatgaaatgaaaaaatttctagaaggacaaaaactaccaaaactgacttagaagaaatagaacatctgaatagacctataacaaataaagatattaaattagtaaaaaaaattttagtcaaaactactcacaaggagctcagtcccagagggcttaactggtgaacatttaaagaataattaatattgattttccacaaacttttccaaaaatagaagaggaaagaatacttcccaacaaattctatgaggccaacattactctgatactcaaaccagacaaaggtatcatattagaagaaaattacagaccaatacctctcataggcaaaaattcctccagaaaatactaacaaactgagtccacaaacataaaaagcattacataccatgttaagtgggatttattccaggaatgcaaggtttgtttaacatcagaaaattaaacattataacataccaaccctatcaagacatttgacaaattcaaaatccttttatgataaatattcaacaaactaggaatatagggaactttcttaatctgattaagggcatctataaaacacacacacacacgcgcgcacacacacacacacaccacacaagccacagctaacctcatattaatggtgaatgattgaatgctttctttcctaagattgggaacaagataaggatatctgctcttgccacttatattcaatattgtactgggaattctagtcagggcaattaggcagtaaaaaaaaaaaagggcataagactggaaaaaaaataaaactatctctatttgaatgtgacattattttgatatagaaaatcctaagaaatttactaaaaatctattagaataaaaaagttagtcaaggttacagaacataagatcaatacattaaatcaattatatttctatatgcttgcaatgaataatcagaaaataaaaataagaaaacaattccttttccattagcatcaaaagaatgaaatacataggattaatttttccaaaagaagtgaaaaacttgtattctgaaacatgtataacattgttgaaataaactaaagacctaaataatgaaaatacatccattttgatagatcagaagactaactattgctacgatgggaatacttcccaaattgatctacagatttaatgcaatctctatcaaaattccagctggcttatttttctgaaattgacaagctgattctaaacttcacataaaaatgtaaagcacccaggatagccaaaacagtcttaagcaaagttggagggctcacactttccaacttcaaaactaactacaaagctacagtaatcaagacaatgtgatactggcataagaacagacacatagatcaatgaaatagaattgagagcccagaaataaaccatgataattatggtcagttgattttctgcaagggtttcaagaccattcaatggaaaaagaagaatcctttcatcaaatgatgctgggaaaactggatatccacatgccaaagaatgaatttaaatccctacctcataccatatacaaaaaattaactgaaaatgcaccaaaaatctaactgtaaaaacaaaaactataaaactcttaaaagaaatatggtcataaatccttgttactttggatctggcaatagttttttaggtatgacaccaaaggcacaagcaaccaaaggaaaaataaataaattgaactttattaaaattaaaaacttttgtgctttaaagaataccatcaataaagtgaaaggataacccacaaaatggaagaaaatattaacaagtcatatatctgaaaggggcttgtattcagaatatataaagaacttttacaatccaataataaaaagacagacaacccaattaaaaaatgggcaaaggatgaatagacatttattcagagaagatatacaaatggccaataaacacataaaagatgctcaacatcatgagccatcaggaaaataaaaatcaaaaccacaatgagatatcacttcacatccactaagatggctgtaatcaaaaaagacaagcgtccacaaggaggtcgagaaactgaaacccttatacactgttaggagaaatgtaaaatggtgcagccactttgccagttcttcaaaaggtaagacatagaattatcatatgacccaatagtaccgctcttaggtatacactcaataaaaataaaagtatgtgtccatctacataatgtataaaatatatgtccatatacatattttatgaaagcttgttcatgaatgttcatagtagcagtattcattataaccaaaaagtggaaatagcccaaatatccaccaattgatgaatggataaataaaatattatatatccatgcagttggatagtgtttggcaataaaaagaaatggaatcctgacacatggtacaacatggatgaactttgaaagccttatgcttatgaaaaaggcagacacaaaaggccacatattgtctgatcccatttatatgaaatgcccagaataggcaaatccataagagacagaaagtagattagtagttgcctagagctgagaggtttggagagaaatggggagtggttgctaatggatatgaggtttcaccgtgaagtgataaaaatgttctaaagttgatcaacacaatgttgattgtgttgatggttagtgtattagtttcactcatgtgatggcttgaaataacataaatttattgtcttatagttctgaaattggaaatgcgtctcactgggctaaaatcaaggttttgacagaactgcttccttttagaggctctgggggaaaatttgtttcctttcagcttctaggactgtgcatttcttggcttgtgacttggcttcctccatcttcaaagcctgcagtgtagtaccttcagatctctctgactccttcactgactgcactcccacccccctttcaattataaggatccttgtgattacatgggtcccacctatataatccaggaaaatctctacctgaggtcaggagttcgagatcagcctggacaacatggtgaaactgtatctctacaaaaaaaaaatacaaaaaattagccaccacgcccggctaattttttgtatttttttttttagtagagatggggtttcaccttgttggccaggctgatcttgaactcctgacctcaggtaatccacccacctcagcctcccaaagtgctgggattataggtgtaagtcaccatgcccagctgactctggtattttctagctgtgtaaactgaaacaaattatttaactttccccagcctctgacttcttatctatagaatgaggataataataaaatttatttcccagaatttaactgagatagttcgtgcaaaggtctctgcacacagtgagcactcagtaatgattgccatgctgctactgttggtaattattccctgagtctcagtttcctttcctcaagaatggggataatgattccgcctatggacttcatggggttgtttttgaagctctaacaagctaatagactggaatgtgctctgaggaggaacaacagcaggacaaatgcaggaggttgttatgatttggccttctttttaaaggatgtttggcttcctgcagactctgaattatgcaggctcagaggagcttggcactgactctcagttccctgctgcctggggcctcatttggatgttagtggtgtccatcccttctctagacacactgggcagctgtttgtggggactacacaatgcccagctgcctttaggccagagaggcccctggcactgcaaacccagcctgagagggcaagtcaaaggtaaggctggacaggaaggtcagcagcagtctttgtgctgctttctgtccctgtggaagccctggcagggagaggctgtgctgcttctgtttcagttggccaggccacttaatcatcttttaattgagtctgaacttgcttttcaggagcaagggcaatgtctgtggcagctctgtgcatatgggcaaggtgggtgtctacccgcttctcttgatgctaacagttagttaatttagattaaaatcaagattcaggataaacctaatttaggccaaaattagttcatttatgttaagcattctccccgaaaggcaatctggcatagaagaatgtcctgggtttggaactagctgcacctggttttgaaccaccccctctcccacctgcctggcctaggaatattttgcagcccaaggtagtcccagaggtccctctatcatttccctcaggaaagagaaatgcattaaatctttaataagacagtagaaataaattaagaatttctttccagaatcccagattccaggacaagggatgggaagagagaagggctcccttgatttcccccatcacatacttcccactgtcccttcaaaaacatctcatagacatttattgaacatctctctagtgcgaagtgctttttatacacaatctcagttaatcttcacaacatctgttcaaggaacatagtctcatcttcttgttgcagttgatgggatggttggacatattgtcggtcctcggatttttgagtacgtggcaggcattggttcattagctaactcattcaccatatgaatggtgcacacacaatgtgctcagcatggagaatatggtgaatacaattagacacagcttccgcccttggtggcaggcattaatcaaaactccacacaaacatatgtaaaatcacacatttggaaggtgctaaggagaggtctatagtattacaagagaccctgaaggagcttggaggatgtggtagatttgctgggatatgagatatgatcaagccataacttgcccatggttgtgtgggcagtggctgaagcttggagaacttgaagtgtggtgtaaataaaggtcacctgatcatatgggactggcccatggaccatgttaaagcatttgacctttacccccggggcagggagaggacattaaactacttccaacagaaggtgatgttagcacatgtgccattttcaaaggtaaccggctgctgtgtggagagaaggagggagaccagaagggttgcagctgtccagggagtgtatgtgggtggcagcttagactgcagcagtgacatggagatggagggagcagatgacttcaagcaacatctaggatgtgaaatggatagttcttgaggtgggatagatggtgagaagaaagctcctgggcaggatggcttcatgtaacctgtgcatagcatggaggccacactcagaggtcccatgcttggtttaatgctcttcctcccctctagctttattgagataaaatttataatttattgagatataattgacaaaaaattgtatatatttaagttgtacaatgtgatgatttgatgtgcatatataatgaaatgattatcacaatcaagttaataacaaatcaatgacctcacagttaacatttttttgcatgtggtaagaatacttaagatctattcgtagcaaatatcaagtatgcaatacagtattattaactatagtcactatgctatacattagatctccagaactcatttgtcttacaactgaaaatgtacactttgaccaacctctctctattgtctcccactctcactcccatgccctggtaatcaccgttctactgtctgtttctatgagtttgcctttcttcaatttcacatataagagagttcatacagtatttctctctctgtgcctggcttatttcacttagcataatgtctccaggttcatccatattgttgcaggtggcaggatttccttattttttatggctgaataatatttattgtatatatacacaccacattttctttatccatttacccattgatggacacttaggttgcttccatatcttggttattgcaaataatatagtaataaacatgggagtgcagataccaagatgctgattacccagaagtgggattgctggatcatatagcagttctatttttaatttttttgggaacctccattatgtttttcataagagttgtaccaacttacatttccaccaacagtgtacaggggttctcttttctctacatccttgccaatacttgttattgcttgtctttttgataatagccatcccagcaggtgtgaggtggtatctcattgtggttttaatttgcattttcctgatgattagtgatgttgagaaccttttcatatacctgttggttatatgtatctctttttttggaaaaatgtctattcatgccctttccccatttttaaattgtgtgtgtgtgtgtgtgtgtgtgtgtgtgtgtgtgtttgctattgagttgtaggagttccttatatatttaggatgctaaccccttattatatatatggcttggaaatattttctcctattatgtaggttgccttttcaatttgttgattttctttgctgtgtggaagatttttttaatttgatgtagtcccacttgtttagttttgcttttgttgcctgtgcttttaatgtcatatccaaaaaaatcattgttctggtcaatatcaaggagcttttctcctatgatttcttctggcaatatatagtttcaagtctttcatttaaatctttaatccattttgagttaatttttctgcacagtgtaagggtcaaatttcatacttttgcatgtggatatccagttttcccaacaccatttattggaaagattgttttttccacattgtgtattcttggtatctttatcaaagattaattgaacatatatgtgtgagctcatttctgggctatctattctgttccattggtctatgtatttttttaatgcaagtaccatgtttttatgcctgttttaattactaaagctttgtgatatagtttgaagtcataaagtgcaaagcctctagcttcgtctttactcaagattgttttggccatttggagtcttttctgaccccatatgaatttcagaattgttttttctgtttctgttaaaatgcctttagaattttgataaggattgctttgaatctgagatcactttaggtaatataggcattttaacaatattaattcggatctttaatctccttggttaaatttattcctaagtattttattattttcaatgctattgtaaatgttattgttttcttaatttctttttctgatggcttgtttttagtatatagaaatgcaactgattttttgtatgttgattttgtatctggcaacctgactgaattcatttattagttctaaaggttttttttggtggtgcatttgggattttctatatataagatcatgtcatatataaagagatgatttcaccccttcctttcttacttggatgccttttattatttcgtcttgcctggttgctccggcaagatcttttttcttcatgtatgcatatatatatatacaaacaaactatatatatattattatatatgtatctgtgtatttatatatatacacacaaagtatatatatctcattatatatgtatatctcattatatatgtgtaagtatatttgtatacaaactatatatgtatatctcattatgtataagtacatatgtatacaaactatatgtatatatagtttgcttgttttttgctattaacttccctctgagagctgcttttcttgcacttcataagttttggtatattgtgtttctatgttcatttgttcatttgtctcaagatttttaaatatcttttttgatttattatttgactcatcggttgtttagaagtatggtattggtttccatatatttgcaaattttccaattttcctcctgttatcgatttctagttttgtagcattatggtcataaaagatacttgatataatttcaaccttcttaaatttgttaagacttgttttgtggactagtacatggagaatgtttttttgtgtgcttgagaaaaatgtgtattctgctgctgttggatggaatgctctgatggtcccaatgtgtctattaggtccgtttgatctatagttttattcaactatgctatttccttattaattgtctgtctgtgtgatatatccatgaataaaaccgggatattgaagttctctcctattattatattgctatttttcccttcacagttctgttaatattttctctatatatttaggtgctccaagattgagtgcatatatatttacaattgctatattctcttgatgaactgatccctttgtaattatatagttactttccttgtctcttgtaactacatgactgtttttggtgagatacaagacatctgaccctctctttctggaagctgcattgtgtttccactggccctgcagtttgcagaagtttctgttctcatttctaggctatttgctcagtactttctgtcttgcttaggaccaacacccttggctcctaatctggaacattgggtaatactgctggggtgtgatggatgtgtgggcttaggggcacatggggaaaactctcactaccatggatttctagtgcttttgtcattggcaccctggttcactcaaattggggtggctatgagtggacctcaagcttttttgcttggggtatagagaacagactccagcttggtctactgggcctggtcatttgattctaacctatggcccctgtactcttaggcattcttataggcagctacataatagctagtatttgtataggtacccactatgtgccaggcatcatgcattgaatcaacttgaacaactgagtgacatggtataatcatgtattttccaaaatggcacaacaatacttttggtctcagatgcctccaatatcttgctttttttctctccaagaggcagggtctatttctcctcttcctgaaaactggtgggtctttgtaactgctttattgaatagaatatggcagaagtaatgcaatatgacttctgaggttgttacaaaaggtgatatggctttttcttgcctctttctttctccccatttctgtttctctctgtgtctccctgtctctgactttctctgtcttggactctatctctttctccctctctctcaatgcttgcttttgaaaaccagccactgtttcctgagggagcctaggaacccatgcctaggcatctgacccacagccccagctaagcttccagtgacagccagaattggcagctgacccattgccccagctaagttcccagtgacagccagagttgactgtgatctatgtgggatatcaggcctcacaatctataagatgattcgagcccttgcctttccatcgttccagctaatgtctactggagcacagatgagctgtccctgccaagccctgccccaactcacagtttcatgagcaaaataagtttgaaaacactacactttagggcaacttgctatgtagccacagtaactgaaaacatgggtattacacaaatgggaaactcattcccatttgtgagtcaggttaattgaggcacagtgagattggcgctgtcactcaaggtaatactgttagtatgtggtggcatccagatttaaatccaagtctgcatgactcccccatacaacgttgattccagggcctgtacatttacctgtggtgagcctgcatgagtcaatgcatcaactcctcctctgctatccttgaactttaaggggttccacaaggtaggaataaggagtccctaagaaaagccaaggcttcaggaatcaaccacttcaaaggaagcagagagaatgtccactctctagcaccctattccagagttccagaaagcacggttctcagaaaaaaagcaacaggctaggaggaaaggataggagggagtcagagatctggctgatcccagttagccatgcaatcttagcaaatcttgagcctcagtttctccatctgtaaagtggacaaggtatgaaatttgatagttagggggacaagctggggtggggatatcattcctagtagggggaatgggctgagtgtgggtgtggagatggtgtgcacaggagtgttggggtacctgcttggggagccaagcctggtacaggaagatcagcgtgggtggaaaggaggcagatagggtgggccagggccacagaagcagctgtgcagtggaattgagaagagtctgctaaggactgggagtacgggtttgtgctgtgttggagaggcagctcagtcactgggagctgagtcagcaccctgaggctgcattcatcccagaatcatcaagtgtgagatgaatcttgtgtccgtgttcctcgtggtcctagtgttttagcatgctagggtccctgtccttcaggtagggtgacaaggtgtgcctcgatcccttgggaatcctgggccagctcttggatgtcatgcacacagggaaggtctcctccacttgtgaccatcccaagcacaccagctctggagcctttggctgttctttccttctttggtgcatctttcctgcaaggaattgttgttggagctgggcacctttaagaaactttatgaaatgtcacaaacaccttaaatgtggagagaaagtgctgtgtacgaggcaaccacaggaagagctgggggtatgaaagcaacagttctcttggtggccttcggatgtggctgctctgcttacaccaggaccccaaagagccggtccatccttcacgggtgggaagcctcctcctggctggctgtacatctcgattatcaaagctgttatttgtaaacactccagccagctggttgaaaactctgacaacacttgaagggaatgctcccacttccccagcaccctggggtggcgttgggaggcacatgctccacagctaagaaagagcaagaggtggaggctggagatacccaggctggtctgtggaggctttctggaaacatactcctactatctagagataattgctgttaatttgtttgtaacatccttttgagaccattctctgtgggtggatttataaatggcatcattctatataccctgttctgtagccgcttcctccttcttctctctctctctctcacacacacagacacacatactttcctaggtcaattagcaaagatccaccttctcatttttaatctctacccagtttttcgcgggatgcacataataaacactcctgttctgcttgttctacaatgtttaacagccatctgtatacatacctctttgcatttttgcccaatcatttcctcaagttacatcattagaagggttaattactgtgtcaaaaggcatgcacattttaaaggcaatttatatatattgttaaatttcttcctttgaaggaggctactccaaaatgcattcttaccagaagtgtttgagagcttcagattcctccggggtattctctttttccattttctccagtctgttaggtgaaaaatgacatttcagttgtttaaaactcactcttggcagagtgcttctgcctttcctgtacagtgcatactcattctttctccttgtatttattgagtacctacgatgtgctgtactgtggtcagcactggggatgcttcatcagatggtcctttctgctcttattgctttgcagtgtgtgttttgccttccagacttagagcattatagaaggttagagctgtaaatgatcttagagattgtctaataacctcattttaaggaggggaaactgaggcccagggagatgtggggatttgcccatggtcacacagggcggcacattcatggtggaattctaactccgaaggcagggatttggggctttctacttgttttgattttctcacccagcatgggagcacttgttggtcaaattcaactctgagctaatagcacagcctccctgtgctacaattcaggggacattccaatgggcacagagtaggtgctttagaacttatttattgaaagaatgttggtgcataacagaacagaagaaatagtacattctgttaaattgtgctgaatattccaggaagaaaggcaggcttctgtggggtgcccttctgggatgaaatgcctttttttttttttaaatgaaaaagaaaaatgagtgggctgttggaattggtggaggaggagagatgggctgcctaaggcttgagacaatgtgtttggagccgtcaggtcactggaatttcccttaggtgcctttctcctaccagagatggcctgatagaaatggggcaggagctaacgggagaagagagctttgttttctctgagcgttcctatctgaacctagcctgaactcttgagtaattcccagggactgtctcatgccattgttattgtctctgctcagctagctccctctttccttctacttcatcaaaaagtctttctagcttgtctcttgagaacattttcaatgctgccctggccttttatgacgcaggaggtagctgagtcaatggaaagaccagagtttggttctggcttcacttctgatcacagtgggaccttgggcaaatctcctgtctttgccatgtcgaccctggcaccacccaattcacacttgtgcccctctccccgggtgcccacaacagccttttttttttttttgagatgggatcttgctctgttgcccaggctggagggcagtggcacagtctcggctcactgcaacctccacctattgggtttgagagattctcctgcctcagcctcccaagtagctgggactacaggcacgcaccaccacgcccagctaagttttgtatttttagtagagatggggtttcaccatgttggccaggatggtctcgatctcctgacctcgtgatccaccaacctcagcctcccaaagtgctgggattacaggcatgagccaccatgctggctcaacagccttttaatccatctctttgcaactgcttgcctccctccaatctgtgcccctgctagtgcgaatgcattatcactccttcacttaaaacccctcatgcctcccagccctcttagaagagagagcaaagtcccttacacttccaccagatccgtgtggcctgtccctgctcctcttgtgctttgctccagccacgctgacctcctttaccagctgtgtggccttgggcaaatgccttcccctctctgaacctcggtttcctcatctgtaaaacaggcattgtaataatcccaatcattctgtttgttatgaagctaacaaccacttttaaatgactctcaactctttcaggctctacttctccaaaagacgttacatattccaaggatcctgcgtctcaacaaaccctttcttctgcaaaagaacagcctgcttttattccaagctctgagattccttataggaagctgtttctctccagttatgccatgttatgccttaacctgggccaacagtgcctacacacggagaatgcaatggttgaggccaattcattaacagggattgtttagccacatccgttgttaattgacaacatgtctatggaattagaa

SEQ ID NO: 384 - DNA, 97344 bp, Homo sapiens; identical to SEQ ID NO: 351

SEQ ID NO: 385 - DNA, 24211 bp, Homo sapiens
ggcgagcgcacgcgcacagcgccgggccgcacacctccgggctctgggcggagcgcctcgggcgttgtaggcgggaccggaccctctggcccgcccctccgtgtcccttctggtcgccagtggacgccgacgtcatgacgtcgcgttccgtagggctcttcccgggctttggtgggtcacgtgaaccacttttcgcgcgaaacctggttgttgctgtagtggcggagaggatcgtggtactgctatggcggtgagcgcgctggcgcgtggcgggcgggcgccggggacatgggtgcggaggctgcgcgcttcccgtactctggccccggcccagggcggcgctctgggtgaggctgggccccaggctctggggcgcagctactttctcgcctgcaccctgcgtgaggcgactcgcctacctaccactgacctggggccctgggctccctaaggcgagctcggcccgttcagcctctgtcctttattcaccccacacatacttattgggcgccatctgtgtggcgctgagcgtacaaaagacaggcccccatttcactacactcctttaaactttttttttttttaatttcccaatgatccttgttccaaacactacacttacttttgtattaccttcttgtccctttgtcttgtatactgtctgttccacatctgagttccagacctcttgttttggtggctcttctatgccatctctatcacaataccttgcgcactgtgtgtgctgaaataggtctaatgcttaaggggagataatagacagtaaacaggtaaataggcaaatgacataacctcagtggtttttcatggagaaagcacggtgatgtgggtgaccccgatatttgagctggcttctatttgtttggaagccactgactcagattgctcagctgagagcattccaggtgagagaacagcaagggcaaagatctggaggctggaaggggtttggtgtgttggaggacaagagtcacaggtggagagaaagaagggaaggcccctgatggtaaaaaggaagctgtatcatgcctcaccagcttcctaggtttctgacaaccgcaccttctcttgcaggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaaggtaatttcattcaaggccctggactcagcagatagttttgcagagagcccattgtgtgcctggtggcctggctttgggagctgggagcagatgaatcgatggcattcttgcctttgagcacagcttgatccagggttctgaggagacaggtttacagagccatgacacaggtctctttaacttactgcatgtaacttggaaagactagaccctaagctgaggataagccccgactccataagcaccccagagaatgtaggggtctctaatctggaatactccaactcaaaaagacaggaagcaggaagcccagtgtttcccagtaacttttcaaaggaaaggtgcatgggggaggagggatctgataaataaagttttagagtcaatcagcaaacatttattgtacctaatgtgcaccatgccctttgttaggaatggtcttgtttattagtaaacatgtggtggctcacacctgtaatcccagcactttgggaggccgaggtgggcggatcacctgaggtcaggagtttgaaaccagcctggtcaacagggtgaaaccccgtctctgctaaaaatacaaaaaattagctgtgcatggtggtgcgtgcttgtagtcccagctacttgggaggctaaggcaggagaatcacttcaacccaggaggcataggttgcagtgagctgagatcacaccactgcactccagcctgggcgaaaagagtgaaactctgtttcaaaaataaataaataaataagttagcaagacttaatgctaggagagtggagtaagctctgcgcataagcaaggctagatttctacccctgccttactctgcatttccagctgcgatctggtagataacgtcagtagcggaattgtgtgaatgcccaggagcctcgtggagatgctccttttgtgccttttcagccttagcatgtgtgagagtactgtgcagggcatcctgccgtccctaggatgtcagacagttgagaggctttcaagggcactccagactggatgcatctttgctattatcagtaccacccccaacgatgagactgcatgtgctgtaggctgtagaaggaatgaggagtctggataaatctgccctggacttggggtcagggcatgggtcctagacggctttcctgttctgcctgatggagttgttcaggccggatgcccctcctctgctgtttcccctccctgtcttgaccctttctctttgcttctctgagaagcaaagagagaggcccttggcagggggcttctgggtagaggtatctgagggatggctgagcccaattacatttgtttttgtggtttttcaaaaaaaaaaaaaaaaactttattgggctatagttttttagagtttaccccttgcgaaaatataattcaatgcaaattcatggtaaatttcctgagttatgcagccttcaccacaatccagtgtgagaacagggccgttttcccattgaggtccctcctgcctgcttatagttcattctcagttcttacccaacccacaggtaagaattaaagacctgtctctagattttccaatctggtcatttcatataaattgaatcatattatatatgcacttttgtggtgggcttttttctcttagtgtggttttaaggtctttctgtgttcttgcatgtgcagcactccattcctttttgtggctgaatcatatttctttgtatggagataccacatctattcatcagttgatggatgttggcttcctcaagccttttggcgattatgaataatgttgctatgaacattcattacaggtcgtgtttttttgtttgtttgtttgtttgtttttgagttttgctctgtcgcttaggctgcagtgtagtggcacaatctcagctcactgcaacctccgcctcccaggttcaagcaattctcctgcctcagcctcccaagtagctgggatcacagacatttgccaccacaccggctaatttttctatttttagtagagatgcggtttcggttttaccatgttggccaggctggtcttgaacccctgacctcaggtgatccacgtgcttcagcctcccaaagtgctgggattacaggtgtgagccaccacacccggcccgttacaggtttttatgtgaccagatctttaattctgttggctatgtaggagtgagattgttggtcttgtgtttaatcttttgaggaactgccagactgttttcaaaagcagctgcactatcttgcattcccaccagcaacacatgagggttccactcctccgtgttcttgccaacattggtctttttgattctggccatccctgcaggtgtgaagtggcatctcattcctgatggctaatgatgttgaacatcttttcgtatgcttgattggctatctgtgtatcttcagagaaatcctggactcactttttaattgggttgcttgtctttttactattgagttgtaagaggttttttacatattctgaatataagtcctctatcagatatgtaatttgcagttattttctcctcaatctggcttatctttttcgtggttttaatgttttcttttgaagtgcaaaagttttgaaatttgatgaagtccagtttaacttttttttttttttttttttgtatgaaccaattagaagtttgctgagggcattttgtgtgacttgagatccagggagaatgggaccgataccttttccccgaaaacatggaagaaatcagacctggtcaactctgatatctgcctggctgggttctgcttggggcatcaacagcataaaaagatttgttctgacagtagtttgacaatgtttattgcagaaaaatagtagcagtttctcttgtcaccatttaacctgaaaaaaggagaattcaaggggattgtcttggggaggcagtatggcatgggggaaggagctctgggcttggactatattttgacactcaggtctacagagcgaccataggcaaaaatcacattttcccctcaactacccatttcctcatctttcagatggaatgacagtgtctcctcctcagggaagagagcactgcagggaagagagcacagtgctttgcactcgctgggtgccttattaaggcattacttctcttcagtatctgaaggaagataatgtggaaaatgtgtgtctgatggtcttagagtagctcaaagggttgagacagtgggtggccatttcagagggctggtttggctgactgtgcatggaagccaggacatcaggttgttgaaggcggcatagtcagagatggggaaagtacagggagaattccagccctcacggggagttgggtcagctctctgaagccttttggtctaatgttttgtggttccttgaattattttttcttattgggcgcatagaagctgtctggagatctacctccccttttgtaattgtggtaaaatacacataacaaaatttaccttttcttttgttttttttttgagacagagtctcactctgttgccaggctggagtgcagtggtgtgatctcggctcactgcaacctccgaaagtgattctcctgcctcagcttcccaagtagctgggactacaggcgcccaccaccgcgcccaagtaatttttgtatttttagtagagacggggtttcaccgtgttagccaggatggtctcgatctcctgacctcgtgatccgcccgcctcagcctcccaaagtgctgggattacaagcatgagctactgccctggcccaaaatttaccatcttaaccttttttgtttgtttgtttgtttgagacggagtttcactcttgttgcccaggctggagtgcagtggtgctatctcggctcactgcaacctctgcctccctggttcaaagtgctaggattacaggcatgagccaccgcacccagcccttttgtttgtttgtttgttttgttttgtttgctagttttttgagacagggtcttactctgtcacccaggctggaatgcagtggcacgaacgtggctcactgcagccttgaactcctgcgctcaagcaatcctcccagctcagcctcctgagtagctaggactataggcatgtgccaccaggcctgggttattttttttttctttttgttttttttgagacggagtctcactctgttgcgaccaggctggagtgcagtggcacaatctctgctcactgcaacctctgcctcccgggttcaagcgattctcctgcctcagcctctcgagtagctgggactagaggcacatgacactacgcccagctaatttttgtatttttagtagagatggagttttaccatgttcgccaggatggtctcaatctcttgacttcgtgattcatccgccttggcctcccaaagtgctgggattacaggcatgagccaccgtgcccggccattttctatttttatacagatggggtctcactatgttaaggctgttcttgaactcctgggctcaagtgatcctcctgccttcacctcccaaagtgctggaattataggcatgaaccaccatgcccagccatcttaaccattcttatgtgtatggttcagtggcattaagtacattcatattgttgtgcggccatcaccgccatccatccacaaaagtcttttcagtttgaaaactgaaactgtctcggttaaacactaactccccattcttcccagcacctagcaaccatcattttactttctgtttctgtgaatttgaccgctcagtgagtggaaccatataggatttgtccttttgtgcctggcttctttcactcagaatcatgtcctcaaggttcatccatgtgccagcacgtggcagaatttccttctattttaaggcttcatcgtccatcatatggacagatcgtgttttgttcatccattggagatcttttctgagccttctgtgtttctgacctggaagcgctgagcctacccacaatggggctcctgaaccttagggaacaggcccagttcctggatggggtttggtgcttagggttttcctttttggcagtaaccacatctgttttggtgctccctcagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatggtaggtccagttgtctgcctgcccgagggactgggaagctgggaaggagtctgggaggggagtagaaggtgctggggatgaccgcagtagcaggtgtctcttgcctccccagacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaaggtgtggcttccctacgcccccgcctcagcccctgtagcgcctccctaaatcctccccagaaagttgtctgagccgagtgaacacgtgaagcacagggcatatggctgagaggtctgtcagagaaaccaaaagttttgagttttgcatcagggctctcctgctggctatgcagtgaccacatctgggccaccaaagcgttttttgacaagcttgaaaatggacagattttatataaaaatctggattactactttgatctttgtaataggaattgactctttttttttttttttttttttttgagacggagttttgttcttgtttcccaggctggagtgcaatggcacggtctcggctcactgcaacctccgcctcctgggttcaagcgtttctcatgcctcagcctcccgagtagctggaattacaggcatgcaccaccatgcctgactaattttttttttttagtagagaaggggtttctccatgttggtcagactggtctcaaactcccgacctcaggtgatttgcccgccttggcctcccagagtgttgagataacaggcgtgagccaccgtccccagccaggaattgacttttaaaagggacatgtagatcttgattcctgcaattccttccactgctttttgtcctgtgtttgtcagtttcttcctggctcttgtaaggcgtttcatgtttgtagctgtgtaggcactctgctcatatttaatttaaccccccagcaactttgtacactgtgtgacatgcccattttacggagtaggaagttgaagctcaggctatgtcacagctgaagtgtggtagacctagaagtgaaagctgggctttctaggtcaaaatcaatggtcggggtgggtaggccttgcttctcacacaggcattgttgcagcccagcccaggcctcatgcttagttaactctcttcccactgtgcccccttctagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggtgagctgagggcaggtgaggatggcaggtccgagctcagtgctgggtgactcggtcgtgattcctgaagagcgattgtggtgtgggcggggagggtgcagccagcagcatcctcatcgcaggtgagttgtggttgcacaggagtgtgatgggagggatcttcccgggctgggggctgggcccaatttccaggacagtgtgttgggacactctcgtctgcagcctggcctcaccctggctcacggcttctgatgcaccctctgcctccgcaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggaggtgagagaggacacaaggtctgctgccagctgtccttaggggtgcccagtatgcaggacctgactggcctctcaggctgtggaagaccagtgtgggcagccgcaagaagcaagatagaattgtgtgttggccacaccctggggtggacccagtctgtctggccagtggacttagcttggcccacacgacgtttttaggaattcaagtcaatatttaagtcaggcgatttgtttaaaccatacaagtttatggctcctcttgaaacatgagaagatctggcaaacagggcccacttcttgccaggtcactccttcaggatgtgtgcttaccagtctccatggtgccatcactcacgtggggtggctgcagtcccatcgggacttcccctcagcttgtttctgggacctgtctggctcacgtggggcccctggaccataccaacctcctgcaccatattcaggagacgctgccaaagcctctgatgttaaggtcttaggcacatgtaatgtgcctttgtacttgagcgtccctgtaaatgggctcatcgccatcgctgtggtggcgcccaggccccttgactgccttgctgctgtggctgttggctgtcctcttctcaccgctctgcagtgcagttctgcgaactgtcccagctggagccaccttgccagaaaatgcctcagaggttccacctgtggccacctacagccaaaagctgacccgtctcgtctcgggtggggcagctgcaggccagatgccagctgagccacgtctttgctcactcttcccatgccctgtctgtctccctcaggccttgcttctagggacctgagatagtacctggtagagggttaacagttacagctatcattcatggagtaacttaccagtgccaggtggtgggtggtttattacctggtcctttttcacagctcatgaggcaggaactgttactggccccactttgccgagtgtttagagaactggctgaggtcacccaaccagaatgtgtgttagaggtccacagctcaggcatcttgatctagagcatgtgcttttaactgcagtgccatgttgtgagataatgggtacgaaatgacatggcacagtgctggcctgtgatacttgacagtgacagccaaaacttcctgtaacttaacatttatcagatgctggattaggttgatgtatgtatgacttgctttaattcttattgtgaggttgcagagaaggcacagagagaggaagtcacttgcccaagatcacacagcttagacacagaacccaggcagcctggttccagcatcggtactcaagacagcttagctgtaaagcatagagcaggtgctgagtctggccgtcagaaggcatcccagagggatggtgtggcaggagtggggactgtcaactgatgtgctgagtcgccatgaactcattccttgctgtctttggctctccatttgccactcaggagtcggaatcctgcctgttctccctcctgttcgggggtcaaggttaggtgacatagtaagtcagtgatttgaggccttctgtgtgtccctcgcagaccatctatcagaactaccagcgtatccgaatccaggagagtccaggcaaagtggcggctggccggctgccccgctccaaggacgccattctcctcgcagatctggtggacagctgcaagccaggagacgagatagtaagtggccggggcaggctgggagggagccaagttgcagagggaactggcagaagcagttgtggctgggccggtggcggtgtctatggtcgcaggggcactcgggctaggatctgtttttgcatggctgaggcaaagaactttcttctggtggatgggttgttggaatggtgggtttaggaggggttttactgagttacttatcttggtgtctgtagtgtggagcacttgcaataggagaaactggaggaaggcagcacggaggtgggcacccctgggttaggctctgacttcttggcccctccctttccccaggagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaaggtaggtggaaggcaggggcaggggctgtcaggatgctgtgagaggatatggagggttgctggggctgtggtaggcacctagggctcactgctcaaaccttgccttattcccctggagctcagtaagcttgtctggaagggaggccctgtgctccagggaagaggtaaactcgcattggggatgggtgaacctggctgtggctccaccatgggccagcgaggtagtgggataacttggatgacctctctgagtctgtgtggtgggaggagtcccctgctgaggacggggttgcgacgagaagagctcttcctttagcagatcatttcaagctgtggtttgaaattggaacagaggcagggcaataggataacttgtgtcatgagggattcctagggatccagctgtggccaacgggaatttcttcagaaaaacaacccagaatggtggtgttttttgtttttttttgtgatggagatggggtctcactacgttgtccaggctggtctcaaactcctggctcaagatcctctcacattggcttcccaaagtgctgggcttacaggtgtgagcccttgtgcccaggcagttgggcagttggtttttagtatagacatccttactgaaggatgaggagatggggatttatgttgcagaaatacggattacttaaacagaacgttaaatttctgttgataaaaaccctttgctgtttctcccacattacctccatcctgcccccagagcaccgtgtgttctcaagctcgctgctctcccctttctcttccttccttcctctgtttctcagtcaacttcctttttttttttttttttttttttttttgagatggagtctctctgtcacccaggctggagtgcagtggcatgatctcagctcactacagcctctgcctcctgggttcaagcgattcttgtgcctcagcctcccgagtagctgggattacaggcacacatcaccgcacctgactaatttttgtatttttagtagagacagatttcaccatgttggccaggctggtctcgaactcctgacctcaggtgatccgcttgcctcagcctcccaaagtgctgggattataggtgtgaggcaccacgcccggccttcaagtcaacttgaacttcagtttttaatgcagagcagtttagttcgccctttaacctccactcttctgccctctggcaagataaaattcagttcccatttggcttcttcagtgaactgggtgatttccttctgacgtatgtaaaccccccagggacaggagccatcactggcttaatcacctctgtctccagggcctggctgcaggaggccctgagtaattttgaaggaatggatggtggggtaaggagagctgtgtccaggctgcaggttagctgatttgttttggttgtttctctccatccaccttcccctgaagcctgtggagccccctttcttggttcctctgaggcacggctatggttgccccttccttttcctcctcacgcatcacatttacccatgtctgcctgccacttaatattcctacacatgcatggtttgttctgttcctttctttactccttgaggcgtgtattccaagtaggcagggtagttttgtgtctcggttccttttctcaagtgtattgcgtgtctttgcatccaccgtgagaagctgctgcaggctagacgcaaacccagtaggggcaaagcatccagcatttgtgggcttatatgttactgtcattgttcaggaaagctccagaaatgcatccctggcagaggctggtattggtgccattccttcccagctcttggccatcgaacctagtctgcgaagatctggggttcccataggagaggtgggtgtttctcagcgtcaggaagccaggagcttcagttcagccaacacacattggttcctggaagacctcctagggccaagttgtagggatacaatggtgagtaagtcagacatgacccttgccctcagagctcatattttactagggttcccaataataggaaatagacaagatcttttcatgtagttttacatgcgaggaagacagtcacacaggcaaagaaagccaggacctcccagccttctaccctcaccacctgcagaggctcatgagtgctaccacagtggacacctttgcagaatttcatccagatgtttgagctaatttcttcaggcttgggtggacttggccctgctggggtcttacagtccctaagcagccgggccacctgtgtcccacatgattatctgtgtctgtgcctaccacgccaaaggagctgcatgcttgaggaactctcttctggcaccttctcttcctttgccttgagcttcagccactaatctcccactctgttgattgaagaggtgagagacccataggtgagcgtgtggcgggcatggcatgcctgggcactaataaggcatctgcccgggccatccccatgtgcttctggagccccaggttccaaaacgacttgttccccaaatggaggcagccctaccccgctcccgtgtcttgatgcctgctatttgtgtctacatagagcaccttctccctcacttgtccccagctgacttctgtcttctgcagattccatctccagcaggaagccctgcaggcttctgcagctgacttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggacgacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccaacagctgactttttgtatttgtttttattttgagttagttatcatccttgagggatccggagacttcacatagaaatccggatgctttttgaaaatccaagatctgtgggtgctggctctgtgttcctctctggtaacgctgacggagctgaggcatagctgcccttgcaggtagggcctgtgtccccaggtttaccccgtcccctactctgtcagtttcatggccctgcctgccttccgtgggccctggacactgatctggtaaagtattaaagagatcagggtcatgcccaacacttagagattttaaagaactaacagaagcagcatgcagtctgaagccagactttttaggtttgaattttggcctaatccttaggatggtcagatgagtcacccttatctatagaaatgagaggatgagagtaaacactcatagagttgttataaagatcaaataaattagtgcatataaagtacttggctgttggcgagtgctcagtatctggctgttactgtacatggctaccaaagttaaactatttgtacaaaaactggatggaagagcctgtgacaggcgtgtagaaagcataagcagccagtaggtaggacaaaaatagctttgagcctgatgctttaggcattttacacacattatctcaggctcatggtacccatgcaggtgggtgctttttctccgtttgctgggtggagctcacagtacccactcaggtgggcactctatccctgtttgctgggtgcggagactgaggagtgctaggaagcagcacacctagagccaggaggagcatgagctttggattcagatgcatctggggtcgagtcttgcctctcctctaggagaaaatattttgacctgagccttggtttcctctgtaggatcgagagaaacaaggttattatgaggattacatgaggtaattcatggaaagcgctgttattccctggcaggtctgggatttgattctgccccactttccagccattaaattagcctgctactctctcctggagtaactgggtcagcggtggaaggcacagcaggcagtgtaggcattcacacatttgcgctgcttgccctccagtcccacagggaagtccccctggatgcagtggttgctttacaggagggggattgagttgggcaatctgccctgcatagcaagcaggaagctcttggccctggagggagacattacctcatcctgcaaggttgctcgctacaaaaattatacggggaaatgagctgggttaagaggagtcaaggattggcagtcttggcacatccagcacgaggtgtgttggggcatgagaggtccgtggagtggtctgcccagcatctgcagcacaaagtaagagtttcataagagagtcattatacttactgaggacttagtatctgcttggcattgtctaggtaatttctagatagcaatgttcctgtgaggtttcatctctgcctgttttactgatgaataaactaaggcacaaaaggttagataagttggccatagtcacatagcaagtggcagagtcagcagcctggcttgagtccatgctcccagtgactgtattgtgccaacagttggtgagtttatttggttattgtgagttccatgggcactctgtgttacataaggcctggcccacattttaaaacattgttacagaaaatttcaaacaggtatgtagaatggtgtagtgaactttgaccatttgtcttagtccattttctgctgctacaacagaataccatagactgggtaatttataatgaacagaaatttattgacttatggttttggaggctggaagtccaaaattgagggctggcatctggtgagggccttcttgccatgtcatcccatggcaaaaaggtgagagttaaagagacagagtgagagcccagagggggccagactcatccttttacaaggacctactccctggatagcagtgcttttatcctccattcatgagagcagatccctcatggcctgatcaccccttaaaggtcccaccttttaatactgttaaatgggggattaagatgccaacacatgctttctggggggtacattcaaactgtagcactctacccagcttccacagctgtcatagtcacagccaatcgagtgttcttaatacaccacccattcacccttggtatatttcaaggcaaattccaggcatgccgtttttttctgtaactacatcagtatgtatatgaaaaagaaaagactctctttgaataaacctagccacaataccattatctcactttaagaggtgattaacaattccttaatatccaatattctgttgttgttcacatttccctgattatcttaccccttccccctgttttttacagcttcttggagtcattatccaaataagatccataagttgtgattggttgatatctcttaagtctcataatctttagatcttttctccatctcttttttccttgtaattttttgtggaagaaactgggtcatttgttctgttgagccttgcagtcgagatattgctaattatgtccccattagacacacacctctgtcacctgtgttttctgtaatttggcagtcaggcactgaagcctagtcaggtaaatgcctgcttattttctttgacttactagttttaaaaataatgaattggttcccaggtgacctgggtatcataacagacaaataggcccgccgggtgttgaggtttccacgctgcaggtgtcatccctacaatgctcaagtgtcccttttttgccagcgtgaacctattcatgttggctcctgagttctgttgacatgaccctggttgtctttgagtgattttttgctttctggtagaagatattgcaggcttctcttgtacatttccagccccggacctggaattggacatttctccaagaagccccgtgggaagtgttacttgctttcagagggagataggagttagagacacctctaaagctgcatgaatttgatggtgcaggcaggacatacaggatgcagcctgatgggggtgtctcccctccaccttcagggctggttttcctgccttagtcccctctccccaggcgagggccagtgctttctgagcttctttgtctgtcctacaaggagggaaggatgtgggtgtggccagtgcaggggggtatgaaggctgaaagctatcaaaacatggctctgctgcaggtggagttggaagcagtctcctacaagcaagaaatgtctttgatgtctctaattctatctaaaattcatgaagattttgctctctccctgtctctttctttctctcacacacacactgaaatagaaatgttccagtgactcactagttggaattacttcctggtggacacatctcccagatgtgccacatttattgcattgacgaggcaggcacttgcatgaactgtcgcatttgtacccacccttctgtgagttggatgttgccatctctcttttccatatgaagaaactgaggcttgaggtaggccagtgccatgacagacctggttctggtcttatttctgctcttggtctgtgatcttgggaaaggcctttctgaaatatgtcaagattaggggttcagatgaaggttcttctaaactccaaagttctgtgactcttgggaagagccaactaatgaaaagctttagagtcgggcacggcttgataccagggcctgatgcagttgcagcagctgtggaagtgggtgtctttgagctggggatgtcgtggttccctgatgccagagcatgtgggtgacctactctgtgagtatctgttcccattcttgtcggtctccctccctttctcagatctttgccagcattgctccttccatctatggtcatgaagacatcaagagaggcctggctctggccctgttcggaggggagcccaaaaacccaggtgagcacccacctttcctctgcaggggtgttagcagctttctctttggggagccagcattcaaagaaggacacagtgtttttaaagcctgggtgctggggagaaagaatgcattaaaagatggtctggctgggcgtgactcattcttcaagggagagggtggccctgagttgggcattctgggtgttgggctgttggtcagggagccagtgtctgcctgcttttgtgatttaagcaaatgagtctttgcttctcttctatgtaaaaaatactttgtcttttaaaaacctgttttaagtacaaaaatactattgacacatgagtttgtatttatattacacttttatagaacactaaaagtcatgggtgaggctgatttccccattgacccccacttctcttcctagtccctccctttgtggccatttacaattacacagcaaccacagggtttcatgactacacgtgtttatttgtacaagcgcagcgtcccctgtgtgtgcccagtgctgtgcctgtgcgcagtgcatcccaccgagctctcccgctcagtgccacactgcagcatcttttcttgttagtgcatacagagcaattgccttcttttaaatgactatcatgccaccagataacgcagtttatttagctctccctttggagaacacttagattgtttctgatatttcacattcgccaaggacatctcgtgcaaccctcctctgcacccgtgtgtgtttccctgggagtgcccagagtgggactgcatggcgtagggcattgtatccctttctagagggactgtgccttaccattcctaacaagtaggttgaggaattggtgggggatgcaactgtgccctcctcctctcacttcccactctccccctcccccgcttctactcatcccctccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaaggtgggtccctgggtcacggaggctggtggaactcagggggtgtgtgtgggcttgggccttagcgacgggaatggtgttaatggggtccattgggacctcatcggagacttagtagtaggggcgtgaaccatgctaagggtgggccattttaatcttgcagatgaatgaccaggacagaaccagcatccatgaggccatggagcaacagagcatctccatctcgaaggctggcatcgtcacctccctgcaggctcgctgcacggtcattgctgccgccaaccccataggtgcagcaggcaccctgactgctggggctggggtgggacacagggaggtcccgcctgcttgaattgggagcccacggggtccccaggagccgatctgaggaagtcattgtgcagcagagggttcccctcttctgcatatcctgccagagtggggaacagtgaaagtgggacctgggacacctgggtttcctgttgagtcatgttcctggaatcaccttggatgttctcagaaggcatgggaggagagcccagtgcccctctggccaggatggagttggctgttggtctcagcagcgaatgcgtaaaagaacccaggctctgtcacccactgtgttcttggtttttcctcctggggaagcagttatgctttctgtctaaattaggctattttgggccctggttagggtaagctctttgctgtctcagacagcaggtgctaagtacccacctatgtcttcctcttccactgccctcatccccttctgccatcagagcagcctggggtccctgagatgggaggataggggaatccaccctgatggaggtgctcccctgtgtttcaggagggcgctacgacccctcgctgactttctctgagaacgtggacctcacagagcccatcatctcacgctttgacatcctgtgtgtggtgagggacaccgtggacccagtccaggtatagctcacatgtgcccggtttccatgaactgtggtttggggacctcaggtgaggcttggggtcatacagtgtgcccaacacaggggacaggtgctgcaggggccataggctgttttctagtcctgttccctcggtctcttctcatgtccagaagtcgccctgatttctctttccttcacagcacccccgacccccaccctacataacccacaatccaccaaatcctgttgtcccaactcctgagcctacccacctccctcacttctgcctctgacttgaggcactaccatcatctgaactggcctcctggcacccatgtagactgtcttccagttgaaggcataaatcagatcagccccgtccttaacaactgcttgaggctttctgctgtcatcagaatagaatccagggtcctcccctccggcccgcacccgccatctctgcagctacctcctcctcgctcccttccctcacctgcacctgcacctgcccttctctctcaaaagggccgagccttggggcttgattgtgctccttgctcctggcagacgctctcccacactgtcacatgacttgcatctcattgtcgtcatctcagctccctgtctttcagggaggggctttgccgggcacccttagctagaggcatctccttggtcccttgatcctatcactctatttttcttctgagcattactttccataattaatttttaagactatttgtctcctgtccccttgtggagatgagccctgtggggactctgtcccattgtctggtttgccacccacacccagaactgcctggcacatggtcagtgtagtcagtcttgttgaaagagtgtcacccttgtagggcacactcagcccttctccagccactgacctccccaaagccacgcacacccacaatcagacccaccctctcatggcttatcttaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggtgagagcccaggcagagccgggaggtgctatgcagagaaggaagtgcagtgtgagccttctgaccaatgcagcgggggtggtggtcagtcaggccaaaaggtgccagagcagggaggcattaaaaaaaaaatgtaggtgccaggcacagtggctcacgcctgtaatcccagtactttgggaggccgaggcaggaggatcacgatgtcaggagtttgagaccagcctgaccaacatggtgaaacccaaaaattagccgggtgtggtggcacatgcctgtaatcccagcttctcaggaggctgaggcaggagaatcgcttgaacccgggaggcggagggtgcagtgagctgagatcgcaccactgcactccagcctgggtgacagagtgagactccatctcaaaaacaaaaacaaaaaatgaaagttgggtacagtgattcatgcctgtaatcccagcactttgggaggccaaggcaggaagattgcttgaggtgagttcaagaccaggctgggcaacatagtgaggccctttctctacaaaaaatgttttgaaacttagctgggcctggtggtttgtgcctgtagtcccagctactcaggaagctaaggaaggaagatctacttgagcccaggagttcgaggctacagtgagctatgatggcaccactgcactctagccttggtgacacagtgaaaccctgtttcaaaaaaaaaatatttttttaaatgataggtattaatatataccttaaccattttgttttagatgaaatttaaatgtgcattcatttgtctcagtgtagggccaaggccttaattgttgatgtgcttattaagttccatattgactttgtgtaaatttcactctaatgaacacaaggtctttggctcattcatagtggaatggaaacttaaagcagcttgcaagccatgggaatgccgagtccttgtagattgctgcctcagccacacccagtcaacacagcagcttttcaaatttctgccttttaactttaccaagttttttcagatcattcaatttagttttcctacaaacaacgacctttttttgcacttacattgtacaggattattcaatatttagtgtgtgacaataaccaatacagctggccacaaatacaacagcctctgagatgcacagaagtcagctggtgggagcagaactgtgcaggtgtgatggtgacaggccgtaagcatgcagcatccactggcatcctctgatttccaggagggataggaagtgtgcattcactgggcagcgcagtcaagcattctgcatttctgctggggcactgtcagatgggtcttcttggctctgggtgctaagagtgccgctgctttattttccttgcttctctttcctgcccgtgaaagacctgacactgtgcttctctccaggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaaggtgggtgtgctccgaggtaggggcctgatgggcaagctcagtgaaggaggccacacgtgggtatccagggctctggcctggacgtgcacccaggagcggcagcctgtctgacctgggtgctggcacgtagggtaaagggagtgtggcaggcgtagtgggagcgggtgtttgactgaggcttttttcctgcagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggtatgggcccggaagggaggtgagggttggggtatgctgacttgggagctgccagtctcctgatgggggctccatcataatgggtcatgaagtgggtgggccttggttgacagccatttattgaatgcttacagtctgttgagtccagttctgtgcctgtagtctgacagcaggggagtgaggtgagtcctgttactgccttcctgttgtgcagaggtggagacagatacagggcagccaagtaacttgtctcagtttacacgcacagcttgtacagcagagatttgaagccccttaatcggcctctccacccctggatattttcctcccataaatggaggtgatggtgtctgaaagtgcactgtaactggggcgctctggaaacagcctgttctcacaccactgatggctcactggacacttcctccttgcaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatat

SEQ ID NO: 386 - DNA, 158706 bp, Homo sapiens
agtagccgggccaaggcgggagcggctgcctctcagggtcgctccagggccgcgctaggaaaggtgtggacggtcggagaggacaggaaggagccggctgcaccgcgccagggtctccgcaaaccgggagcccagggagggcgggaagactggcgggggtccgaggcagcccgctacaggatacgtgatggacgcccagagacaccgccctccagctggtgggggaggagccccagccaccaagaagttaagtgactggcccagttcacacagcaagctagtggctgtgtgcgtgtccggggtcctcatgggccccaggcctgcaatgcgtacgccccttcccctggctctgcctttggggtctcggacgcccgactagcactttggttaaaatgagaggaggacgggcgcctgcagcctgcccggtgctgtagctttgcggccgccccggcgcctgtgtaatccgaggcgtggcgcgccaggttttggcctgcgagggagcgcacgtgggctgcggcttctcgcggacgcccaggccccacccacccgggacccggcgcgcggcgccccagtttgactttcactacccccaaaggaggtctttccaccggcctcttttctgggtaacagctccagggctcacacttggtgaccccaccgaggtcaagtagccgctaagttacggagccggaattcgaatttggcggtcgggcttctggtggcctcgggacggaggtggctgtgtgtccctgggcaagtctctttccttctctgggtagcccagtcgggcgccccgcctgtcgtcgccgcgcatgctcagttgcgggcggcgtccggaggaggtggcgggcgccccagctgctttgcattgacgccagcacccgctggaggtcaccgctgggggctcggcgcggcacgctgccggcaaaacccggcccggatcacggagccggagccggagccgtaccgccagcaactcctgggtgcgcgcagccgtttctgcgcttctcgacggtgcggccccaggccccgctggagccgagctgctcccctccctaccctggcggacgtggcccggccgctccgaggggtttccctcggaccccgcgcctaaaccccggccagcgggagcgtctaaggctagccttgtaccccaccggcactcggcctgggggggcttttccgcgaggcggcggcccagcgggcggagcggcgtgggtgtccacatctaggcggagtctggagccggggaggcggcggcggcggcggcgggagcggggccgggcgcggccgggagctcgcctcccccgggggtcgtgccgcagctcggcgagggcagcgtggctcgcgcggcgtggactcagccgctcctgggtaaggagagcgcaaatctcctccccctatttccccggaagcgcggccgaggcgagcccggcgatgtgagaggcggccgtcggctcctgcctcaggaagggcatgttcggaggggcggcctcggcacgccacccgcctaagcgcccccttcccaccgcagccgccgccgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtaaggggcgccgggcactctggggccgccgcgaaactcgggcccggccagtaagcaactttcccgcaggggccgggcggggtcccccccacccggcctcggtgccctcttgtcccgctttggatggttctgattgacgccagtctcccgccttgccggggcagcgttcagagaaggaccgacccaggtcccgcgaccctgatttcctagggttgcgattaggacgccgcctgtgtcgcggcgtcggttttttggacacatccgactcccggagcggcggggcccgatgtgaagttgactgaggcgcttgcatcaatttcctctccaagagcgggtgtttgagggaaacccccaggatattctggcgcgcccctgcaatgttaaatcagtgtgaactttgttcttttcctgtggtagaaagggaagggcgactggcctcaccactcttttccctctgtcagctttgcacatgcagttgcaggttaccattttcttcgggactgctagaatgtaatctggaacatcagctttgcttcattgcacatgtatttgaggtccacgtttattagcatacatactgtatttaaagcatatgtaattagaaaatactgtgaaacgcgatttttgaagcattcagcagaacaaagttaatcttttattaagccgacttactgggacattttgtgactggggttttttgtttttttacattgcgtgtcttctccagcgcatgttgccttggcttatgttttgtcaaagtttctgggcttagtctttgttgaggttttctaaaggaaagttaaaaaggaaaaagaaaaacgtgatcattaaggcacacagcagcagctttccagttctctcatttcagaatttaaagctggaactcatgcgttggtttatgttttgttaaaccagtaaaagacaacaacaacaaaattcgtgcatggctgcagattgttggctgtcatccctctcatcacgaccagtttttgaaagagtaatttgcaaaatttgtttgatttttccttgcttgctgagaactgctgaacctccgaagtttgagggatatagtttgatgtactttctgtcttacatttctagcagtcgtcatgatactttttctgtacgaaaggggaaagtctttttcagtgttgcataacagttgatttccccaccattcccataccctaagtgaaaattcaactttgttctgattatcagaaattgaattccttctcctatagattctttaaagaaacctctgatggtttaggcttactaactcaaggtgctcttaatatcagtgttaagctgtgtgttaagcctacttggctttaaaaaagtgttacacaggtgcatatggaaactttaacagctttcaagttttcagtccaaatctaacattttgcagactaatgtgataatttcagattaccaaagtagcccttttatagtgaggggcctttgtgtcttacaggctttttttgtggtggattgggtgtcctaaaattcacctaggtgtcttgtaagcctccccagtgcagcagcagcttgctcttgtgctatcgcagtgccgttaggtccctgagtttttaagtacttacttcaaccattcttctgtattggcagaccattgtcttgtgttgggggctcagaaaatactttcatccttaaagtgcctaacccagtggcatacacatagtaggtactaaataaatgtttactgatttcttaaaaaattgttaactgattgatgaaactttttcagtcattggaatttgatttcataaagcctcctatgtagacttcaaaataatagtatttccagagcaggagtcaaattataaattataacaccacaaccacagaaataatagccccatacttgttattcatgaactgtacatgttgatatctcatttacagttatttgcatttaggcatgtcagatagtagagcagaggtaaatgtcagcattttttctagtctaatattttttctttgaaaatgaatctttttaaattttaagatattaactatgctctggaaattcatgttagagaaggcaaactgctagcaatttagcaaaattaaatcataaaattagtttctttgtattatctcaagatgcaatttaattcattacaaaatttcttattaaaactgtaagtcagcatatctttaagtgaatttcaacaagaaattcattgggggatgcttttatagtcctacagcatttagtaaataccagtttatcagtgtgggtgggagattgataactaattgcatttttaggttaagcagtatgtactttgcgttaaagtgtatcctgcatgtgttctatggaacaatatgtggactgttagtattgtatgagaaaagagttccgtggtctggtaagtttttgggaaatacaggttgaatatccctaatcagaaaatgagaaatgttccaaagtctgttttgagtgctgacatgatgctcaaaggaagtgctcaatggagcatttcagagtttggattttcagattagggatgctgaactggtaaatataatgcagatattccaaaagccaaaaaaaaaaaatccaaaacacttctggtctcaagcatttgggataagagatatgcggcctatactggctcagactaagttcaacagagttcttttatgtagggcttgtcagagaacctaatttctgaaagtaatctgtgagtctccaagtggtttttagagtgtgcatcatttcctaaactagttgattgtggagcccttttcttgaggtgtatgtcaggcaggccacatgttaagacctgattctttatgtgagataccaatattcaaagtacaagaaatataattaacagtaaaactcaacgaatgtaatttgcttcttaatgattccaaaggtactttagatcttgcaatatattaggctgggttgtctgtatgaacttatttaagtattactaaaaataccctctgtctgtttattcctttcgggagtttaagtttatgtggttacagataatgaatgctgtgttcagtttgaacacttagagttttgtttatttttaatcagtgtgagtgagccttaactgtaacattttaatattttcttgccagtctttggatttaccccatttccactttccctagccaggacttgagttgcccttgaaagatttgcatgtagtgttagagaccctatgctcaccccctatcttcctttttgcaaacacccactgcactgctaatgattgatgctccccacaccccaactaatcaactctgtgagatggcagtcatgtttgttttgttcactgctgtatcccccaggcctgatgcacagtaggccttccgtaaacgtatgttgaattagagaattttgtgaaccaggctgtcaagttgaaaatccacccaggccaggtaagtagaaatagaagccagttttaaccagagtagaggctgtaaagtttggatttggttttgtggaaatctctggttattgctcttcagagcactgtacccagggaataatatatttctaccctgttgagcagagtagatttccctgtaaagaaagattaaagaggctgggcgcggtggctcatgtctatagtcccagcactttgggaggccaaggcagaaggattgctagagcccaggagtttgagaccagcctggacaacatctcaagactctgtctctaccaaaaaataaaaaaaattagctgggcatggcaccgcacacctttagtcccagatacttgggaggctgaggtgggaggatcacctgaggtaagaagttcaaggttgctgtgagccgagagtgcgtccctgcactccagcctgggcaacagacagaaaccctatctcaaaaataaataataaataaaagatgtaaggattagtgcagctaaggtgatagataatagtacagctgcaagccaacctctaatcgagtgttactgctgtcagcactcacttaaaatctcagacattctctagttggtccatttctgtttccctttgcttctgtcattcacttccttcaacctcttttctcttactttgcatcacctcccgtcccacttccatcttcctccttgcttttttctgctagcccaccttcctgcacaaaactggccactcttgccatcttagtcaactaaagtttagtggtttccaaatgttacttaagtaacatttggaatggaataaaatttattgcctgctcctagtttacaaagtggattagtcaaaactttttttttttttttaagacagcgtcttgctttgttacccaggctggagtgcagtggcacaaccatggctcactcagccttgacctcctgggctcaagtgatccccccacctcagcctcccaagtaactgggactacaggtgcgcaccatgcatggccagttttttaaactttttttttgtcgagacgagatcttgctgtgctgcccaggctaggctcaaactcctgggctcctgtgattcccccagcctcagcctaccaaagtgctgggattacaggtgtgggttactgtgcccaactgattactcaaaattttacatttggctaaactaaagcaattttctctttgtgtgtgacctgactgatttttttcctccagtaggggtctttgacccttgctagattatatggaattactgaaagtttcctttgaaagtgtagttgagaaaaatgagaccaaactttctgctgccatagtaagtgactacagtttatctctagagctcaggggttgtgagttccctcattgtgttcttgtgcttttcagtatatagaaagatatttctttattcattttcttgaattccttttacatacataaaatactttgcatttatagcatatgttttttagtacttactgtcattgccaccataactttaagtgtgattcttaagatagacattgtcacaattctgttacctgaaacctgtccctgaccagctttgaccctcgccttgctgaggtaaggtttatgatagggcctgtggtcccttctggcgcaaatgtttcctgtgaagtggcttatgactggttttcccttggatagcttacccatttggattggttccttttttttttttttttttttttaaagacagttttttgctcttgttgcccaggctggagtgtaatggtgcgatctcagcttaccacaacctccgcctcccgggtcgaagcaattcgcatgccttagcctcccgagtagctgggattacaggcttgcaccaccatgcccggctaattttttttttgtatatttagtagagatggggtttctccatattggtcaggctggttttgaactcctgatctcaggtgatctgcccacctcggcctcccagagtgctgggattacaggtgtgagccaccgcgcccggccttggattggttcttaaataggagaaggttcatgatgtgaggacacagggtgaggcagacatcccagagtaaccttaaaggacagaatattttaaaaaattttaaaaaaaagaacagagggataagtacttaggacatgagtaagccctcagtcttacccaagcttagtggcttcatcctggtttctcagtacactgaggcagtaggaggtgatggattctgcagttcttagagtgcaaactattcatattaataatagccaccatttcttggatgccctctgtgttgcaagcaccatgttagatgctttaaagatgttatctcatttaatcctttcaaccctgtgaggtggcaggtatcatttccctttagcagataagacaccagaggttagaaacttgtccgaggtcatacatttaagctgagattcaaatccactggtcctggctctcacctgttaggttgttgctctctgttaactagctatgttcattgcatttcccattctttggtcttctgctaagctacagatttcacaggacaactgggttttaagcaggcatcttgaatctgcattatcaggattttgttaagtttcgacttactgtggaagttggttacagctctaccttaggttcctgtgtttgaggaagttgaagtcatcttcagccctgtgccagttaactcctgaagctagatattttgtgacgccctctgaatctgccctctttgctgtctgaaatgagttgggagggcatcccttgggagtttttttcctttcccctttctcctgctcaggtttcaggcagcctgccctaccaagagttccccaggagctggttctttccattgccctttgcctagagtgctgttcccccaccagtgctgcatgtacctatcttctcaggagttagtcaaggcccagctgaaagcttccttgagcccttggctggcttgcactcttttctctgctcttgggacctgctcctgtatccgtgtgagcctaggatttctgtcttcagccttctgctggattatatgctgcttgagggcaagcactgtgtcctagtttccttatagttcccaaagtgcttggcacacttggtaaatatttggataagtacaccagtctctaaggctgaaagggcttttattcatgttccacgagtctatctcaccttgtttagatttaacaaaagttgttggggtgtattctgtgttttaacagaaagctaaaatacccttaagccagtgattaatctgtggggtgattagtaaagcttttgcctccaattttgtctgagttagggttaagcaatgttcctgagtcccctccttctgttctacttttgttctgctctgtgtggtaaagagtggtagagtatcatgtcagagagctgttttgacaagtttatattgcatgtcttagctacaggcaccatgtgtagtttgcccatccacacaggaaggatgttgcagatttcccagaactttgagggtgacctccaataatttgggatggggggctttgccagtgcttttattctgtattggttggaaatagacctttgctgttttgaattcatcctctttcactgcttgccttctccctttcatgtcctattagggagtacaggagctgcttcacttcctcttactctgcttataggataacccaaagcgctggtggcacatcagcagttcccaggttgtctgcaaaggtttggtgttgatggcagctccctagtgaggtgttaaaagactataggaggaggagccagaagatgtgtgttttgggtccagctccatcaggctttggctatgtgatacttggcaactcctgatcctgagttttctcaagtacagagtgaagctagaatacctgggttctggtaaggataactaaaaataatctgtgtgaaagtgttttgtaaactccaagacactatcgcatgtaaggattgaccattttcttatgagaacctttctcaaaggcaaacttggttcaaatatatctattttttaacgcagatctcatttttaatatagtttttctccaatattttgtgaaaattttcatagagcaaagttgagagaattatgcactcatatgcctgccatctggattctgcagttaacagttttctatatttgtcttatatctgtccactcctttatccatccatcaacccattttatttttggattcatttcaaagtaagttccacacatcagtatactcaacccctaaatattgcagtatgtatatcaagtactagagcgcaaaatttgaactttgggcatggtaacacacacctgtagtcccatctactcaggagctgaggcagaaggattgctcgagcccaggtgttcgagaccagcctgggcaatatagcaagacctcatctcaaaaaaaaattaattcaaaattaaataaattcaaagtttacatttttaaatgtgaaatgccataaagtaaaatgtgtaaattttatgtgtaccatttgtgagatatgacaaatgtatatgtctatgtactatgaatctctgtcaagatacagaattacacaatattataatcacccccaaaagttctattgtgctccctttccattcttacccccagccaccagcaaccactgttctgaattttttccattataaattatttttgcctattctagatttcatgtaaatagaaccttacagtctattctttttttataaggcttatttcactcagcataatgtttttgagattcttctatgctgcacgagtcagtagtttgttcttttttctaattaaagtagtctgttacatgaagaaaccacagttcacttatctattcttttgttattggatactagggctgtttctaatttttggctattatgactaaagctactatgaatattctagtacacattattttgtggacatgtgctttcattccccttggttaaataccaagaggtgaaattgctgggtcataggataggtatatgtgtagctttttaagaaactgcttgaccttttcccaaaatagttatccaatattacactcatgccaacaatgtataataaaagttcagttgctctacatccttcccatcatttggtgttaatcagtattttaattttagccattctggtgggtgtgtagtggtatctcattgtggttttgatttgtatttccttgatggctgatgattttgagtactttttccgtgtgcttgttgttcatttactgtattgctgtctttttaaagtttttattttaatacttttttattaaaaggaaatataaacattatgacctctgggtagggaaggactgattaagcaagttacacaaggcatttacataaaggaaatggttgataaattcaactacgttaaaataaagaacttctcatcaaaagagagtgaaaaggaaagcggcagactggaagaagacatttgcaatgcatagtaccaataaaggattagtattcagagaggtcctaaaagtcaataagaaaacaaccgcccagttgaaaaattggaaaaggttgggacaggcacagcactaagaggaaaccaaatagctaataactatatgaaaaggttttcaacctcattggggaaatgcaaattaaacccacaatgaaataacattttatactcatcaaattggcagacatttaaaaggttggcagtattttgaggaactgctcaacattaagtagaggtgtaaattagttcaactactagggaaaaacccattgtcattgccaggtagagttgaatatgtgaccctgtgacatagcagcttctcttctagaaactcttatatatctttactggaaacatgtacgagaattttcagagcagcattacttttaattccaaactttcctgtaaaacccaaatgtccattaacaacataatggataaaaaagttatgatatgttcaaagaaaggaatacttcacagctgtgaaaaatggattatagttttagatattaactttgataaatctcagtggagagaaagaagaagccatcaaaaaatctgtaagttatgattctttttatttaaagattgataggctgggagtggtggctcacacctgtaatcccagcactttgggaggccgaggcaggaggattacttgaggccaggagtttgagatcagcctggacaacatagcaagaccccatctctaacaacaaaaaaaagattaatagctaaacaatatatagtaatacacacataggtgttaaaacttaccataaaatcagttcaggcaaataaagtttattttaaggacttaaatgtttagcatgttaatttgagtgcctaatatagaggctgtaggaggataacaggccctgctctcagggaacaattagtcctttctggaaaggtggggtaggtctctgacctggaagtgatgatggcaccttgggggatggattgtggaggcaagagcttggtctggattggtcataaggtatagaaagaggaaaggagggagaggtttgacctgggcttaaaagactgggaggatgtggataagtggaaaatatatctctggataaggggaaggaagggtacgggggttgggtgcatgttccaattatgaggaggctgaccagagataggacgggaggtctaaaagccaggttgaggagtttgaagtccatcctataaacctcagagaactcccaaaggcatttcattttcagcggggtagtcaaaggataaacatgtttcatgaagattaggtttcaggcaaaaattgcagtaggtggggtgagggacagctagaggtggggcactatgcaggacctattgcagtggttcaggcacaaggtatgaccaggtatgactaacttagtgcagtagtttgggagaggagggaatgagagaaggaaaaactgactagtgacaaattggacttggtgagtgaaagggcggagagtggagggtgactcagaggttggggtttaccagcttagaaggactgtgataacatgccacaatttgtacagtgctttatggtttaccaaatgctatttttgtacctcatctcatttgatgttccccaaaccatggggaggtggaaaggagggattttattttccctgtttaaggcctaaagaagcagaaattcagagattgaatgacttgttcaagtttgtggtgaccacttacagaaacaggttcactgtaatagcataagggagaagtcacaggaaagcgaatttagggagtttttaaaaaacctttcttgtcttttggttctgagttcatcttataaaaataaacttttacttttcctgattgtaaaagtcatattcattgtagaaaacttgaaacatatagaaaagaacaaggatcggctgggcgtggtggctcatgcctgtaatcccagcactttgggaggccaaggcgggcggatcacaaggtcaggagatcaagaccatcctggctaacacggtgaaaccccgtctcttctaaaaatacaaaaaattagccgggtgtggtggcaggtgcctgtagtcccagctacttgggaggctgaggcaggagaatggcatgaacccaggaggcagagtttgtagtgagccgaaatcgcgccactgcagtccagcctgggcgacagagcgagactccatctcaaaaaaaaaaaaaaaaaaaaaaagaacaaggatcacttaaattgtacaatcacttaaattgcacagtcaggagataatgtctcttaaaatggtggtgtgtttccttccatccatgtagattgctttaaataactataattaaaaacttttttgggctgggcgtagtggctcatgcctgtaaatcccagcacttttgggaggacaagatgggagaatcacgtgaggccaggagtttgagaacagcttgggaaacatagtaagacccccattctctataaaaaaaaataataataaataaattagctgggcatggtggtgcacacctgtaatcccagctacttagactgaggtgggaggattgcttgaggctgggagtttgaggttgcagtgagctatgattgtgccactgcactccaacctgggtgacagagtgagaccctgtctcttaaaaagcaaaaaacaaaaatattttttaagcagttttgttttttagttctaggaaacatttaactattatttatttaaatgttgtccccttaagttttctcattttctcttctgcagctccctccaaaagatagattgagacgcatcttgatctgtcctccgtgtctcttcacttttcttttacttcccctctctgtgctatcttctgggaggattttttagctcaatattttaagtcacgaattcattcctcaaggtctactcagctctttagcccactgagtttttaaatttgagtttttgtcttcagtctatggtttgctcttttttcttaattgcttattcatgttttatggttgcagcatacttccttatctctttgaggatattaattacactcactttaaagtcctattctgattgctgtattaaaaacactttttattgagttataaatgtaatcagccaaggtgtacaaaatccctaagtgtacagcttgatgaattttcctcatgctcccatgtaatcaccagccaaatcaagacagaacatttccagcattccagaaggctgccttgtggctgtttactgttttttagtatttttaacattttatgaaaaatctcaaaatacagcaatcttgaaggatttttcacagggtacccctgtgtacccaatgcctgtattttacattagcattttactgtacttgctttatcacatatatccatgtatccattcttctacctatcatactcctttttctttgatatattttaaagtaattgcaagtgaggacgggagcggtggctcacgcctgtaatcccagcactttgggaggctgaggcaggtggatcacctgaggtcaggagttcaagacctgaccaacatggtgaaaccctgtctctactaaaaatacaaaaaattagctgggcatggtggcaggtgcctataatcctagctactagaggctgaggcaggagaatcgcttgaacccaggaggcagaggctgcagtgagctgagatcacaccattgcactccagcctgggcaacaagggcgaaactctgtctcaaaaaaaaaaaagagagaaaaagcaattgtaaatgttagtatactatacttccccttaaatatttcagcatgaatttgatatttgcttaggttttttccttttgaagcaacatttacacacagtgaaatgcacaaatatttagtgtatatttgctgagttttgacaaacgcatacatatatctgcgtaatccaaacctctatgaagttatagaacattattttcattccagaaagtttcattatgctccttattggacaatctcttcttgcaaccacccttctgatttttttcttaccacagattagttttgcctgttctaattttaatataagtggagttacacagtatgtacctttttttttttttctgaggcagggtctccctctgttgcctagactggagtgcagtgctgtgatcatagttaactgcagccttgacttccctggctcaactgatcctcctcccacctcaacctcctgggtagctgggactacaggtacgcaccaccactcctggctaattaaaaaaattttttttgtagagacagggtctcattatattgctcaggctggtctcaaactcctgggctcaagcagtcctcctgcctcagcttcccaaagtgttgggattacaggtgtgagctaccacgcccagtgtatgtacttttatataagacttctttccctaagcgttatgtttttgggattcatctatgtttcatgtctcagtagttcataatattacacgattaacttttaaaagctcacgataaatattgttaaattgccctccaggaaaatgtgatgaaattttgtaattaaaaaatccctgagtggctgggattataggcatgcactactttaccctgccttgtggtcagatttttatttcataaggagcatgtgagagtgctttgtggtgcattcatcaatctgactgtgagaggtggtattttattggtattttagtttaaacttacttcatttattatttgttactctttatttctccctagtatgttttggacatttgaatgtcctcttctgtgaatttttcatgtttgttgcctatatctctattttggttttagaagttaaattattacttaaaagaactttttaataagtttgaatgttaaattttgacctctcatgtgcattgcaaatttttttcctcaagtatctttttcttttttttagatagtgtttttaaaattttttttaatttaattatttttagagccagggtcttgctctgttgcccaggctggagtgcagtggcagcctcactgcagcctcaaacttttggactcaagtgatcctcccaccttagcctcctgagtagctggggctatagatgtatgccaccatgcctggccgatttttaaaatttttaaaaaagagacaaggtctccccatgttgtccaagtggtcttgaactcctgggctcagaggatactcctgccttagcctctcaaaatgctgagattacaggcatgagctaccgtgcttggcaggtatttgtgtatctaaacatagaaaaagtataataaaaatacagtataaaagataaaaaatgggctgggcatggtggctcatgcctgtaatcccagcactttgggcggctgaggcgggcaaaccacctgaggtcgtaagttcaagaccagccttgccaacatggtgagaccccatttctacttaaaaatacaaaaattaggcgggtatagtggcacatgcctgtaatcgcagctactcaggaggctgaggcaggaaagtcgcttgaacccaggaggcagagattgcagtgagccgagatcgcaccactgcactccatcctggacaacagagcaagactctctcaaaaaaaaaaaaaaaaaaaaaaaaaaaggtggtacacttatataaggcacttagcatgaatgggccttacaggactggaagctgctgagtgagtcagtgaatgagtggtgagtgaatgtgaaggcctacgatattactgtgtactactgtagaccttataaacactgtacacttaggctacactaaatttgttttaaaaatttttatttcttcgataatctcagcttactgtaacttttttactttataaagtttttttaactttctgacacatttgaagtaatacttagcttaaaacgtgaacatattgtatagctgtagctaagtattttttttcttcacatacttactctataagcttttctccattatgtttttttttctttttgagacagggtctcactctgtcacccaggctgtaatgcagtggtgcgatcttggcttactgcaacctctgtctcctgggctcaagtgatcctcccaccttagcctcctaagtagctgggactgcaggtgtgcaccaccatgcctggctaattttttgtatttttttgtagagatggggtcttgctatattgtccaggctggccttgaactcctgggctcaagcaatccacccactttggcctcccaaagtgctgggattacagatatgagccaacgcacccagccttgatttttaaatttaataataaattgcagccattttcccgttttattaatttcttcagaacatttatatgatggtactaatgctgccatgtacatctttttttgtttttttttgagacagagttttgctctcgttgcccaggccggagtgcaatggtgcgatcttggctcaccgcaatccctgcctcccaggttcaagcaattctcctgcctcagccttccgagtaactgggattacaggtgcatgccaccatgccaggctaatttttttgtgtttttagtagagacggggtttctccatgttggtcaggctggtcttgaactcccaacctcaggtgatctgcctgcctcggcctcccaaagtgctgggattgacaggcatgagccactgcgcccagccatgtatatcttcttacaacaggtttaagatgggtacaattttataaggctttgtgcacaaagacttggatttattcttagaatctacttttaagtcttaatttcaggttttaaaacattttagggtagtctgtaatgaaaaagccctaaattaaaaattttttatgtataaacttggctttagataagttacatttacttattgaaatcttccattttcttaagaaatcattcctgagtgggacctttgactttaccatatccaacttactttctcaatttatggaggaggaaatcgaaaccctaaggcagttgtgagacaggtgcaagatcacactgcaagtattggtgaagctgggacaagaaccccaagctaactcttgtcctttatctcatggcaccttttatattcatgggaagtgaaccagttacttcactccctttggtcactgagatggcctggcctcagactctgcatgctcttctaattcaggtttgcaaagtgtagccttgtccagcaggctttactatatcagaagcaataaagaagttgaacacttggaatttctaaacttggatgtcattagaggagttgctagattactgcaaaatggctctgttttcattttgaatgcatgtacagatacctattttttcatctcagtttgtaacccatgcatttggggttggagttggcatgcagtgaaacctacagtatttatcaatatgtagtcagtaactgtatttttgatcagcttcctttacttccctaacatttttaggtaaaaacaggaagtcttgttccttttttctccccaaatcattatgccctgtctttttgttattctagaattaagaaatagggtcttaaaaagccaaaaacttcccatgaggtgaattatagtaaaggctttccttgggatgaagaagtcagggttaaaacctgtgggccagcagtattttcaaaaggcacagaacacctctatggagataattgatagttgactatatgagcaaacatatactcgttttcaatattgctaaaaatcagttcttccattagacactaatctctaatgagattagttttcagacactatgagttagaaattattttagtggttttctagtctgacttcttgaactccatagtaggtattctcttgtcaattctcccatctacacagagaactccagtttggtaaattttcctgataggtcacattctttttttttttttttttgagacggaatcttgctctgtcacctaggctggatttcagtggtgcaatcttgactcactgcaacctctgcctcctgggttcaggcgattctcctgcctcagcctcccaagcagctgggattataggcacctgccaccatgcctagctaatttttgtatttttagtagagatggggtttcaccatgttggccaggcctggtctttgaactcctgacctcaggtgatctgcctgcctcggcctcccagtgtactgggattacaggcgtgagccaccgcgcctggcccatattccttattgaacaataaaatattccctcattcattcagcaaacctttggtgcttaccatgggctaggaactgcactggacacttgctggtaatgtgatgatgaataagacatggcctcccttttttgttgttgttgttgttgttgttgctgttttttgttgtttttgagacggagtctcgctctgtcgccaggctggagttcagtggtgcaatcttggctcactgcaacctctgcctcccgggttcaagcgattctccttcctcagcctcctgagcagctaggactactggcgggcaccagtacacccagctaattttttgtatttttggtagagacgggctttcaccatgttagccaggatggtctccatctcttgaccttgtgattcacctgcctcggcctcccaaagtgctgggattacaggcatgagctactgcgcccggctggcctcccttttaagatgataagctcacaagaccacaggcttgcctctaattgtgtgtgtttccactgcccccttgattttataaaacctgtatagaaatctaaacatattgttgctgcaatacagttaaaaagagcgggggaattgaaatctgaaaacttgcgttcaaattctgggctttctctttggctttggtacttatttagctgtgtgagctggagcaaattgaataacttgtctgtgagccacggttccttgtatataaaatgtggacatgagagaaggtataggaagataccttctaatctgttaatgcaccttagaagtgacagacttttcttgtttttctttgcctattaaccagaattttgttttctcaccagtgggtcactggagaaggaagctgtgttataatcctttcagtgctgctgaatatactgataatggaaaaataaacaggggtgcactggttttctggcctgtaaaccaaaaaacagttttcagtgccaaaagctgtgtttgtcttgcaaggccaagaatgtttctgcagtgtaggacagcttcagatcccactgaatctcttgggtaatcacatggttttggtttaggttcagttgtttatagggctagctttgcttactgtgctcagtttctgctgtagtaaaataatgtaggctggctggaggtggtctctgttcagggttattatgaactggccttgttcttccagtgtgcaggccctggctaatcagagaagtgtacctgtcccatagctaggctctggaaagaccttcaagcatggcatgtgaactgggccctggctcctccccaccaggtccatttggagtcagtggtttctaaatggtggcagtgagtgctttgctctggccctcagccttcttagctttctttaccactgtagagccaggtagctaaaataatctgccctgtttttcttccttatgaggacattttctggaatttttatcccaccttatccattcttctgaaaaacttgtcttcagacctcatttttctaactcccagataaccagaacctacatgcagaggtctaggagatctctaccctgcaagcagaggttcagaaaaggagcagagtgagcaaatgcagataccattgttctgttcccctgtctaacaccccctgtaactcccagttgccaaattcagactcctttctttggtctgtaaagcccagcctgatgggttcctgcgccctctccagcttcttcctgtgcctcacacactgaatgcctcgagtactcacatttccagggacttgataacctctggacttttgacggtgcagtttccttgccaatgctccgcaagaatttcttcccaatttaatcagtgtaattaaccaaaaaaacctcgatgaaggtagagcactaagaaggaagtaggtaactgttaaaagattttatgtctggaaaaaatgcccccttttttttgtatttgcaatattccattacaaaaacaaaaacaaaaaaaggcaagactaagatatgataaagggttccaactgtcaaagtcatgcatgctcagaggatggagaggttcctgtggtctgctgtaggacagtttttccctcctgactgtttcactatggccttgaggacccagagagtggaagaaggtcacggagaatggatggatatcctagggactggaagagcatggtggctggtactgggtatccttgttgaactccaggagggatctgaggttgttgaagtggcttcaccttgttgggcacctgaagacgtcattacaaatcaaagatcttctggatttgatggtgcactgctgagtgttggattatgagatcacagtgagtgtgtggcacaaacacactttctatgatcagcttgatacgtttctagctgtgacaccttattaaagcgtgggtcactagcctggaaataactaagactggtataacaataaagctgtcatgtattgactgtttactgcataccaggcactgttctaagtactttgtgcatgaactaagttaatcttatgacaatccagggggcttgaggttaccttaaaggttcaccttttcaaaattctacctttttttttaagagatggggtctcgctatgttgcccatgctggtcttgaattcctggcctcaagtgatcctcctgcattggcctcctaaaaaactcccacacacgtaaagcagcttttcagtttgtggacaccagcttgggtgccctaaagttcaattcaattctgactggaattagtgtagaccccccaggttaaggaggctgcccccccagttcagatgccaatcgaaagtagtaggtctttaggttgcccctaattgttgtctgacttggctacgaattggaagttctcatgaccaccctcttgggattgatgatttgctagactggctcacagtttacttactagattaccagtttattaggaaggatatatttattaaaggatacaaatgaacagacagacaaagaggtgatacacagggctaggtctagagggtcccaagcacaggagcttcagtgcctgtagagttgggtgcgccaccctctggcatgtggatgtgttcttgttcaccaacctggatggtccctgaacacatctttctggatttttatggaggcttcattacataggcatggttgattaaatcatcggccattggttatcagctcaactctcaacccatttcctctccacttgatcttagccaaaaggccgagaagcgattcccatttcctctcatctttcctgggggaggtgggggaggtatgctgaaaatcccaaccctttaatcctgtggttgcttgctgtggtaaccagcaccccatcttgtggttatctaggggctttccacaaatcacctcattagcataaactccggtgttgtggaaggggcttgttaggaataacagaagtcacttctttcacctttattggcctggagctgctccagagctgtttcaggacaaaagaccaaatattttaacaaaagataagctatgagtgaggaattgtggaagaagaccaaaatatgtatttcttattatatcacaactatactttggtatttctgtgtttttcattttacttctttgagtttagtgagatgtcatgaatttttttttttcagtcaagtttcctgattatattggtcaggtttcttttgactgtaagtgacataatgcattctaaactagctgaagccagaagtggaatttgtggatcaccatattctggcttacataaccagaccaagggaaggacatgggtatgctggcctctggtacaaatgaaaccaggactttttttccatctttccctgtcattggtgccatctttgtttccttgggctactttttgctgttcaacaggaaacaatgtccatcagtagctcctggcctcacattttataacttcatcagtagagagcttcttcccttaattccaatttgaaaatcctggggaaaaaccaagatgggcctggcttggaaacacctgcccaccccagcagccagtggacgacctctgcgatgggcaacaactttcacagaacaggatagttgcaatgagggggagcgcccctcagaggaggtgagggtactgatcagaacaatagctgtccctgcactggggttcagccaaggccccaaaacgctttttcagcataagaattaatactacttttatatgtaatgatagtttttattcctaatcttaccctgaggcagtttgtattctgaattgttagagaacttttccacttactctgtttgctaagagaagaataggtaatttgtaggaaaatttcaacaaggcttcccagttgacgttctcccttacttcgtgtagcctgcctaagagatatttaattaccctgcattgctcatcacttctcattttaccctgtccttagagaagagtggaagactgttctcaaagcagtgattcagggactaaggctccttctatctgtggctcttttatcttcaacatatggttgccaaggttgccatgcttgtctatatggacaagctcccaaaaggagaaaagagcatggagggtcatgagtgagaggtttttaacggccaggtctagaagtggtccatgtcagattacttactttccattggccacatggccacacttcactgaaggctgggaaatatgatctagctgtgtgcccaataagaagaggaactgagtttcagtagccagcaagccagcctctgccacagcttctttggtaacatttgttgcttccccttttcccctttgccatgcataatagttgtgtagtttgggtgggattgagctcatttccagctctagggtgggccccagcaacatccttgcctcatttattggttcagtaatagatacataacccaggcccaagctgagcaggacatggaattcatctggtcccagttactaattcaggggcaggcatgtcatagaaactgtcccaatcagactatggagtggttgggggaagatgttcctcccacctccctcacagccccccacagtgaggacaaagccaactcctgggtgagaataggcttagagaattgcaaacccgtattgtgaagtcctaccaaacctttcctgaagctcgcaagagctgaccctggactctgcgttagcatgaggcagtaaatccactctatcgcctaatactttaagattaattttcttgacttgcaaccacaagcatcctggctgatacaaccaatgaaatggaagaggaatagggagagagaaaggatacaatctgaatctctaagttctgcttccgttcattgctgtcagttctatgatgtttctttgaatacttgaacacaaccaagttgggtctgaatggatgtatcttagtttcacttccccattctctggaattagagtggggataattacattttttaatattcttttttttttttttttacctttagacaatgttttctctctggattgaatgatacatagtttctttgaagaatacattatgacattttatttctcttccaccataatggaatcatatggactcaacatagtccatatgattttttttcctgttttgttttagtgacttttctaaagtttgtcttttcatctaggaagtatatagaatacatttatcttacacattgcagtatgcatttgttttatagctgggtattatctctatattactataggacttttttttgttttttgttttgaaacagggtcttgctgtgtcacccagactggagtatagtggcatgatcacagcttgagctcctgggctcaaatgatcctctcacctcagccccctgagtagctgggactgctgccatgcaccaccacatctggctaatgttttaatttttttgtagagaaaggttctcactatattgcccaggctggtcttgaactcccggactcaagcaatcttcctgccttggcctcccaaagtgttgggattacaagtatgtgccactgtgcccagctgttattacaggaacttttaatattttgagttaaatattccaggccattttagaatttgaatagcttgtcaaatttgttgattttatagcacctccgtcttgaaaaatatgccccctggtgttcctaaaagaacattttgagagaattatatggtatttagtaaggcaattagaaatcaccaagtatttagggactattgcttaagaagctaatttgcacaatcagaattcattagcccaggacacagacaccttatacacctgtggtgacaaatgaaaactgtgaaagtccaatctgattcattcctctcagaatatggaggacaggagagtggggacaacctcagcattaggactgccctctctcgttttgtttcaaaaagagtttaagtaacttaaaaaatacatataataagtttaaaaaaaaaaggaaattgggccaagggaacatggcgagaactgaccaattaagtcaggagtgaggtcagtatgtggaaacacatgccacaggggcatgcatgattgccatggggctgggtcacacgttcggctctgagcttccacagcctcaccaaatacgaaaacagttgcagaattctggagatttaaaaatggcaaatgactcaggagaagtacagtttctgagctcagacctaaagaaattattctctcaggaaggggaacatcacactctggggactgttgtgaggtggggggagggatagcattaggagacatacctaatgctaaatgacgagttaatgggtgcagcacaccagcatggcacatgtatacatatgtaactaaccggcacattgtgcacatgtaccctaaaacttaaagtattattattataataataataataaaagaaagtattctcatgggtcctttcagagggacaaggttctgaacaatgttgccatcataaatgtggtggtgaatgtctctcagtgcaagctgagggcaggatgccatacacagattccaggtggggctaaagtacatggtccaggcactcagttagtttgatttgggaattaacatttagtctacctggaagaatgtggtattacccatttttaatcttggccaattttatttgcattaagttgatttgaaacggatatcagtctttgtccatatgtttatcaaccatttgtaattttttttatattgtctattactttggctgttttcctattggagaaatagagtttttcttcttgtgtagattttttaaaagttaagaatgttaatctttttgtcatgtgtggtgaataactttttttttttccctggtttgccttttaaacttacccctggtaaacatttttaggattgctcactgaaataggagggaattaggctactgtattgcgagtgggaggatgagattagggcatgtatatgatgtcccttctggcattagagacttttgacatgtacttgagaagagggaatatttggaatttggactagtccctacgaagaggagaggaggagtggttggggacatggagaaagcaccttcggcagcacttggtgtccagctgtggtgggacattgtgcatttaattaccattctgcaagctgtgtgatcttcagcagtgtttggccattcttctgtacatgggtgaaagatagacagttagattgatctggaattggagttttgcatttcgcagaatgtccagtagctactgatgagagagcaaaagtgtgggatgtgggtttgggtttgatagaagggaaaagcattagagggggactaggagaacagatgatatagggccaggcagtgtcagttaaaggggccaaatgattatatgcttagagcagtgcctaataggtggagcttctcaacacgattcagcatgggtggtggtggtaagtgaagactgaagaagcagccagccacagtagcacaaaagcaggcaaaacagatctgtgctgttagaattcagcacagtggtactgggaggggacacagggcggcttctagtatgccggtaatgttgcttcttgatctgggtgctggttatacaggtacgttcagtttgcaaaaataaatctattagtacagttacgctatatgtactttctgtgtatgttcaataaaatgtaaaaaataatgaaagagagcacatacttcggtgccccaccacattgttttcagatctcagctctgcaactttatagctgtgagaccttgggcaaattacttaacctgtttgtgcctcagatttcaagtcatataaaatgagaataatacgtacatcacaggagtgctgggaggattaaatgagtctcccaatagtgttgagtacatagtaaatactcccagagtgttgcgtattattattttttaaataattattataaatgcgaatatgtatgagggagaactgatgaattggaaatttgtggtcagagagagctcttggacattctgccaaatgacattcctaagtatggccatacagtggtgcctgtagtggagtggggttggactgcagctcatagtcagaattaaagggaagggtgaggtggttgtgttgccatatgaaccttgaccttgcccagggtgatggtagtacttggagtgagcttgaagcactgaggtccttaatgtatgtgagtgacttagaggtcaagagaaggtggcaggggtggcattgctgtgtgttatgagcctcagggtatctaggagtgacagtgggagagtcagaagctggctccctctaatagggagtggtctgggcagctgtggcctttgcagaaagtcctattccaggactttccctacagtgtctgtgcctgcatagtcagtggctcagggagggatcagaagccagggaactttgcaatgttgtgatggtgaaatatgggttaattatatttgcttcaatatattttcagaattccacgtgctgatacccgtaatactctgtcagaccccattactgcctttctccttgaaccttagctatatctgcttcccctcaccagacccttcctccatactgtgtaactcatcccccacccccagttcagttggagaaagttgaagtcattctagttccacactctgggccccatttttaataaccggaccctgtggctgtggacacattcccattttaaattctgctaccaggtataggtcttgctcttataccttatcctggctacctgccagtactccagcttccccacagctgaggtcttctttgcattcggccaaacccttttctgactccaggccccaagggtgcgagcctatcacctgatatgaacttcctccctcctctagtctgcctgaatcctccattaccaccttcatcccaccctattccaccttgcccctgtctgctgagccatctgcatttgctgaacctcgctaaggcatagtctgccaacattgtctgctgggggtacagagagagcctccctctccctgtgtctcgagttcagcacctattccaccttagtaagcctgtgaggctttccaggcatctctcccaagctggtctgtcccttgtcttcagggctcctgttctgacactgggcccatgggaggtacaagttttgagtcctgtaaaaagaaaaaagaaggaagtgtccttcacacaacttctgacctttttcttcacttcctggtgtgttagtgtgtgagagagagagagagagagagtgtgtgtgtgtgtgtgtgtgtgtgtgtgtgtgtgatgtttagggtctgaggatattcaaagtggaaaagggtataagagctaggtaatttttattttgtgactaggcaaaggcagtctaaaaaactgacctatggagacaattttagttctcttctacctgttaatgtaagagatgtaaaaactaaagtctttcttttcaaagtgactactagaaaatccttttggactgtaggtaatacagaatgtttataatcagaccaacaaaatactattcctacacattgttttctatgacctagaaataaggatgttacagatccttctttgtaatggaatttgttgtcctaagatcatacccattgtaaaatttaggacttttcgttggtaaataataaaatttgtggaaagaagtactcacaaggatttcaggctggagaagggactattggccattgtatttttcctggccagttttcatcaaaagtttagattttctccggactgtggtaggttatcttgtctgttatgacaaaaactaaccaaacaaaaaacaaatgtcacatgctgttagcaggaatgtaaattagcaagattactttggaaaactgttggcaatatttactgaagttgaaaatatgcatgttctctcaccaccagttctacttccagttatatagccagcagaaatgtgtagatatgttcaccaaaagtcactactagaatgtccattgtagtattagtcgtactagctaaaaactagaaataaccccatagttcatcagaagaataagctgtaatataagcatataatgaaacactttatagcaatggaaatgaaagatcattgctacatgcaacaccatgcatgaatttcataagcatcgtgttgagtgaatgaagccagacaaaaaaagattacatgctatatgatttagtttatacaaagttcaaaatcaggcagaactatggtgttggcagttaggacagggctcacctttgaggaaggggaggggtagtgatttggagaaggcttgagggcttttgaatgttctatttttgacctaggtggtaattatatgggtgagttcactttgtgataattaaccaagctgcacacttagggtttatattcttttctgtaagtatgttaaccttcaataaaaatgtccatcaaaaaaactttcagtgtttattatacttgagccacatgttcatatgcacctgtcccttctggtcttagggacttagcatgtgctttagcctcagtctcaaacagtttgacttcctttttgcaaaataatactcatcattttggaaaccttatctgataagctgcttccctctcttccttacacacagaagggagtgtgtagtttccctgttatatcctctgtgggcaccatgtcctgaaccacagctaggagttcacatgtctgtatgtatttgattgcctctcctgatgtttaaacttgaggacgctgggcctatttatgccagtcattatgtctctagggaccactacagtgcctacactcattggtatttgtcaaatgaatgaactgacttcaaagggaacagtctttttttctgtcacccatttcaacttttaattagggttagtaggaggttggagcccctgtgaggttgcatggaacatttttgagataatagtgactttaatagccttaaagtatgacctgtaggaaaactcagctgaaggaggggagcagttattggctaatcagtgtcccttaacctagttctgtgtttcccccagtcgtgttcctgagagtgaagtttatatatgatgacttcatttgttctggcttttctcatgacaatcctaaggtcaagtctattttaagtctgagaaatatgtcctggaagttagtttcagagtccctatttcctttttctctcctttgtattgaaatcttggctgtcctccccattccctccttccaaactgttcttagaaacgactttgcaagtatcataaatatcctctatgttgatttttctctgaactttagctgttctttttcagttagatatggggaagtggcacgttctcactcaccattctaacctgacagaattaagccaaaagcaatgttcagattggcccagtaggaagacgaattgaagatgagacatttacattacactttatttgctggatgatttttgtagggtttttttcttcttgtgtaatgttgttagaagacaggtttggagccagagagtactggtccaaaactcaaccctgtctctccctgctttttgacctttggcaagtttcataacctttcggggccctagctttttcttatttgtaaagtggtggtagttgtccagttttaattaaattttgaatgtaaaatggtctgtcaatgtgtaaaaaattataaaacactcaataaattgcagttgcctaaaagggaagcttcaactttattgttagaaaaataatggttttcctagaagaaaacctaggcattaccattcaggacataggcatgggcaaggactttatgtctaaaacaccaaaagcaatggcaacaaaagccaaaattgacacatgggatctaattaaactaaagagcttctgcacagcaaaagaaactaccatcagagtgaacaggcaacctacaaaatgggagaaaattttcgcaacctgctcatctgacaaagggctaatatccagaatctacaatgaactcaaacaaatttacaagaaaaaaaacaaacaaccccatcaaaaagtgggcgaaggacatgaacagacacttctcaaattaagacatttatgcagccaaaaaacacatgaaaaaatgctcaccatcactggccatcagagaaatgcaaatcaaaaccacaatgagataccatctcacaccagttagaaaggcaatcattaaaaagtcaggaaacagcaggtgctggagaggatgtggagaaataggaacacttttacactgttggtgggactgtaaactagttcaaccattgtggaagtcagtgtggtgattcctcagggatctagaactagaaataccatttgacccagccatctcattactgggtgtatacccaaaggactataaatcatgctgctataaagacacatgcacacgtatgtttattgcagcactattcacaatagcaaagacttggagccaacccaaatatccaacaatgatagactggattaagaaaatgtggcacatatacaccatggaatactatgcagccataaaaaatgatgagttcatgtcctttgtagggacctggatgaaattggaaatcatcattctcagtaaactatcacaaggacaaaaaaccaaacaccgcatgttctcactcataggtgggaattgaacaatgagaacacatggacacaggaaggggaacatcacactctgggggctgttgtgggttggggggaggggggagggatggcattaggagatatacctaatgctaaatgacgagttaatgggtgcagcacaccagcatggcacatgtatacatatgtaactaacctgcacattgtgcacatgtaccctaaaacttaaagtataataataatagaataaaaaaaaaagaagaaaataatggttttaacatacagtattgttagactccgaaaagtagattagggctttctttttaagaatttatttggaaattaattttgatgatttataaatgattatataatacccagttatacaatttacccttgggaacaaagaaggaaatataatattatattggcttgtataatcaccctcttactttggaaacaaaagagtgggagtgggagaattttggagaacctgatccactgttaactctaataatcgtttcctgaagaacagccccatccacagttaaacagaaatctggggatattaaatggagctttgtactcttgtcacttttttctttcttcatcaatttctagttgcttagaattaagggctacactaaatgaccctgcatttgttggtgagaacaggggaagcagagagatgttttgtaagggatggaaggtagtatttacatacaaaattcacagatttggaccttagcaactttgatcctgatgggcttgatagagaaattacaaggttaaaagggctttgagatgtggtggaaagaacagagacttcctataccctgcctctaccactgtgcacttttaacaagttattatcttctctgagcatcacttttcttatctgcaaaatgggaataatgaattctatcttttagagtttttgagattaactgagataatgtgataaatgatacttttcttaaggcagtgaggtagaaaagcaacaaatttttattagctctttcttcctctccttcaatttaatctattatatgtgtttgccagaataaaggaattgtgtttaaaggattgtctgtaattactcaacttagtattttgaaatattttattgtggagaatttataacatgtacaaaagtagaattatgttgtatttgttgcataacaaattaccccaaagtttactggcttaaaacagtaataagcatttatttctcactgtttctttggttcaggaatttgagagaagcggggctcaatagttctggctcatagtctctcttgaggttgcagtcaggtgttggctgggtctttggtcatccaaaacctttagtgggccagcggattcacttccaaggtgcttcactcatatgattggccaagttagtgcaggatgttttggggtttgaggaaaggcccaattcctctccatgtgtgtcagcttcacagggctgctcaggtacccgctggcttcccgcagagaagtgatccaggaagtcaaagcagaagctacaatgccctgtttgacctagcctagactacatattgtcagttccactgtattttatgcattacatataccagccttgattcagggtggagatgatacacgatcttgtgatgataatcacatctttctttcttcctttctttttctttttctttttctttttttttaaagtcagggtcttgctctgtcccccaggctaccaggctggagtgcagtggcatgataatagcttaatgcagcctcgaactcctgggctaaagctattctcctgcttcagcctcccgaggagttggaagtacaggtgcgggccactagtcctggccacagtcatcacatatttcattcattagtggtgatatggcggcaaatggtgatattctaattctctcattactttttcatttaatactgaatacctctataaagagaagctcctctcattaactatgtgataaagtttgaatagcataggcaggataaatgcttgtttcttgttctccatttattataccagttttcagaataatggtttgacttcctaatatcctccaaaggggacctgttaaatgttatttgtattactatgaagttaagtattttaatgtatttgatatgtttcagtcaattgctcttattacctatattgatgttcatatatttataccccttttagagaaatggtggcatactgtacatagtactcttgatttgcttttctcgcttcacagcatatccttgggatcactccatagttgtctatggaggaattgttcattcttaaaaaaattgaaatataattcatatactcgcccttataaagtagacaattcattggttttttagtataatcaaagttgtgcaaccattaccactaatcctagaatgttttcatcaaagaaaccctgtacctaataacagtccctccccattgcctcctgcccctttacccgctacacccccagcctctggcaaccactaatctattttctgtctctctgaatttaccaatgaacgtttgatttaagtaaaatcatataatttctggcctttgtgtctggtttctttcagttagcataatgttttcaaggttcatccatgttttattaatagtttgaatcagttcctccttccttttttagcagcacagtgctccaccggcttgatctgtctataccttagctaaccagctcatgttggtgaacatttgaacatttgagttgtttccctacattattatatgaccttgtgcataagtctttttttttttggacagggttgcccaggctagagagcagtggtgcaatcacagctcaccggagcctcgacctcccgggctcaggtgatcctcctgcctcagcctcctgagtagctgggaccacatcacgcctggctaatttttgtaaagatggagtctcactatggtgcccaggcaggtctcaaaactactgggctcaagcaacccacctgcctcagcctcccaaagtgctgagagtcatcttttttgttttttaatgtgaattttgctaggtgttgttcaatttccctctataagggttgtaccattctgaatttttaccagcagtgtatcagaaagtattatttctctactgccttgccatagaatattttgtgatatctcactatggtttttagttatcattttacttctcatatcgtgattgagattgagcatcttttcacatgtttaaactctgcattcctttttttgttaactatctgtccatatcactctagactctctccaaagggtcgtttgtattttccttccatttttggcatctctttctatattgcaaatattctttccatttctttatttctccttttgttttaagatgacttgtcggctgggcgtggcggctcacacttgtaatcccagcactttgggagggtgaggtgggcaatcactcgaggccaggaattggagaccagcctggccaacatggcaaaacctcgtctctattaaaaatacaaaaatgtgctgagtgtgttggtgcacatccgtaatcccagctacttgggaggctgaggcataacaatcacttgaacccgggaagtggaggttgcagtgagctgaggtcgcgccactcactgtacttcagcctgggtgaccaagcaagacttggtctcaaaataaataaataaataaaatttaaaaaatgacttgtcattgcaaatttaaatttttatgtaattaattctaacaatatttcccctaatatcttctggagtttgagtcataatgggaaagctttccatactccatgttataaaatatttacccatgtactcaatggttttatttttcacatttaaatcttcaatccatttggaatttatcttggtgtatgatatgaggaataaattcagtttaatctttttttccatatggctatggaattattcccagcaccacttattttgttcattcccccacactaatttgagataaattccattcataattgagttcatttctggattctctgtactgttccattagtctctctttaattatgtgccactaccacactgttttaattatagagctgtataagaattatcttgcaaggctattcctctctcttttctttcccttttcagggtcttctggctgttcttgcttgtttgtttttacagatgaactttataattagcttgtctagctgtgggaagaaaactcaaaggttttttctttttattgaggttgtattatatttacaaattagtatagggagaactgacatcattgtgatgttgtatcttcttatacaagaacatggtatgtctttttacttgtttaaatctcttgtggttttttgggagtgtttttatgactctcctcatagagttccttattgagtttatgccagatgttctattattttttgctttcataagtaggattttctcttccattatgtttctaactgaatttcccttttttttttttttaataaatgaagcctgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccaaaaaaaaaaaaaataaataaatgaagcctgttgattttgatatgtttcttatatagcctgctaagttctctgatttgtaatacatagcacataaattctttggggttttccagacatatcattatattatttgtaaatagagttttacctcttttccaatttttagaccactaattgcagtctcttattgcattggatagtatctttaatacagtgttaaaataataaagaagataatgttttatacaaaatagtgtgtcttgtttctaactttgtcaggaaagttctagtttttccccattaatatttagcagacttttacacttttattaaaggaataagaccggacacggtggctcacgcctgtaatcccaacactttgggaggctgaggcgggtggattacttgaggtcaggagttcaagaccagcctggccaacatggtgaaaccctgtctctactaaaaatataaatattagccgggtgtggtggtgggcacctgtaatcccagctactagggaggctgaggcaggggaattatttgaacctgggagacagaggttgcagtgagccgagatcgcgccattgcactccagcctgagcaacaggagcgaaactccgtctcaaaaaaaaaaaagcaatagtgggaggaaattatgtggagaaagtttttgtgttttttgcttcttttcaaagtatggatgagatatgcccaggatggtggtggtagatattgtgattatttctactctcaattctgtagttataatatccagaataagtatggtttgatgagcgtttcaaaacaaccactttggctatcaagtgaaaagtagattgtagagcaacagaagtggcagtaggctaactacaggacttttgcagctcttcagagaagtagtttggatttcatggtagcagtagatgtagagggatataggcaaacttgggatatattttggaagtagagtctgtagtggtactaattaaaatagtcatgtagataaactgtttcttactgtttcaggacaagatgagtctatgccagatgtaagtcaccacactcatttactgatttcttccttgaggattttttgttgttaaaaaatttttgtggttgatctgcattctgtcttaaactctttatttcattgtggattattaacagttggtccacgggccacactttaagcaacgtcaatctctagtatccatcttaggggcaaaccatgatctatttaaccagtctcttactattgggtagatggttaaccctcacatcatcttttttttagtattaggaataagtaacattgccatgaaatgcttgtttctataattatgtgtatatatcttatgctttctttaggataattcctggaaatagagtaaggattttggaacataatgacaaattgttctccattttacacacttgcagagccacatttttaccagtatgaattcttttttcaaaaaaatctttgctaatttggatgacaaatagcaagttgttatatgaatatgtacttatttgattactagtaagaatattttaaatgtattttttggaattgatacatccacctttgccatttttaatgctcttggatcatttttactttggggtgtaagtaccatttacattaaggttatttactctttgtataatgaaaatatttttcctctgttttaaaaatggattttggtatttttgcatcatgtagaaattgtccttttttatagactctcctagcagtatagttacttgggaggtgtagttggtcaagccttgctgcctccctgcttccatctctaaagaggttgccctttggtggtaagggcagttcactattgtgaacttgctggggtaaaaggttttggtgtgaggaacttaggagttaaaaactcttctgtaagggaaatgtatatgagtgatggatgatattaagaggttatttttaaattttgttaggtgtgaaaatggaattgtggttgagtagaaaaatctgcatacacacatagatgtatttaggggtgaaaaatgtgagggattttcttgaaaatactacagtcaaaaagatagacatagcaaatgtatcaacatttaaaaaatttttgatttgagtgatgggtttatgagtgttcttaacacttttaaaattttattttaaagaaatggggtctcgctgtgttgcccaggctggactagaactcctgggctcaaacgatccacgtatgtcagcccctaccgaatagctggcattacaggagcactgtgcttggcttcttaatactattcattatttttgtggggttttttttgttttgttttggagtcagagtttcgctcttgtcacccaggctggtgtgcaatggcatgatcttggctctgcaacctctacctcccaggttcaagtgatcctcctgcctcagcctcccaagtagctgggactacaggcacccaccaccacacctggctaatttttgtatttttagtagagacgaggtttcactatgttggccaggctggtctcaaactcctgacctcaagtgatctgcccaccttggcctcacaaagtgctggaattacaggcatatgagccactatgcgtggccagtgtgtatgtttcgaaaaggctcttgggtctctggagaactttgggggagtttttttttggtttttttttttttttttttttttttttggcttcctgtgactaggattctcttcttagtctctcttctggcactttgcaggccgggtggttggtgatctacattacaaatggagccaccagtaaagtcagaaatgagtcaaagaaggaggtttatggttgcccctttatttaaatgatcatggtcattggcaaataataggtattctttcttaggcacaagattactaatcttctcaattctctgtctgtgtttattttttatgtgatctgtctgccaaagaaggagagtagtgttttgaagtccttcagtcacagttgtggttttggcgagtttttcctcatacttctcacagctctgggcattaagaaaacaacaagggcccggcgcagtggctcatgcctgtaatcccagcactttgggaagccaaggcgggtggattacctgaggtcaggagtttgagaccagcctggccaacacggcgaaaccctgtctctactaaaaatacaaaagttagccgggcatggtggcgcgtgcctgtaatcccagctacttggcaggctgaggcacgggaagtgcttgaacacgggaggtggaggttgcagtgagccaaaattgtaccactgcactctagcctgagcgagactgtgtctcaaaacaaacaaacaaaacaacaacaaaaagtttttttaattttgaaataattttagacttagagaaaatttaccaaaaaaagtacaaagaattcctgcgtagtctctacccagattgcccaaatgttactaatattttaccatgggcttctatttattgcctgtatgtatccatattattattattttcttaatcatttaaagtaagttgcatacccgatgcccctttacatcccttcagtgtgttaattcctaaaaataaggacattctctattatcaatactgttaccaagatcatcaaattaacattgttacagtattgttagtaccacagaccttattcatgttgtcccactaatttcctttgtagctgctatggtctcaatgttcgtattctcccaaaattcttgttgaaacctaatcactaatgcaatggtattaagaggtggggcctttgggagatgattaggtcatgggggcagagaccttgtaaatgggattagttcccttaaaaaagaagattgagggagcttgttctcctgtccgccttgtaagaacacatagcaggtgccatctatgaagagtaggccctcaccagacactgatcttggacctcccaccctccagaactgtgagaaataaatttctgtttataaattgtccaagcctggtgtggtggctcacacctgtagtctcagcaatttgggaagctgaggtgggaggattgcttgaagccaggagttcaagaccagcctaggtgacataatgtgaccccgtctctaaagacaaattaaaaatttagctgggcatggtggcctttgcccgtagtcctagctactggggttgggggtggtggtagtgcagaggtgggaggattgcttgtgcccaggaattcaaggatgcagtgagctatgatcgtgccactgcactccagcctaggcaactgagcagtaccctggctcttaaaaaaaaaaagttacctagtctaaggtattttgttatagcagctcaaactgactaagacaacagcagaagaaaaaaaaatactgttactttctgatctcatatccaatccaggatcacacattaaattatcatgtctctctagtcttcagcctgaggcaattcttaagtacctgtccattgagatctagatgtttttgaagagtacggaacagttattttgtaggattttccttatgtttgctttgtctcctgttttcttgtgatagattcaggctgtgcacgtttggcgggaataccacaaaagggaggttgcgtgtcctccttactgcatcatatcagaaggcacattccatctgtttgttccattactggtgattttcactgtgatcacttaaggtggtgcctgccaggtttccttagtattttctgctttgaaatgaataaatatcttatggggaagtattttaagactatatacaaattctcttaatcattaagctttcaccaactagttttaacattcattggtcatttttgtctgaaatagctaataccacggatagttgccaaatggtgaattttaactcatgggtagcatgttttgacagcttgttattcagccatttggggtttgtcttagttcttttcagctgagatgtacagcagctttgtagaaaagggcagctagatctcagcattggtccaaagacatgggtgcttcacattttgttatatctgtttggacaggacctggatgggtcgagttctcacccatgctggacggggcaccctgcctctgcctgtctgctcttctctagctctagcaccagtccacccaggcagctttgtctgggtattggaagtgtttttttttttttttttgtaatgtctgacatagatcatattaactagaataaaccaggcaaggcggcatttttcagaaggggctatggcatggtagtgtcatatatatgcaaaatttttttttttttttttgagatggagtcttgttctgtcacccctgtcgcccaggctggggtgcagtggcgtgatctcagctcactgcaacctctgcctcccgggttgaagcaattctcctgccccagcctccggagtagctgggattacaggtgcatgccaccacacctggctattttttttttgtatttttggtagagacagggtttcaccatgttggccaggctagtttcgaactcctgacctctgatgatctgcccaccttggcctccctaagtgctgggattacaggcgtgagccaccggacctagccagatttatatctaatgggatcaagagaatatttattttgttgaatggaagatgaagatatatgaacatgtttacatgctaaagggacagagtcagtaggagagattaacgatcaagacagaggggactgttaagggagtttccctgaaaaggtagacctaggtaatggggttagctcttggcaagagaacggacactcaggaggaagttggaaggaatgaagggaagggaacagtactgtttttcaggttatgagtaggcaaacatttgaaggagttgttccctaattgcctcattttgctttgtgaaataggagtgagattatgtcctaagagttagcaggtacacgtcttgaggacgtcgctgaatagggaaagtgttgtggggaataagagcattgtctggggttcaccaaaggatttctaggcttctggtggtagagaccatgaattcttggtggcctcagtctgcaaggctctgttatttttctcccgcagtggttatcagctcaggtggagaagcataggaaataattgggttggttggggatggggctttgccacatattgtggtgggaaggccagggaggtaggagaacagagagtgggacaagagggttggactttgtttggagacgtggtttatgactccatggtggtctatacagaactggggaggtgggattggagagagggtaaaagagtgaatgtcttgagaaggtcagagaattattggaggaggaattaggttcaagattgctagcagcataggaatattagagagtagaatattggagtttagcattttcatcatgggacagttctggctgatgaggggctggagtggagcagggtaaggtgaagatcactgggttgtgagaaaacttgaaattggtggatgggttatttatgtggacattgacaccaccaggttgatgggaggacattggtggaggggggatgacagtgttccaagtgttcagggaaggagggagagttgagcaggaatgaagtattgaggccagatggcatgaacacacttaaaagatggcattttggttgccaagggatcagggatggtttggacctggaggtttggtggaactggctgtccacagcctccaaagatgtcttgatgctacgaagagtggaatttgctcagatttccaaaaaaaagttggtcattgggcctttgcttgtatttcttcttcctgtagctcccttgcctaccttctctacctggctaactcctgctggccctttaagactgagctctgagatcacctcttccgggaaatctttcttgaaccctctgatccgtctatctgtccctatgttccttatgcttatctctaacttagcaggtatcataccatatcatcgtctgctgtccttccctcccctagaccataacttccttgatgaaagcagggactgtatctttgcatccctggcacagtacctggcatatatttggttgaactatatgaaattgccatttaagaagtgaatttggtctagtttgtaatttctctccttaataggtgactttcttttgtcagctcatcttgaatctttttctgaagttacaagcccctttcttagtttggccttagccaagttccatgcaggttgtttctcttttagtgaccaactaatttctatgtgggccagtcagtctttcatcttgcttaggctttttttttttcttttcaccctctattactcctactgcgtaggctttttgttacattaacttcccttttgcttttctctaccctcagcagagggggtcaaaagaaacttctttgttcttagtcttccttagctgcccaaaatttcccagtagtttgcccatgcatttcattcccctattgactcttactgagtgacctatgtgccaggcaaaaattcggacttgttcattctagtttctctgcttctagtgtgtctcatgctggtgtttgttggctcagatgtgttaatggggctgccgctgctgttgtggttgttagtcattcttttgaacagcggctttagcttaccaatgctccagatacagtttttcagaaactcaatgatctgtgtgcattacacattaaaaagtgcattgaacaacagcatatccagattaaaaacaaacaaattagatttatctggtgtttttccattatgggttggagcaaacatgctgtgtataaatcagataaaccttttctttcactgtttcagactgagaattgtttgttcttgcttttgtggtcaccaagaatgtaatataactatgctcttcacatcctaaggccaccataagtcctggatcagacctgtttttttgaagtcacctgaattttgacttgaggctcccccaacccttactcccactacccctttgaactggatcactttgcttttaaggggcactcccttgaagccagttccctgaagtgacctactttcttgaggtgcttgaagagcttccctttcatttgggaggcttcctcagtgcccccattcccaggcgttttttcctgggagtcctgtcctattcatgaatttcctgttttttccaggggggtgggtagggggtgtgggggcaggcagtactatgttattatcgtaactagtgacatttaaagaaagaaacccaaagcccagttaaccaattacacttaaattctctgggcccaggcctgctggatgctctccatctaccagaaatgcttcttatcatcccccctcttttttagactgctaatccttaacagattaatctgagtttatatttagatgaaagttattcattaatagaaaaacctgaaactgtagtgagggctgacagtgttgaagtggatagaggtacataggccacctttagaccaaaaagtctttgtaaggcactggagtctttaagtgtctgctttggcacaaggacatcaggttatccttaggaagccaggaacaccttgagactcgggccagaacaatgtggcccacctttgagcttcaggtttggtcccagtgagtctcacgcctttttgatgctgaccatatatatggggcaaaacactctgtaatctgctttaccccactacacccatcccatccatccctagttgcaaaaatttcaacttgtatgaatatgcacagattcaatagtggaaactcagcactgttgagtgccaggcttcaaatatggaattagtgacctctgaacccgtgtttgtcaaactgcctgctaatgggtcatgacatcagtttagcagattatgcctagcactattgttccagttaaattgctgtgaaacaaaccaccccaaacttagtgacattaaacagtaaccgtttattatgctcatggattctgtggctcaggaattggacagggtacaatgggaggtggcttgtctttgttccatgatggctgggggttgggatcatttggaggctcttttactccacatctgatgtctgggctggggtgccttgaaggctagtggaatcagctgggaccaatgaccagaacacctacatgtagactctccatgtggtctgggcttctcacagtgtggtggctgggttccaagagagaggttccccagaggaagcatttagagagccagtgttccaaaagaacaaggacatttgataaccttgcctctgaagttacatggcatcacttctgttccggatttgtggatgctatctcaagcctgcacagattcaagggaggtggagatagagagatggagatctatatccccatctctcaatgggtagagagtcaaaagatttgtggctgtttttaaaactactacaagttcattttaaaacaagatagatgcttgagcccaaaagtttgaggctgcagtgaactgtgatcataccactgcattccagcctggccctgtctcaaaacaaaaaacaaaacaaaacaaaaaaactaaatttaaaaaataaaacaagttagaatatagaacaacagagtgcctcatgtagtcaaaaaaggcattgtgaaacttgtgtttcagttatgtgtgtctgtgtgttctggtttatgaggtaacgtttttctttctgtggtctacaaaaacattttttaaaacactgcttaactgtagtaacatctaatttggtttatgaacaccaaattttatctcttaatacctcagttaataggttactattgtgtggttctttgttataaagatgagaacctaaggaattgattgtcctttgcctgtaagaacaaaaagtcctttgggacctgttttctttgccctccaggactccctgaaggccttgttggactgtggaccagacttggagagtcagtgtgctgcagaatgggctgtggtctgggccaggagtcaaaacttccttaaagttttagtccaatctttgccagtcagtttcctagagtagcaaacaaatgtgaaatgaagaggacatacttctttttagagacagtcagaaaatatttagccatctggaagcccaagaactattcataataataaagagacagctacctcgcctgagcaaggtggtgtctgtggtaaagcaatctcaggaaaggctttctaccttcagtgttgaaatcaaaaggaaatactgagattggggtctgcaagaaaagacatgctatgtgtgttgccaaaacaatctgccttcctccccttgctgtgacttactgcgtttagttattcctaccctttcaaggaaatgtgcaaagatgactgagcaatggcatttactgtcatcttataaaacactgcattgcaaaacaatttttgggaatagtgcgattaaatggtaaattttgctcacgtatgttaggaaatttacacaattctgtgcttttatttcttcttattaaaatgagacatgtttattctagaaaactagaaaatacagataactgttattttaccacgtagaggagggtattatttaccactgatttttttttggttgcatatccttcctgtcatttttctgatatgtatacattttaaaaaacaaatgggctgttgcagtacactgttctgaaatctactttttaaacttagatgaacacattccatgtcaattaatgtacttctattataaaaacttcatagtgttacattgtatagagatagtatttgaacgcttaacgttgctggcaacatttaactgtggtaaacgatgctgtggtgaacatctattaatatataactaaatcttttttgtaatcatgattcctaaaattttttaaaaatcttttttgaatatatatgtacatggtacacaatgttatgattttccttaggagatacctatgtaatttgatctgctaaatcacagagcatgaacctattttatttattattttattagagacagagtcttgctcttatcactcaggctggagtgtagtggtgtgattatagctcactgcagcctggaactcctgggctcaaatgatcctccctcctaagcctcacaagtagctgggactacaggtgtgtgccggcacaactggctaattattttattttttgtagagacaagatcttgctttgttgcccaggctggtcttgagctcctggcctcaagtgatcctccttcctcagcctcgccaagtgctgggattacaggtgtgagccaccacgcccgcccagcatggacattttgaaaacaaaaaatttttgtgctgctaaattgtccttcccaaatgtaccagtttatactcctacaaaagtgttatctattccttgtatttcgcaatttgatagagaaaaaagtcacttgctttcttagttgggtgatttatttgcattttaacttctttagcattttacctctgaaaatcttgcctgttttttaatcctcatctcaaatacctcccacccgacccctcccgagcacctcccagcacaatgaagacttcccatctgctctgtcttgtggatttttcttgtcctttccaatcacctgtggtttacttgagagcattaagcactgtgtctaactcactttttaatcttcttttgcatgcagcatatttcattgcatatgtttaagactcagtaaatattgagttaaattgcagtccaacaaaaaggattgatggcagcacaaagtaatctgtcgagagagagaaatgtaaagaaaagaaatgttcgtcaagctgaagaccatgtgaagctactttggagagggcatttagtatttcatttaggaattcttatttgcctgtagtaaaaaaagaaaggcctctccttttttttgaaccatttttatttatagctaatacttccattaggcagcccagccctgaaattcttgtttaataatagccgatgttttgtcaatattcttatgttaaccgtaggtagtaggatcctctgaagccaggactatttttttaatgacccaacttattgttaaaatatattttctcaataagttagtgttggctaccgtcggaaacttacatctctttcctgttttcaatgcctttcccttctgccattgtatttggttcagaccccttcagatctgttttgtcctcacgggtcttttttttttttttaatgactttatttaaacttggagcatcagtcacaaatttgcagagacaatgctattttctactgaaggcttttgtctgagcttattacctctcttatgtttgccttatatccatcttcttcccaaatatacattttacttctatttatttcttttctacatgaatttgtatatatgtggcgctgagtgaaattacaagaaaatgcaatggtaacacacagtttataaaaccctggagatagaaacattttctggtgcctgacactgctggactggacccttttctgaagctgcacattctgccattattcatctctgagtgttagatggtatcagttaggacccttcagctgcaactaacagcattcagaactaaaaagcaacttacttttctcacataagaagtctagagtctggaagtcaagtgtcactcatatgacaatgtctaaggcaggtgggaagggggacactcttttaactgggagaaagaagtctccacctctccccagcgggcttcccctcaggtcccactgaccaggggttctgtgtgcgtctgctctgttctaaagagggttgcagaaggaacatctagtggcttccactgctgtcaagggaaaaatgatgttgagaatgtgaccaacaggtgctgttagaggcataattctcacttgcattgagctccaacctccctttggttacttccataggtcagctctagctgtactctaaattagagtcccacaaccattttatttctctttctttttgtaaattcctagaagtgttgaaaacagagggtatgattctgcctgagttttgtctcctgcttgtggaatatcttcagttcctggaacctgaggttgtgtcttgcccccgtagcctccattgaatctggcccagtttggtatgatctcctagccacagcctctttgtctcccagccacagtcactagtttccttttcctgtgagaagtgagaattagtcactcacttccagtgctaagcataatcagagtgaggaatgtaggagcagctctaaaaacctgagagctattggtgtctggaattagttttattgtttttacctggtatttgttcctgggcacttaagtgcttgcctggctgcagcactgttaattgatgagacccaactaggccctctgtcatctgaccctgacccctctgcagcctcatctactgtggaatcctccatttcaaccatacttagtcatttactattccttaacatgcttggtggcttcacacttccatgcctttttgcacataatattttctctttctagaatgttcatgtccctcttcttatctggcagagccctacttttccttcaagatttaacctcagcaggcatcactccactcctttggaaaacttttgtgatttttcccttggacagagttaatcagttacttttcagtcacactctctacaagttcctgttgttaaacattcacaaagtgttgtaattatctgtttatatttttatatccttctatatttagcttctggaagatgggatttatgtttttatttctataacatcagtactcagtatacgtttagcgcataaaaggtgctttgtaaatgttgaaatgaataaatgacaattttacatctaaacctgctgattaataccaacttcatatccttcttgtaagaaatctgtatatattagaagattataaattataaaatacacaagctactatgttatctaaaactgaatctgatagcccatcacatttcttatttggcagactagactgaggcctggagtggataagtgactagcctaggccacataatgatgagaggcagagataagactagacttctatgtctttgtctctcacatagcttgtcttgtagtttctataacaccatcttaccagataggtgagggagatttgggattagcatcatctgtgtgccgtcaaaaaccctgccattgctctcctcgcctgtatgcttttgttcacgtggacctttggctctctgcttgcctgagtcctgccctgttgctccagacctaccctgattcttgccttttctgaccatctcagtcagaatcacttaaaccatcttctgagtttccatagctgtttatagcacacgcagcaataccatgcagtgactgagtacagccctcagtccacacccctgcttcctagctgtgtgactgacaagtagattaacctctctgtttccaaatctataattaggaataataataacagttcctactttatagagttgatgtgtgaggattaagatgttctgtggtacatagtaaacatccaaatgttacatgctgttattggtggtgacggcctgattactattcataaatcgctagaggctgattactggctgcctctagtttcagctcttcctgtgtctgactgcttattgctgaatccagggttgcccagttttgtaaggggtatatcctaacctgcaggttaccctcagacacttgttggaatatttttgcgaataacattcacttaggagttttgttccctggcacacaccagtgctttgtcatgtagaggttcgctcatttgtataggtgatgttactttgaaaaagttgtctctaaggtctgctcagtgaaagaacaggatgttttctctctttacttcacagccatagccagctttgaggttcagtgtttgtatagctctaagtctctgttaattaaggaaatggactagaaaagacagtttaatgaaaactcacagacagtagacaatttgcacacattccattgtttgacaccatagtagaagctcacctctagatgtaaaggagcagtctgtaattctcttgacccttttcctgattaataacctgtagatattgtccatccatggtataagagttggatagttttgtttggattttctctatcttgtaaatgagaaaccagggaaagaaaatacagtgtatttattatactgggaacaaaggtcatggaaacagtaacttttaaaaagaacccttggttacctagtttttaaagacctagacttccttgttctatttctaaaagtctgtggaataaacccctcattttctctgatttacaaggaaactaaaatgtggaaaatttgatctttaaggggcatgacttctggtttatgggattgtttattttaaagtttaaacatttcagtgtcttatgatactcttagttaaaaggaagttctcttgagtatcatataactattaaaattataatttagatctgtattttcaagaaaatactcagttttaagtggaaaaatgcatgggaaaaggtcaatttaaatgcattttaaaaaatcaaagaatatgtgcttatgttaataaggattactttagggtaatgagatttcgggtaatcactttttacttttttcctctgcagcctttctatattgtctggattttggagtgaccatgtgttactccatattcaaaaaaattttttaagccattttgtttatggaggaaaaaagtgcaacttaagatttgaacatggtaaagtcagcctttttctatcttccccagggaagttatccccagcagctaggagagaaagaaacagaaatgaaaactccatctttgaagaaattgggagatatctgaaaccccaaaccagaaaatgagtagaataagttcttcaaagattgaaccagggtatgagaggaagtagactgaaggcacttgggactacagatctcaggaaaagagagagacattttccaacgtaagggacacaccctgggattcaaaaccaaatgcttcatttgaaatagtggaaatgagcacacaagctgatggcaggagcttccctgcagttagtttgattccaggatgcagaagaggctggattgaatgaggacttagacaagtagtacttgtagggagaggtctgaccttgtagcaggaaggagagactacactgtgaacagctccacagctgccttttgcttttggttgatgggggagagaggctcaagaataccttccccaaccctgtgtgcatatatacacacaggcttgcaagtaaaagaaagaagacttctactctcctgaatatggccctggctcctctcccaaatgaatcttcaaatagctggtccaagccaggcgtggtggctcacacttgtaatcccagcactttgggagactgagatgggcagatcacttgaggtcaggagctcgagactagcctggccaatatggtgaaaccccgtctctactaaaaatacaaaaattagctgggcgtggtggcgggcgcctgtaatcccagctgttcgggaggctgaggcaggagaatcgcttgaacctgggaggcagaggttgcagtgagccaagattgtgccgctgcactccagcctgggcgatagagcaagacgtggtctcaaaaaaagaaaaacaaaaacacaaaaattccctaaagaaggaaacaaatagtggagaaaacaaaagttttgtagtacaaatcaagaagtttccagaaataagagaaagcttgaatctacagtttgaaaagacacactgtgttctggaaaaattaacatagagtggccagccttgcaacatctcccagtagggttattagattttaaatgtaaagaatcattcaggcagccaggccaaaagatcaagtcacttagtaaaggagaaattttgactcctccgtattattaacgatcatgggaggacactggagcaacagtgagaaactccgtaaggaaagtcagtgtgactcaaggattttatattcaatgaaattgttttttaaatataaaaacaacaaatgcatttttctatgttagaaatcaagaaagaatattctcgtgaacgcttcttggaatctagtcgaagataaacttcagtccaccaagagataactggaaaaactacagcaaagtagatggcaatgagtgttgaccctctaactgtaggttaaaacaaatgtggagattgatacagtagaacagaatgtaaaggttatatgacctgacggtgtgtggtcatataactaaccacctgtgggaggagaggggaaagaagattgtaggtaaagtaagagtgctgttccctcatcgttaatagctaaggttcaaagggtaccatgtaaagctgacaatgaactaatagaggtatagggtctatttacagctacaaagctaaacagtaagagttaatataactgactaaaataggttagcaaaagaatggtgcaggagaagaaaatattttatttatttagttttactaattttagagacagggtctcactatgttgcctaggctggtcttgaactcctcctgggttcaagtgaacctctcaccttggcttcccaaagtgttgggattacaggcatgagccatgaaacctggcccagaaatattttaatttcatcattttcatgggggttaaatagatactatctaaataaataaaggttgatagatatttataaataagtgaccattagacaaaatatcagttatcttaaatatcaaaatacatgcacaaaggaaagtagcctctacaaggggtaacagaaacaatggacagatacctgacataccaataaatataaatgggagttggggttacaacagtcttggtcatcaagaagtcggaccttatattccactaatatgtttctctgagcaactcaaaacctggtatttcagaagctttggggtcagcaggagcaggacctcacctctgggtatttccttttttttttttttttttttttttttttgagacagtgtttccctcttgtcacccaggctggagtgcaatggcacaatctcagctcactgcaacctccgcctaccaggttcaaccgattctcctgcctcagcctcccaagtagcttggattacaggcgcccgccaccacgcccagctaattttttgtatttttagtagagatggggtttcaacatgttagccaggctggtctcaagctcctgacctcaggtgatccgcccacctcggcctccctaagtgctgggattacaggcgtgagccaccgcgccgggccctgagtattaactttaaagtgattttctttttccactcagccaactatagtgaaggtacttagtgttttgtttaaggtgattagtttcactcctctgaaaaaattaaaaattcaaaactaataaataaatgaatgaaactaaaaaaggaaagaccaaattattatttattttgaatagttatgttggagtttttgatggaagttcttttctcaagagctattctcaaggaccaggaaaatatattttgtttttggaagttcttggaatataaacagaccaactttctgaagtgtcataatatgtggtcccctaatatgtgtatttaatgttctcctttgtttcaccctcagaaccaaagctgccttcattccttggtttcatggaaatagtgtgcatatgtaacagacaataatagcacacatggagattctagtttaaatgacatctagcagttgctaatgccacctttccaaattttcagcagatctgaggttgaaactgacaacaccaaaaaacagtcctagtggggcacatatttagaagttatggaactggattgaaaaacatattttaaaacaggaatatcacccttggcaatttgatagaaaatgggaagacttaactgccttcctcatggtccactcctcattaaccctggcagccatccaaattcctctgtttatgtggatgctacttttaacagcagtcaggtactgcattccctgtcttcttcctgcttcctcttggtactactctattctacatcaattcaaagaccctggctgccagcatatatctgagcagtgaatgtgatgctgtctcagaggctcccatgattaaaatgggggcataaacaggaaacaccccagtagttgaccgtgttagagacattgaaggacagagtacatacgccaggaagcagagccactttattcctaaagcctagtggacttgaacctgtatacatcaacccttccctcccaccaaacaaaacattagtgctcagagagtaaagctatgagcccacatacactttggctatgggcagatgcaggatccaggtagaatgttgacctggggtcattcttaaggagttcctgcccaagatgttagctcatcaggctgagaggactccagcagtaaaggttgtgggatctatactttggtagaaaaggagaaaggaccaagaaaagccagctgaggcactgcctcagctgcccatctaaaggaagttgcagcaggagggacacagtagaagaatctctagagacatcacaaaaatgcttttttagagaaagagctttaaacatccatcaggccccaagaatgagaagtcgtcttctaacagcactggtcagggacttctctgaccctttcctgtcctccctgcctcagaaacagcagctagcagattggggaggaagtgagggagatagaacagtccccacccccagcttcttccccagtggcaggctgcccctgcaactggtcctgctattagagagaggtcttttcttcaaatgaaggttgcagtgctcttaagatactggactaattttttttttttttttggagacggagtttctctcttgtcgcccaggctggagtgcaatggcgcaatcttggctcactgcaacctctccctcccgggttcaagggattcccttgcctcagcctcccaagtagctgggattacaggtgcccacgaccacgcccagctaattttgtatttttagtagagacagggtttctctatgttggtcacactggtctcaaactcccaacctcaggtgatctgcccgcctctgcctcccgaagtgctgggattacaggcgtgagccacagcacccagcctgatcactttctttttgcaaatgtaaccatccagattaaaaaagagcattccaggaccccatgagatgcccttgtattcccttttgattacctctcaccccacaaaatatactatagattagttttgcctgatttgaactttatttaaattgatcatttttaattactgaactgagccttaattataatgtgaaatgagcagaaagatatttcaaaatgtttcatgatggttctttatggccagtatttttgtatatcctgtagaaatatgtcattccctttattttcaaacctcatttgtgagattttagggatacgaatgcctttttgggactggtgtggctgtgttcttcttattaattattactgaagtaaagaggaaatgatatcagcagatgtgcagagcttttatttgcactgaatacactattcatttagacaaaaagatcatttctcaattcaaatcagaatattctaatttaaggctgaaatcagttgtgtcataatctctatggaaacaaagctttctactgtgtagtagttgcataagtaactcatttccccttgtagatatacaaattgtagatgcaaacacttctttttccattttctcccaacaatactcttgaaatagaagatactttagtcatatttgttacgttttacaaaatttaaaatatctgttcaaatttcctgctgacatacattttaataaaattgttaaaacttaaaaattgttgatgagctcactttcttttgctagttgaattcagaaaaagaagattgagttatccttcttagctcttgcgtattagtgtcatctaactctgcaaggctctctccaattggggggtgtgtgtgtgtgtgtgtgtgtgtgtgtgtgtgtgtgttttactaatctgcaggcattcttcgtatattgtgggtatgagctctttgtcagttttacgttttgcagatactttctccaacttcgtggcttactttttcattcctttacatgggtcttttgatgacccaaagttcttaattttgaaatctaacttatcagtcttttcctttatgattagtgcttttcgtatctggttaagaaatctttgcctcaatgaaagcaaaaatagaaaaatgaaattgcatcaaactaaaaagcttctgtactcggcaaaggaaacaattagcagcatggagagacaagctgcagactgggagaaaagatttgcaaatcacacatcagataaggggccaatatccaaaatatataagaaccgcaaactactaataacaagaaaacacgtaacttaaaaaatggccaaaggacctgaatagacatttctcagaagatatacagatggctaacagataaatggaaaaaaatgctcaacacctctaatcatcagagaaatgcaaattaaaccataatgaaatatatcacctcatacctttggattggctgttatcaaaaaggtgaaagataaggctgaggccggtggctcacacctgtaatcccagcactttgggagactgaggcaggcagatcacctgaggttaggagtttgagaccagcctgaccaacatggagaaaccccgtctctactaaagatacaaaattagccaggcgtggtggttcatgcctgtaatcctagctacttgggaggctgaggcaggagaattgcttgaactcgggaggcagaggttgcagtgagccgagattgtgccattgcactccagccttagtaacaagagcgaaactccatctcaagaaaaaaaaaaaaaagaaaagagtgggtacagtggctcatgcctataagcccatcactttgggaggctgagacgggaggatcgcttgagctcaggagttccagaccagcctgagcaacctagtaagacctcatttctatagaacacaaagtaaaaattagctaggaatagtggcacatgcctgtagtcccagctacttgggaatctgaggtgggaggattgcttgagcccgggaggttgagactgcagtgagctgtgatcgcaccactgtctcccagcctgggtgacagagtgagatcttgtctaaaaaaaaaaaaagatggaaaataaacgttggtgaggatgtggaggagagaagggaacttcacacgctgttagtagtattgtaaatatatacagtcactttggaaaacagtatggaggttcctaaaaaaaaaactaaaaatagacttagcatgccatctagcaatcccacttctgagtgtatatccaaaggaattgaagtcagtgtgttgaagagatgtctgtctgtactcctgtgttcgttgcagttttattcacaacagccaagatgtagaaacaatcgatgtgctgatccacagacaaatggattaaaaaatgcaatatatacatgcagtggaatactattcagcctgtcatttgtgacaacatggataaacttagaggactttctgctaagtcaaataagccaggcacagagagacaaataccctatgatttcacttatgtggaatatacaaaagttgaacttagaagtaaagagtagaatgataattaccagaggctggagggtaggggagtggtagatgggaaaagaggatacactggtcagagggcacaaagtttcatttagataggaggaataagttctggtggttcattgtatagcaaggagattgcagttaataataatgtatatttcaaaatagctaagagatagcattttaaatgttctcaccataaagaaatgataaatatttggggtgatggatatgttaaagaaaaaaaagaaaaagaagctgagtgtgatggtgtgcgcctatagtcctagctacttgggaggctgaggcaggaggatcacttgagcccaggagttccaggccagcctgggcaatatagcaagacctcttctcaactcctgacctcaggtgatctgcccaccttggcgcctcccaaagtgctgggattacggcgtgagccaccatgcccagccaagacctcttctctaaaaaaaaaaaaaaaaaaaagaaaagaaaagaaaaaacatttttgccttaagtctcctctttttgttttatttctgattatgtacacccttttcctttctgtcttctctaggcacctgttctagtgtgtttaatgtatgtagttttgtttttctgtgttcatttaaagtatatattgttatgtgcttatgtattttttttttttttttgagacggagtctgggtctgtcgtccaggcaggagtgcagtggtgcaatcttggctcactgcaagctctgcctcccgggttcacgccattctcctgactcagcctcctgagtagttgggactacaggcgcccaccatcatacccggctaatgtttctatttttagtagagacagggtttcaccgtgttagccaggatggtctcgatctcctgaccttgtgatccgcctgccttggcctcccaaaatgctgggattacaggcgtgaaccaccacacccggccttgcttatgtatttttaatttatgtaaatggtattgtattgtagatctcattgtctttatttttttaatttggcatgtttttaagattcatcatattattatcccctagttagatatactgagaatgctcgtaaccccctgccaccacacataaccctagacagacatcttttcatatgtccccttacagatctttgtgaataggcccaggctcatcacttctgggttgtagggtaatgcaagtgcaggcattttaggccaaacctcagtaattggttcctgaacatcagatgctatacatgaaaatgtcaaccagaagcaatttcttgttacttttaatgggaaaaaatacgattcattacaagtcaactcaaccccaaacctatttcctacagcatgactgaaacttagtaaagtagtagtctagtctggtaggatgtaaaatgcttaaaacatcattttctgttatcagacattgcttattagcaagtgtttgctttgaacgcaccaacaagaaccgtttgcctgctctctcgtgacctgccataggaaggccaagagcagccccacagaggatggtgctggatgtcctctgcaccagcagctgtggagatgcacatcctctttgacagtctgtgcttttcaaaatgtttatgcacttatgactactacgatgttctaacaagtgtatttggattataatttgagactttccgcccaccattttgttaaaaatgtattcattttggggcacataaatacacatttttttcttatataaacaccagacaacttctggtcaagattttgcctttaaacccttaggaagatgcacccctaggaagagacggtctcccttacaagaggtttaggtttcctaaaccttcagcctgggctgttgctgctatttgcaatgaaggggcaggcgatgattgtccaaggctggggcctcacctccatccccatcctaatgtcccccatccttgatctgaaggccttcatctgccccaggagttctcacattctttgttgatgttgttagttcctttactatatacttacctctcgttccagtagtttctcctctgaaaccccaagttccgttttcttttgaacgtaagcaaatgacttccttgatttttctgagatgattatttgaaatttagaattagacataattagtagtaaaattccaaaaagaaactttaaagaaaccaattttttttttttaataaaaaatagtataggccagttgctagttgctgagatacttgtatagccctcttaaaagaagactcagaggtttgttttttgtttttttgttttttgttttgaggggacagggtcttgttctgtcacccaggctggagtgcagtggtgcaataatagctcactgcagcctcaaactccttggctcaattgatcctctcacttcagcctctctggtcttagactacaggtatgtaccaccgtgcccagctaattttttgtagagacagcatctcgctatggctggtcttgaactcctgggctcaagtgatgctcctgcctcagcctctcaaagtgttgagattacaagcatgagccaccatgcccagccaagagatggttttaacagtacagcctcaggttgaggacagcattcagaaggtccgatggtttaatacaagaaggaggctggggttaacaatttactctttgttgcagatttttttcagatagctttcagtctcaaaactcactttctacccaaagctatgacagagatagcatgtttagcttccctacctggtcaaggatgccttctttgttctagaaccaaagtaggggctttatgaatggttgtgcatccacttccagtagtaatggctatacattatggagcacttaactgtgtggcgggtactgcacagagtgcttcatatctgttactcatttaatcttcacaatcactattttccaagtgaagcttagcaaagtgaagaaactcacagtttttcagaaagggtcacagttcaaaccccatatctgtctaacctccagaatacgggttatgggaactgtgggtgattctagataattcgattgtgtggattgtcattctcattgtaatctccttaaatctcattaaagctcattagccaacccaataaaacctaggctggcctttgcagtcaggatgctagtagtgatcaggtatgcaggcaaacagctgtagaacctccagacaaggctctctgtctgaatatacagtgtgttacagaaacatgattgacaaatgtaaatattcctgaaatagattcatctgagagagaggcatgctgctaatttgttaatcaattgatttggtatccatatcacccatgcctgctgaattcagtttttctttagaagggagttaaataaatagcactgagttctcaacctttggctccctgctccctggggcagcctgtagaccccccttttcattctgacagatgaataggcaagtgatcagttttgtcttttgggagggtggagggaagaggtagattctagtctggcctccatgattttatacctcagattgccacattggatttgaggatcctcagatctcagtgacatgtttgaagaagatctcggattgggttatctctcctatagttgactattctcatttttctatgggttaattcttactagttttactttcaaaggtaattttaacatttcgggaaaacttacatttgtcccctgtatttaatacgttaatacgatatttaagaactagatcctactttgtacagtatttcaaggtatcatgaaattaatggttttttgtttgtttgtttgtttgtttgtttgtttttttgaggcagggtcttactctgtcgcccaggctggagtgcagtcgtgtgatcttggcacactgcaacctctgcctcccgggttcaggtgattctcctgcctcagcctcctgagtagctgggactacaggtgcccaccaccacgccaagctaatttttggtatttttagtagagacagggtttcaccatattggccaggctggtctcgaactcctgaccttgtgatccacccaccttggcctcccaaagtgctgggattacaggcgtgaggcaccacacccagccagtgtgttctgaaagaaatagtgctttggaaaaatacagtttaaaaaaatgccttgtaatatgtatgtgcattatagaattataatttcatagcaaaagcttcttggaaaatatttgctgtagatatttagaatttattgggcatttactcattgtcaggcattgtggtaactacttgaaatagcttatttaatctggatatcattttttgcccaacactacgggtttgggaaaaaaggatgtgcatgatttcaccccagtatataactagaatttgcaatcagtcagggtaacatacacaaggttcacagtaaatatttactgtttaaatcgactgatgggaaaatcaggaacaggtagggggaggaaagagactatgacagtgggggacagataaagagtctgggagaagaaccagggaaagcagctgagaactttgcctcaagagtagaccttggtgccatcttgtgggtggatctggaaaggaccaagcagatgcacatcagttgctactaagatgccttgcagagccccaaatttccatgccacaatgatagaaaactgcaaatcagataatcagaactctggtctaggaatcagtggatcttagtgatggaatcagtgtcctgtccatcagcaagtcctgatcactctctccaaaacacatcctaaatctgtttatctctgtggccggccccaggccaagccaccatcttctcttgtttggactactgcagaagcttccttattggccttgcctctactctcatcctcccgtagttcattctccattggcagccaaagacatcttttttagaaagaagaatcagattatgtcacttctttgtataaaacctttaagcggcttttcatgaaatttagaataaaattcaaatgtcttgtcctgccttagaaaactctgcatcgtatgacccctgcttagctgtaacttcatctcatgaccttctttgtatggcccctgcttagctgtaacctcatctcttgaccttcttcctctttgtttcctccagtgtcccaccttatttccactgtaggtcctgtgcactagctgttcctctgcctggtactccttcctccacctcttgcatggttggctacttcctgtcattcagatctcacctcctgcattgctgcctcagaggggccttccttgactctgattcagttactctccatcacatctttccctgttgttaatcagagatattgtctgtcttgctgtctattgaatcctcaatgcctaggagaccatttggcacatagtggatgttcagtaaagatctgtcagaaggataaatgctgttttccagtttcttgatctttttccagctagatacagattacggccaggttattttagacttttcctaatagagcatgaaaagatcacaggaattaaattcagacagaactgggtcccattcctgcaactactgcttaccaactatttgaccatacttctctgagtgtcagcttcttcatcaataaaatggagttaatgagcttaccttgctcataaggtaagaactaaattggacttaaatatgattggatccaaagtatttacgtgttagatacttttttctattaaaactgactggaccatgttgttatttgcattttcctctcctgctacccaagggacaggattaggttctttgtactcctagtatctagcactgcacttgtcttacagtaataggtggtccacaagtgtctggatttagactcttccacacctaagaactggtatctcctgactctttccaggctgtgtccctttgatcacattatttctctttgtccagagagagaaacagatggtcactggttgtacatggaaagcctgaagggatagtatggttcagaccaaaattggatttatgtctttactgcagttcctgggttttgtatacaattaatgtaaattgaccccaggataactttctgtttctaataaaaggatgaaggaaaaaaagagatcgatcatatgattgttttgtagttcctaggacttaggctcttcgtaagattcttctttctgtttcttttttttttttttttttttaagacagagtctcgccctgtcacccaggctggagtacagtggctctgtctcagctcagtgcaatctctgcctcccaggttcaatccctcctgagtagctgggattacaggcacccaccacacctggctaatttttgtatttttagtagagacagggttttactatgttggctaggctggtcttgagctcctgacctcaggtgatctgcccgcctcggcctcccaaagtgctgggattacaggcgtgaggcaccacgcccagccattctttctgtttcttaatggaataaagtacctatgaaattactctgaaaactacaagtcctgtattacatacatatatttatgtaataagctggtatgagtataatttctagataaatgattggtttaaaaagattagctgttgactgcacattaattccaaaatattttttgaataccatgtactagacactgttttgggtgttgggaatatagtaatgaataaagcaggtaaatccctgttgttatagaactctgtattccagtgggagaaacagacaaaaaagaagatagataataaaatatgtagtataccaaatggtgattgggagctaagaaataaaaacaaagcaggcaagggatagggagggtagaggggagtagaaattttacagaggttggaattatatatctattttctttctcacccacccctaatcaagatttgtaacataataactttgccttctaataccacatctaaatgatgttagatcagttaggcaaacgaaatcaaaacttctaataatttgtttcatatatctgtaaaccatatttacaaaaagttttacttttcaatattaaaatgcaaatcaacaccatcatattgtctgatatcctaatattataacctttttaaataatcttaatacattcacaaatatttaaaagtataaaagattaagaacgtgtataattactgatatcagctattgaacatacttttgtttctatattgcttaaaaatgtcagttgcttttaaagctgaaagataaaatcaaagctatgctatttaaatttatttgaaatgattattcccttgtaaatattaatgtgaaaaataaattattattaagagggctgtgacctgaaaccttaggtcagtttgattatgatttccatacataaagaaaggatggatacaagaattccagaagttccagtcctcttttctagagcagtcaggaagttgtttactctttgagggcccactgctgacgtctgctcactgagtaatgtcatcagatttcctggtggtggttattttggggggagcagtggcaagtagttgtccggctgttaggagactctgctccatagaggtcctgagagccggatataccccgtagacaggatgtaaggttaaatgcaatctagttaagtaaataaagtaagcgttcagtggtaaaaaggaattgctgaaacatgaatgttttaaaatgatattgctaaaatttttacgtggcaaaattcatagtcttaaatcttttaaaagtgaacccatagctgcctttatttcttaaaataaatccaaaggtgagttacttttataagttcacatcataaatttatgctgtcctttgtctgtacaaatcaagttatttcaccagcttttggtgtagaccacatattcaggattgtttacctaggagggatgagccttttgccctgagctatccagacttttatcttttccctcagcttgtgaccaacactatgtaaatatgtatatacatactttttactcatgctggtcattaatatttaaacaattcattattgtctttatatttattttccttaccggtttccttaagtttgtactgttgattttctcaaacttaatgatttgaaagcttagtgtacttattttgtgacaaaaaggttttagactatagattttgcctctcattataatttagcagtagtatcctgtaagtcttactacataatattcacttttattttccaagttaactgtaggcatagtttgcatatctctctttgattcattacttttgtgagttaatatttttaagttttctaaggaggcaggattttttgttgtcgcttaaacttaagtttttaattcctagtttgcttcgttgaaggataaaaactgtacagtttttactttaggaatatattttaagggtttttttctggtaacctagtatatcatgtttttctaatatttataaatattttctttctttccattcagactttattttttatctatttgatccttcttagtaaatttcatgagtattctgtcagagactgagacaccaattcatataaaggacccaggtggctctctgaccctgctttattgtggcagtagcagcatccctccagtttatgctttttctgctttctcttacgaaactgtgccccatactgtaggacataagcaaaatgattttctttctcttcttcctgtcattttcttcctttcttcttcctgagcagttccactgcattctccaagcaataggtcagtctcattcatttgctcattgctttaaacttgttcattaagtgctggtgccacaaacaaaaaactcatcgttcaaactggtctctcagagcctcttgctttccttcttcctgtaccgtgagagtatgatgattatacagaccatttcaagcacttgaaagttgattttaaaaaataacaaaacaaagccgggcgcggtggctcacgcctataattccagtactttgggaggccaaggcagacagatcacttgaggtcaggagttcgagaccaccctggccaatatggcaaaaccccgtctctactaaaaataacaaaaattagccaggcgtggtggctcatgcctgtagtcctggctactcgggaggctgaggcaggagaattgcttgaatctgggaagtggaggttgcagtgagctgagatcgcgccactgcactctagcctgggcgacagagtgagactccatctcaaaaaataaaaaataaaataaaaaagaaaatgattatacagaccagatgtctccttttttcctgattttaaaaaatatggtaaaatacacataacgtaaaatataccatcttaaccagttttaagtgtacggttgaatggtattaaatacattcataatgttgtgcaactgtgatcaccatctatctccagaactcttttcattttgtaaaactaaaacaatatatcaattaaacaagagcttccccattcttcccttccccttgtccctagcaaacacattctgctttctctctatatattttgactactccaagtacctcatgtaagtggaatcatatagaatttgtctttttgtgactggcttatttcacttagcataatgttcttacagttcatctgttccatagcatatatgtcagaatttcctttttatggctgaataatattccattttatgcatataccacattttaaaatacatttattctttattttttaaaggaagaaataggatctcactgtgttgagctcactcccaggcccgagtgattctcctgccttagcctcccaagtacctgggactgcaggcacacgccaccactcctggctttgtttatttgttcatctgtcattagacacttgggctgttttcatgttttagaaattatgaataatgctgttatgaacatgtgcatacagatatctgtctgaatcactgctttttattcttttgaatatatacccaaaaggggattgttggatcatatgttaattctatttttttaattttttgaggaattgccattctgttttctgcagcagctataccatttaatatttccatcaacagggcacagaggttccagtttttccatgttctcatcagcacttgttattttctggtagtagtgtgaggtggtgtctcattgtggttttgattttcatttccctactggttattgatattgagcatcttttcatgtgcttattggccctttcttttattaatatatcttctttggagaagaatgtgtatgttcaagtcctttgcccatttttgaattgggttgttgttggattataggggttctctatatattgtagatattactctcttatcagatatatgattggcaattactttttccagttctgtggattgcatttttactctgttgatgttgtctttttatgcacaaaattttaaaattttgatgaagtttaatttgtctcttttttcttttgctgcctgtgccattgatatcatacccaaaaaaatcattgccaagtctagtgttgtgaagattttgccctatattctcttttaggaattctgtgtattaggtcttacatttaggtcttcaatccattttgaataaatttttttatatggtgttagataagggtccaacttcattctttggatgtggttatccagttttcccagcaccatttgttgaaaacactctcctttcaccattgaatgttcttggctcccttgttaaaaattatttgaccctatacacaagggtttatttctgggccctttattctagttcgttggtctgtatgtctgtctttatgctagtaccacattattttgatcactgtagctttgtagtaagtcacaaaatcaggaagtgtgagttcttcagttatgttcttttcaggattgttttggctattcgagatcccttgagattccatatgaattttagaatgggtttttctgtttcttcaaaaaacatatttgggattttggtaaggattgcattgaatctatagattgctctgagtagtattgacatcttaacaatattaagtattgtaatttgtgaatgtgggatatgtttccatttattaaatctttttaatttttcagcaatattttgtagtttcacttgtacaaatctttcacctccttggttaaatcaattcttaagtgccttattctttttgatgctattgtaattggaattgttttttgtaatttccttttcagattggtcattgttagtgtatagaaatgcagcttgtttggtgtgttgcctttgtgtcctgatactttgctgactttattagttctaacaggcttttgtgtatgtgtgtgtggaatctttagggttttcttacctataagatcatacaaatgaataaagataattttacttcttattttctatttcgactgtcttttctttttcttacctaattgctccggctaggactttctatgttgaatagaagaagtaggcatccttgctttgttcctgatcttagaggaaaagtcctttaccattcattatgatgtttgctgtgggttttgttcatacatggctttttaaaaaatttgtttaaaaaaattttttttcttcaatttttaagtcccggggtacttagggatgtgcaggtttgttacataggtaaatgtgtgccatggtgttttgctgcacagatcaacccatcacccaggtattaagcccagcacctattagctattcttcctgatgctgtccctccctccgcctgccacaggcctcagtgtgtgttgttccccccacatgtccatgtgttctcatcattcagctcctgcttagagaacacacagtgtttggttttctgtgcctgttagtttgctgaggataatgcttccagctccatccgtgtttgtgcaaaggacgtgatcgttttcctttttatggctgcacatacatggctttttaaaattattattatactttaagttctagggtacatgtgcacaatgtgcaggtttgttacatatgtatacatgtgccgtgctggtgtgctgcacccgttaactcatcatttacattagatatatctcctaatgctatcccctcccccctccccacaccccacagcaggccccggtgtgtgatgttcctcaccctgtgtccaagtgttctcattgttcaattcccacctatgagtgagaacatgcagtgtttggttttctgtccttgcaatagtttgctcagaatgatggtttccagcttcatccatgtccctacaaaggacatgaactcatccttttttatggctgcatggcattccatggtgtatatgtaccacatttgcttaatccagtctatcattgatgggcatttgcgttggttccaagtctttgctattgtgaatagcgccgcaataaacatatgtgtgcatgtgtctttatagcagcatgatttataatcctttgggtatatacccagtaatgggagggctgggtcaaatggtatttctagttctagatccttgaggaattggcacactgtcttccacagtggttgaactagtttacagtcccaccaacagtgtaaaagtgttcctatttctccacatcctctccagcgcctgttgtttcctgactttttaatgatcgccattgtaactggtgtgagatggtatctcattgtggttttgatttgcatttctctgacggccagtgatgatgagcattttttcatgtgtctgttggctgcataaatgtcttcttttgagaagtgtctgttcatatcctttgcccacttgttgatagggttgtttgattttttcttgtaaatttgtttaagttctttgtagattctggatattagccctttgtcagatgggtagattgtaaaaattttctcccattttgtaggttgcctgttcactctgatggtagtttcttttgctgtgcagaagctctttagtttaattagatcccatttgtcaattttggcttttgttgccattgcttttggtattttagtcatgaagtccttgcccatgcctatgtcccgaatgatattgcctaggttttcttcctggggtttttatggttttaggtctaacatttaagtctttaatccatcttgaatttttgcgtaaggtgtaaggaagtgatccagtttcagctttctacatatggctagccagttttcccagcactatttattaaatagggaatcctttccccatttcttgtttttgtcaggtttgtcaaagatcagatggttgtagatgtatggtattatttctgagggctctgttctgttccattggtctatatctctgttttggtaccagtaccatgctgttttggttactgtagccttgcagtatagtttgaagtcaggtagcgtgatgcctccaactttgttcttttggcttaggattgtcttggcaatgcaggctcttttatggttccatatgaactttaaagtagtcttttccaattctgtgaagaaagtcattggtagcttgatggagatggcatttaatctataagttgccttgggcagtgtggccattttcacgatattgattcttcctatctgtgagcatggaatgttcttccatttgtttgtgtcctcttttattttgttgagcagtggtttgtagttctccttgaagaggtccttcacatcccttgtaagttggattcctaggtattctattctcttggaagcaattgtgaatgggagttcactcatgatttggctgtctgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaattgaataccctctatttctttctcttgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagcccttattattttgagatatgtcccatcaatacctagtttatcgagagtttttagcatgaagggctgttgaattttgtcaaaggccttttctgcatctattgagataatcatgtggtttttgtctttggttctgtttatatgctggattacgtttattggtttttgtatgttgaaccagtcttgcatcccagagatgaagccaacttgatcatggtagataagctttttgatgtgctgctggattcagtttgccagtattttattcaggatttttgcatcgatgttcatcagggatattggtctaaaattctcttttttttgttgtgtctctgccaggctttggtatcaggatgatgctggcctcataaaatgagttatggaggattccctctttttctattgatcggaatagtttcagaaggaatggtaccagctcctctttgtacgtctggtagaattcagctgtgaatccatcaggtacgggactttttttggttggtaggctattattgcctcaacttcagagcctgttattggtctattcagggattcagcttcttcctggtttaacctttggagggtgtatgtgtccaggaattcatccatttcttctagattttctagtttatttgtgtagaggtgtttatagtattctctgacggtagtttgtatttctgtgggatcggtggttatattcccttcatcattttctattgtgtctatttgattcttctctcttctttgttagtcttgctagcggtctgtcgattttgttgatcttttcaaacaaccagctcctggattcattgattttttgaagagttttttgtgtcgctatctccttcagttctgctctgatcttagttatttcttgccttctgctagcttttgaatgtgtttgctcttgcttctctaattcttctatttgtgatgttagggtgtcagttttagatcttttcctgctttctcttgtgggcatttactgctataaatttccctctacacactgctttaaatgtgtcccagagattctggtatgttgtgtctttgttctcgttggtttcaaagaacctctttatttctgccttcatttcgttatgtatccagtagtcattcgggagcaggttgtttagtttccatgtagttgggtggttttgagtgagtttcttaatcctgagttctagtttgactgcactgtggtctgagagacagtttgttataatttctgttcttttacatttgctgaggagtgctttacttccaactgtggtcaattttggaataagtgtgatgtggtggtgagaagaatgtatattttgttgatttggggtggagagttctgtagatgtctattaggtctgcttggtgcagagctgagttcaattcctggatatccttgttaactttctgtcttgttgatctgtctaatgttgacagtgggatgttaaagtctcccattattattgtgtgggagtctaagtctctttgtaggtctctaaggacttgccttatgaatctgggtgctcctgtattgggtgcatatatatttaggatagttagctcttcttgttgaattgatccctttaccattatgtaatggctttcttggtctcttttgatctttgttggtttaaagtctgttttatcagagactaggattgcaacccctactattttttgttttccatttgcttggtagatcttcctccatccctttattttgagcctgtgtgtgtctctgcatgtgagttgggtctcctgaatacagcacactgatgggtcttgactctatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtactggttgttcctttccatgtttagtgcttttttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccaccctcttctggcttgtagagtttctgctgagatatcagctgttagtctgatgggcttccctttgtgggtaacccgacctttctctctggctgcccttaacattttttccttcatttcaactttggtgaatctgacaattacgtgtcttggagttgctcttctcgaggagtatctttgtggcgttctctgtatttcctgaatttgaatgttggcctgccttggtaggttggagaagttttcctggataatatcctgcagagtgttttccaacttggttccattctccccatcaatttcaggtacaccaatcagacgtagatttgatctttttacatagtcccacatttcttggaggctttgttcgtttctttttactcatttttctctaaacttctcttctcacttcatttcattcatttgatcttcagtcactgataccccttcttccacttgatcaaattggctactgaagcttgtgcatgtgtcacatagttctcatgtcatggttttcagctccatcaggtcatttaaggtattctctatgctgtttattctagttagccattcgtctaatattttttcaaggtttttagcttctttgcagtgggttcagacatcctcctttagctcggagaagttcgttattaccgattgtctgaagccttcttctctcaactcgtcaaagtcattctccgtccagctttgttccattgctggcgaggagctgcgttcctttggaggagaagaggcactccgatttttagaatgttcagcttttctgctctggtttctccccatctttgtggttttatctacctttggtctttgatgctggtgacctacagatggggttttggtgtggatgtcctttctgtttgttagttttccttctaacagtcaggaccctcaactgcaggcctgttggagtttgctggaggtccactccagaccctgtttgcctgggtatcaccagcggagaaccacaaatactgcagaacggcaaatgttgctgcctgatcatcccctggaagcttcgtctcagaggtgcacccagccgtatgaggtgtcagttggcccctactggaagatgtcttccagttaggctacttgggggtcagggatccgcttgaggaggcagactgtctgttctcagatctcgaactccgtgctgggaggaccactactctcttcaaagctgtcagacagggacgtttaagtctgcagaagtttctgctgccttttgttcagctatgccctgcccccagaggtggagtctatagaggcaggcaggcctccttgagctgtggtgggctccacccaggaattccctgaccccttgtgcttcccgggtgaggcgatgcccctccctgctctggctcatgctccatgggctgcacttactgtccgacaagccccagtgagatgaagccggtacctcagttggaaatgcagaaatcacccgtcttccatgtcgcgcacgctgggagctgtagactggagctgttcctattcggccatcttggaacctcctgtgctcgtacatggctttttaaatgttgaggtagttcccttctatttctattttgttgagtgtttttatcatgaaaggatattgaattttgttaaatgccttttctgcattatttgaggtataatgaatgaggcttttgtcctttattctgtacaataatgtattacactgatcaattttcatatgtcaatacatccttgcatttcaggaatacatcccacttagtcatggtgtataatccttttattatgctgctgaattcagttttctagtattttgttgaggatttttgcatcagtgtttataagggatattggcctgtaattttcttttagtgtcttttgttgttgtcgttgttttgtttttgagatagagtctcactttgttacctaggctggaatgcagtggcatgattgttttgttttaagggatagggtcttgctctgttgcccaagttggaatgtagtggcacagtcttgtctcactgcagcctcgacttcctgggctcaaatgatcctcttcccttagcctcctgagtagctacgattataggtgcataccaccatgaccagctttttcttcttcttctcttttttatagagttagggtctcgttattttgcctaggcttgtcttgactcctggcctcaaacagtcctcccaccttagcctctcaaaagcgctgggattacaggtgtgagctaccacatctggccctaactttggtatcaaggtaatactggcgtcatagaatgagttaggaagtgtttctttctcttcaattttttgtaaaagtttgagaaggattgtattagttctttaaatgcttggtagaattcacctgtgaagctattgggtccaggggttttctttgttgggggatttttgattactgattcagtctccttactagtaatagatctattcaggttttctgtttctttatgatttggtcttcgtactttttgcgcttctaggaatttgtccattttatccagattatccaatttgttggtgtataagtgttaatagtactctcttagaatcctttttattgctgtagaattggtagcaatgtccctactttcatttctaattttggtaatttgagtcatttttatttttttctccatcttgctaaaggtttgtcaattttgttgatcatttcaaagaaccagcttttggtttccttgatttttctgtattatctattctctattgtattaatctttgctctaatcgttatttccatctgctagctttgggtttagttttctctttttctagttccctaaattataaagttatgttgttgatttgagatcttattttctagtgtatttatagctattaatgttccccttagcctgtttttgctgctacatcccataagttttagtatgttgcgtttttgttttcattcatctccaagtattttctaatttatcttgtgtattcttctttgatctgttagttaagattgtgttgtttaatttccacaattttgtgaattttccagttttacttttgttattgatttctcactttatccttaagatactttgtgttacatctatcttttaaaatctattgagttttgatttgtggcctaatatgtagtctgtccttgagaatgtcccatgtgcacttgaggaaaatatatatgttgttattgggtagcacattctgtatatgtctattagatcttgttggtttattgtgttgcttaagtctagccattattgagaggggggtgttgaagtcttcaactataattttagaactgtctcttccttcaattctgtcagtttttactttatatattttaatggtctgtcattgggtagataattgcttataattgttacatcttgttactctgttgaatgtttaacatatagtgtcctcctttgtctcttatagccttttttggtttaaagtctattttgtctgctgttagtataacttcccctgctcttttttgattactattagagtatctttttccatcctttcactttctatttttgtctttggatctaaagtgaatgtcttatagaccacatatagatgggttcattctgccaatctctgtcttttgattggagagtttaatccatttatatttaaagtaattactgagcttgcacaacaaagcaaggctgtgtctctacaaaacatttaaaaattaaccagatgaggtggcatatacctgtagtctcagctactcgggagactgaagtgggacgatctcttgagcccaggagttcaaggctacagtgagctatgatcatgccattgcactccagcctgggtgatagagcaggaccctgtccctaaaaataaataaataattactgataaaggtggacttaacttctgtcattttgctatttgtttttctgtatgtcacatagcttttctgtcttccatttctttaattactgtcttcttttgtgttcagttgattttttgtaatgcaatatttaaattcctttctcatttccctttgtgtatattctgtagctactttctttatggttagcatggggattatagttaacatcctaatgttatataaatatttaatttgaattatgccagcttaacttcaataacatacaaaaattctactcctatactgctttattcccacccttttcagttattgatgtcacaaaattaaagctttatgtagttggtcctccatattggtgggttccacgtccatggattcagccaactgaagattgaaaatatttaggaaaataaaaataaaacatgtaaaataatacagcattaagaactgtttacatagcattacattgtattaggtattataagtaagtagagacaatttaaagcgtagaggagaatgggaatatgttatataaggtacttgagcatccatagattttcatatatatgggtgttcctggaaccaattccctgcagataacaagggacaactgtacattgtgtgcccaaaagcgtacactaatactttcaaatgtctcttatttaggaaataaaatgcaaaatgtagttacccacaaaagttacaataatacttccttttagaccaatgattttttttttccaccaaactgtattcatctcttaaatcatgtaggaaacaaacaaaaggagttataagccatttatacaatagcaatagcttttataattatccatggtttcacttttattgagatctttatttcttcagacagctttgagttactgtctagtgtccttttattttaccctgcaggactcccttgaacatttcttgcagggcatatctagtggtaatgaactcccttagtttttttggtttgttttattttgtttttgtttttgtttttgtttttcattctggagatgtcttaattcctccctcacttttgaatgaagttttgccaaatataggatctttgattgacgattagctgacctccaaagtttctgatgagagatctattgataatcttattgaggatttcttgtgtgtgaccagttgcttctttcttgctgctttcttttttatttttcttcttttttatttatttattttttttgagatggcatcttgctctgttgtccaggctggagtgcaatggtgcagtctcggctcactgcaacttctgcctcccaggttcaagcaattctcctgcctcagcctcctgagtagctgggattacaggcacccgccaccacacccagctaatttttttttttgtatttttagtagagacggggtttcaccatgttggccaggctggtttcgaattcctggcctcaggtgatctgtctgtctcagcctcccaaagtgctgggattacaggcgtgagccaccacgcccagttcttgctgctttcaagattctctttttgtctttgagcagtttcattataatgtgtcttgatatgggtctctttgagttcatcttacttattgtttgttgagcttctttatgtcctacatcaagtttgggatattttcttcatacattttttctttccctttctcttcagcatctgggactcccgtgatgcatatattagcttgtttcatggtgtccttcaggcactgtaagctctgttcactatttttttaaaggttttttctctttcccagactcgataatttcaattgtcccctctctaagtgtgctcattctttcttttgcctgcccaaatttgcctttgaatctctttagtgaatttttcattccagttattgtacttttcagctccagaaattatttttggtttctttttagtttttttcatctctttacttagattttcatgttgttcgtacatcattttcttgactttctccacatctttctttagttcttttagcatcttgaagttgttgtaaagtctttgtctagtagatctgccattaggtatctttcagggatggttgctgttgatttagtttttttcatttgaattggctgtactttcctgtttgtgtgctttgtgaatttgtgttgaaaactggacatttgaatgtaataatgtggtaactctggaaatcattctccgtcttccccaggatttgctgttattgttttgttttgttttgtttttaattgtggtaggccatctctgtgccaaggatcagtctaatgtgtaaactcaaggtcttctcaggcattttctaagcctttccctaggcttgcataatcactttctagttttccctgtatatgccattgcttttcaatgccttagtccctaatgtctgactctcaaaggggataaaagagaaaaatgaaaggagaggaagggcactagccctttaaatctcctagaagtctcttcaactggagggggaatggcttgcaacaatgggagaaagtgcaacaatgcaccccttctttgtctgcacctctgtatcagtgatcagagcacagatccctgatatttggaggacatggttgtttttgccttccctgggtcctgcaagttgtgttcaggttgctttaggaacacatgcacagctgcccaccatgggcctgggtacctgctatgtgctaagagctaaaattaactgcggtttaccatccaagccttcccctggaagttgcacgtcttcaattgttcctaaaatagttgcatcagacatattctgccagtgcaatattgtctaggtggggaaacagattcctggtgcttcttactctactgtcttctctaaatccatcttttaagactctcctgtggacctcttggaccatcttccctcataaaaattctggctttggcatccagttacaccagtatgagactggcccatagttacacaactcaagagaataggtaataaccatgcactgtctgttctgactctttcaccctactgaagaatcttcctcctcagtctttggtctagaatattagggaccctcattctttttatgccttctgagagataaaattattgcagagcaatgcagaaactgagccagtggcccataattactagacatcagcttctcatggttaaaaatatatgtggatttttctcccatcactaagcaaacttcgtaatgtgtttactagaataggtcactgtttgaggggagagattggaggagggcagtcagttgggaaacattttgtaggaagtcttatggatctagttcttctgttgctgtgacgaatcataccatcacacagaggcccagattgggatctcatcaacacctacagagtcactgggcaaattacaaaatgtgtctcttcccctgggtagcagcccagtgccagaattcatcacctggagctggttttcagtcccaccttctcccttccttgggcccctttgtgttgtatacaggctattcaaatcttctggtggtcctgagtttacagcacagtgtatggagctaaacaaacctgggtggaatcccagcactaccacttgctgtgtggtcttaatgcagggtacttagaacttcagttttctagctataaactctcaccacattactatcagattcagtgaaataacatgtgcagcccttagcacagtaaccagaacacactaagtcttccattggtgctgtgattgttattactcactggggtttggttatgatattacatttatctttgatttagcattacattctcaaatggataagtacttacagtaagtgctattatgctcctctgtaaaatagaaagtgtcaaccatttttcaatgacattccatggttctgactgctggattgcattattcatgtgccatttgggtgtaagatttcattgtccatcaggaaaaaaatggaaataggcacagagggaatcagcgtttatttagtatctattattggggggctctctatattgtcatctcatttggcctttaacaaatgagaagttgaggctgaggaagattaattcacttaaagtcacatgtagctagtaaaaggcaaagccagaatcacattcattttatttgttcattttatttctcctttcctgctccccacttttcctgggggctataaggagatccttaggattcctcataatcatttcatttatctactatttactttatttgcctctagaatagaaattttgctttcatttttggcactgtttagagagagaaaaagttaagcttctctttctccgttgtcttttcatttttaagccaatctctttcttacaggtagcagtagctgatgtgcagtttggccccatgagatttcatcaagatcaacttcaggtaataatgaacgatgctgtatttttcacatgctgattttctttaaaaagggtggaggtggagctaaatttacacatttaaaatagtctttcatttagataatagtgtttggaccaatgttaaattccctgaactctgtaacagtattatagttatataagagaatatcctgttcttagaaatacacattgtggtgtttagagatgaagaagtgtttgtagcctactttcattggttcagcaataggtcaggcacggtggctcatgcctataatcccagcactttgggaggctgaggcagtaggatctcttgagcttgaggagtccttgaggagtttgaaaccagcctgggcaacatagggagacccagtttctgcaacaacagcaacaataaattagatggacatgggggtgtgtgtgcctgtggtcccagctacttggaaggctgagatgggagaatcacctgagcccgggaggtcaaggctgcagtgagtcatgatcacaccattgcactgcagcctgggcaacagagtgagaccctgtctcaaacaaacaaaagaaaaaaaattggttcagcaataaataaaaaatgtgtataattgtatgtatgtacatgtatgtgtttagagagagagagaaagcaaagcaaaggtggcaaaatgttaattgatgaatgtagagaaagggcatgtttagtgttcattttcattcacgtttctgtagatttgaaattttccaatataaaaagtaaaaagattgtcttttcaatgttgctgaatcagctctgtcagagagaagatatctgtaatttatctaattcaaaatatgagacagaaaacaaccaattgatgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaaagaaaacaaccaattgaaattcagcgaagttatccatgctccccgcacatgaacatgtttcattcactattacatttaaaaatatatgagaagtgctgacagaaatgtgtgctcttagttctttgcatgtatggtctttgtgtagttgagtaaactcggaagaaataagccttaggagggtttctgatagctttgcagtctgtttcacaggctgcccatctcctccttaccactgttgccccattttcagtctgcttctgaagggatggagcacgggtgctcctgaaccagattgggagtgggaatagcagggagagagagggaaggaggctggctggataaggaagacgctatggatacaggcctcgcttgctccaggccaggactgacgtgattggggcagccagccactgtcctgggcagaggcacagatgctacctcttgcacctggtgactgtgtcacttaactgataggctttgaagtgtcacattttggtctactttaaatctttcttcttttaatcaaagcaattttttttttaacttggaggaattacataaaatcttgagtcaaacatttcaatacattatttataggattaagtattctaataatttcaccaagatattagcattcaccatctgagaacttacccagttaactttctttcagctaaaataaatattaatgtgttttaattcttttagtttcaagataaaatgcttaactaaatctttgttgagttctgccagtgggtttcttagcaaaaaagtaggcatatggccaggtgcagtggctcacacctgcaatcccagcactttgggaggccacagcaggtggatcacttgagtccaggagttctagactagcctgggcaacatggagggaccccatctctactgaaaatacaaaaattagccgggcatgtggtggcgcacacctgtaatctcccagccactgggggctctgaggtacaagaacactggaaccctggaggtggaggttgcagtgagctgacatcacaccactgtacaccagcccatgcaacagaggaagaccctgttgcccacccaccatccccccaaaacacacacacacacacacacacacacacacacacacacacacacacacacacacacacagaaatgacgattctgaccaggcgcggtggctcacgcctgtaatcccaacactttgggaggctgaggtgggaggattacttgaagccaggagttcgaaatcagcctggccaacatggcaaaaccccgtctctactaaaaatacaaaaattagctgggcatggtggcatgtgcctgtggcccaactactcggcagggctgaggtgggagaatcacttgaacctgggaggcagaggttgcagtgagccaagatcatgccattacactccagcctgagcaacagagcaagactctgtctcaagaaaaaaaaagtgtaagaaatgacaattctaacatctttttttaaaaaaagtgtttgtgctcttttgattcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtaagcccaagactcgggcctaaatagtcccattggcctttctgacaatacatgcagcctagaaatagattaaattagactcactctcttttaagttgctttccatgcatgtgaaataaacaaaatattagaacctcactatttataggactgatgcatatctcttttgttttgtcttgcttcactttacttgaaacagtaagaaaatgtgaataataagaattattaagggtcaaagtgaaacccaaaatgtaattaaccacaagtatcacttgtatattagtgcagtaagaattataatttttcagattgttttcaaagttttaaaaattttgaaaattgtcttttaatgttcgatgaatgggctttatttattatacttgcaccttgtcaatattatgagagaattctctgtagtgacctaaacctaaaaaatgccttttaaagaaagttatttgttgctgatggaagcaaggcaaatataaaattttatgacatattaattttaaggacatttaaaatcttgacttttaagagagagaaaagatataagctaagtagattaaaaacccatgggttaaaaaccgaggtgacaagcaaatgacaacatattaaaagattatttatggggtatgtggtgacgtcaacatgggtttgtttccttggtgttgagaactctacactcctggtagtcagactaggtagcgtttacccttccatgacttgcctccagtagtttctcctgtggccttgatctagtgcctgaaatgtgcctgtgttcctcatctgtttcaatctgcatgacttcacaataagccatcatcattgtagcccagatttctttttttttttcttgtgacggagtctcactctgtaacccagtctggagtgcaaggctcgatctcagctcactgcaacctccacctccagggttcaagggattctcctgcctcagcctcccaagtagctgggattacaggcgcacaccaccatgcctggctaattttgtatttttaatagagacggtgtttgaccatattggccaggctggtcttgaactcctgaccccaagtgatccatctgcctcagcctcccaaagtgctgggattacaggtgtgagccaccgcactgtgcccgccctaccccagatttcttgacatgtcatttggccagtcacccagcacattcatgggggattgcagcccaaaagaaatggagagagctccggccaggaaaaagggaggtccaggtccttgtttggctcttcctggatagctgcttgtctctgggtaactctgccttctctggggatgttttagctcagctgtaaatttggaacacttggtttccagtatcccttttatccctaacattgaatagataccactcagaggaagggaagatgatatctaaattacatggtgcttggtagtcatggtggaatgttgcaaggcagtagaggtgtctaaggtgggccaaatggctgccgagatagaagagggaggacagggtgaggggctggagaaaatttggcctctttcctagtcttgtccaggcccaagcctagccacaggtatgtgctaggcaatgaaagttcatacttttaaaggtgactactagagcatcttgtattgtaaaagaaaatttaaattgtgttggttacgctccactgttaaaaattgtggtaaaagaaacataacattaactttatgttccactttttaagggaagaaaatgtactattgctgtacattttaggaatattctaaacaaatagggttaattcattcagcagatttttattgagctatgtacaagagaatgttttagactgaaagttataaaatgaagttcttgtcttctatgagcttatagactagaggagctgaaatatttcaatgaaaaaaagtaatgttacgtgctcagttaaaaactcacacaaataccaaattccataagcactatagttaatcagagttctttcgtcatgtaaataacaattttatatagttttaaagtaaagaatgggaactggattgctttaatatatggttttagagaagcagagaatgtcagatgtgcctctcctctatgaagtgcctagcactctccatccagcctctcctcaggacctggggctcactaagtgaaaccctgagatttagaagctttgctttatattgaacccaactttgtccacagttggcgcacaggattgctagaacagagctattattcctcttccccagaatggacttccaacactggaggacaggaattgtgtccccccaccccagacatctttccttttctgaactgagcacacccttactgctatgagtggctcctaacagatcctggtttcatattcccaccacatcaagggtgcttcccctgagtacccttttctgattgatagaccttgtaagcatggctccagaaccgaaaagctcacactaggtttaggggaaccagtgacaagtaagcagaacagtcccctccactgtgctagccagagagagcaggcctttacaaatgtaatccccgatcacatttatttcctgatggccacatcacagccttggtcaagaatctcaagtgtttctcacaagctgttttctaccacgtcatctccatcttgttgggtgaggatttggggtagggatgggtccttgtgctaatcgtagtgagttttctagaggcaagagcagaccctgatttattttcctaatcagttttgtcttcattctggcccttacctggcttatctcccttaagatcatccctttaaggatgcccgcccactttggactgttcaagaaatctttccaggctccccacccccgaaccagcttgccctgtctctgagctgacttacatggctcttgagaccttagccctgcagaattctgtccttcccttcatcttcccttttgggatacctaatcaacactgcctatggagagcttttcatcggttgttgacctgtctaaatgactagcattcacctgtatctctctgttgggggcatttggaactccttacactccttatgagatgccttgctaacagcaaatattctatgtctattatatttccaaatctaccagtttaggaaccctacgttgtaagtctcctcaggtctgggcactgcatttggtactagagctacatagatgagtaagatgtgcttcttgtctctgaggagctaatactttagttagcagggaaagtgagtgatttcggtataggcttgtaagtgcccgcagaagaggtttacgcagagtgttgtgggtgcctgtgtcaaagagggcttcgcaagaggatacttgagttgcatcttaaaggatgagcaggagttttgaaaggaaaaaaggtggagaaaatgttccaggtagagggagcggcatgtgtagaaacaggcaggacatccgggcacctctgctcagtgctagatggctgctggtcaggcagatgtggagtaggtgtcaggggaggttggaacagcagacgtgaaccaaatgatgaaggccttgtgtgctaagccaaaggctgtggactctaccccgtaggtagttgaaacactgatagattctgcgcaggaaagtgttgagcaggatagaaaaataacttggctgccaagtggagaatggagtagaaaactggaggagatgaggcaaatcaatcagttgtgaggctgctagaggccatccagtagttcctaacagagtatagcttcatattcccactgtagcacttgatatcaatgtctcctcccaacttcctatcaaaaaacccatgaagagggaaaaagagacaaaaattgaccatagcaataataaataaaaacccacaaagataagatgataggtcagaagctgagagaacagaaaaggataggaatctctactgtatctgtcgtaccgtggagactaataaagaagcctgtttctgaactgtgcctcaagcacttcagtctttgaagctgaaataccagtggccataaaggaaggcagtggaaacaggctttgctttactcccactgtgttctgccaagcctgggatgctggagttgctctaaccagagaaacagatgactgagccccagcagagcagcaaggctttatgagctgggcagaggcctgcactcttgcccctgccatccctgctgcccctgattctttactttctgcatctactcagaaacccaaggtaaggaagagagggatatggacagagacatggtttttcctactatgttttaagaagggacagaggtataaggaacctgaagacagttctccacatactgcagtttcaaaacaacaaattgcatcagttctcaggttcagtttgagaatcagagagaacaggccaggagccccgctctgcagcagacctgtgcatgcctgctggcagtgttctccaagcccgaactgtgcttgttgatgtgatctaccgcccagacctaagaggaggacagctgctgacaccaagggttcagtgaagaggtgctaaggaaactcttgtgaccctctttgttggcaaactcttagcctgcatagatgcgaattgcattcaggggtgtgtaaacaggatgagaaggggggcctgtgaaaagtgccaccacataatgaggggggaaagaacagccctgaagactaagaaaattattttttataagacactgtagaaccttttgaagacatatgcttagtggactcagaagaggtgcagcagtatttcttggtgcaacaggagtaggtctctgtaataaaagggaagatctcataaagggatatagaggaaataaaaaaagtactacttgaaaacccaaaacgcattaacagaattaaaatctatgttgaatgcagaagcaagattgaactcagagcaccagatgcttttatacaatttcttgattcaccttggtgtgcagatcctttataccattataaatcccattctttttcatctgaaactcattccacatggcagagaaaaatagcaaagcacaagtaatggagttgtgcttttgtgaaacttaactcattaaagggctgggctatgttcttatagtgagcctccattatgtggccttttttccagtgttgtgttgagaccattatcagaattatttgtagttgcctagagtagcttgagtctggtagttgcccccagtatccatttctattcttttcctaataacagaatctctgatgtgtagctgggcatatggctacctagaaaatagattgcattccctagtttttcttacagctggccaatggacctatcatgtgtatcttctggaaagtatacttagggaaggagcattccctttttcctgctatctggaatgtggacattatggctagtgttcagtatctgtcttggaccatgaggaagaaacctcatgtacagacaatagtagagaaacactggtaggagctaggttcctgatcctgcagagtccatggcagccctggactgtctcctctgcacatttttgatgtgtgagacagatactgtttaaaccactcttctctggtgttttctatcttgtgtggccaaaaggattcctaatggtaaaccaagtagcatgcttttaagactttcccagtgaggccgggcttggtggctcacacctctaatcccagcactttgggaggccaaggcaggcagattgcttgagcccaggagttcgagaccagcttgagccacatggtgaaaccctatctttacaaaacatcaaaaaataaaccaagcatggttggcacttgcctgtagtcccagctacttgagaggccgatgtgagaggatcacttgagcccaggaggtcaaagctgcagtgtgccatgatcacaccactacacttgagcctggccgacagagcaagaccttgtctcaaaaaaaaagtggggtgggtggggacttccctgagtacttaacactgctttcagaatctcattctacaggatcgcactccatctttttcgtgaccttcttgaattctgacttcctgaacattcaggtatacatttcaataatgccaagtaatttctttcctagttttcatgaattccaatgcaaggatgttatttttcaactcagtttcctgacatttctgttttctagcccgttcttccttcatatgcaccagaaaaggtcccagtatgtctctacctttttatacagttttagagctgtttttaagggcttatctccaggtaaacaaggtcctcccttccactttatccttaatccagtgcttctcattcttgtgtctccagataggagtagttcattcaaagctccttagtgagatcacctacctacttgcctacttgccattacatcactcccatcttgatttttcttctaaaaagctgaaagctggtttgaaatggctacatacttaaatttgccctttctccttccaaatctctgtgatatgatggaaatgtaaacacaggacagatacagtgtcactagaagtgatgaaaataccatttgtgagtcacgccttattccctgtttgagatcagtgttaggatgagtattagtcagcaggtgtgatgagtgcactagctgtgtctgtgagtgtctgttgtgccagtgacccctccaggcctaagcagcctttcccatagctcttccccaggaagctgagcctgcctgctctccccagtcagggggaccagggttgaactggggattgacacctggccagtaagccctgaggtggcgtgtctgcaaggggtcttccagcagagccatgcagcacccttaggttggctccctctggagaggataggcaggtggatgctagaggagtacagagtgaacacagaaaagcagggatgttgagggggtggggaagaagtgaacatgagagagactggctggtcgctagagctgcttttccattcctgagcaacttccctacccctggcctattctgcatgtgttgttagattcagcctttctcaacctggattccataagaaaatgaagcccgaatccctacaggcaagaatgggcaaaggagaacacagtcttgcccattcatttgtgtattatgtgtgactgcctttgtgctacagtggtagagttgagtagttgtgacaagagtccatatggcctgcaaagcctaaaatatttattccctgaccctttacagaaaagtttgctaagactggggcgggggcatttggctgagtgtgctggctcacgcctgtaatcccagcactttgggaggccaaggcaggagactgcttgaatgcaggagtttgagaccagcctgggcaatgtagtgagacctcgtctctacaaaaaataaaaaaattagccagtggcatgtgccagctggtcgcagctactcatagctggagcccaggaggtcaagactgcagtgagctgtgattgcaccactgtactccagcctggtgacaaataggaacctgtctcaaaaagatgggggcatccatcgtgcatgatgaatctcttacgcatctggaatggttatgttgtataccatctttgagagacttgagaactagtcactcaaattattttctggattttgtgattcagaagtggctctataccttgaactaacagctgaagcaaatgcagtcagtcttgactggtttctgtgccatcctagacacattctccaggaggccagctcacctttgacttgactagggcagtctggttatgttcctctacattctcctccttttagagtccctctccaacataagtcgtcttcctctgggtctggggtgagttcctttcttctccagtggagttgttcttctctagagtctgctcgcttctcccagtgtaggatgagttcaaagctgttgcatatctccagtggagcacttcttttctttcttttactctatgtcacatttatttctgctctgatattttggctgtattttcattccccatggcctctaaagctgcttctgcaaaagggttgaatttactctgtatgggaagtcttgtactctttgggtaactttagtcgaacagtctcttgtacttttctagaccagtcctctgttcttaaccttttcatgaggtgttgatgctcttctttctgaccgattacaatatcttgcatttcctagttttggattatttttggttatttagcctccattttacctagtaactcttcatcctttgtgctccttagaatgcagtggagccagcccttgggctcctttatccccgttgtaagcatagccatcatcttgtggtaatagacataaacttgcattttcctttggaagaagagaccaacggcttctttcatgtaagcacaaagcagggaaaatactccgcctgaaacaatgcaggttaacaaagatcagaacaagtagaatacatgtcatcttagttagctgttaattcatactccataatcattacagttaacacagtccactgagtgggagtttgcccccaaaagagagaaagatcaagtagtcaagaaggtgagtgaattcagagagtgaggggatcatttactctcccttctacccctcttccaactttaattgttgtaattgtttaagtatatttggtttttaaggattatttttatatttattttaaagttttgtgttttttttaaggtctatcagatcatcaaaactctcagaaaacacagttattgttggtgtagtacgcaggtaaactttcatttttttaatgttgaaattgaggtaccagtgtaatacttgctcttaacagatggccaaataacagcttgcatgctgtgtcaggcatgcccctttgtagtgtggccttctcttctttattctttattttattttgctgcttcagttaacttcctggaaggactttgtgctctcatgctagatttttgtgatttttaaactgcctttcactttagaaacaggcgaactatgagagaattccattcctaaaagtatgaatgttttccaggggtatcttcctagggccttctaactccaaatatctctgaggggggaatcttaggttttgtctttaaattggaggtaaggaaagaagagaaatatattaggagaagggcaagtattcaaattaatgttatttagcttatatgtttttatacatagaagaaatgtttctatgtactttaaagttttttcctgagctgtaggggagaaaggaattaaaaaaaaaacctggaagtagaagaaaataggagtagtttaaattaaaaattttatatattaaaaagatatatgaacactcctgtattcctgctattaatgtagtttgtgtatttcaagtattataatatataattccaaaaagctaaatgtgaaattgaaacagaaaacagttttcaactttatcctttaaatttgtatattaatctgattcatctaaaagtactcattacataacgaagtattatttaaattagtagagtaaaagaggtgagatgtaattgataaaaactatgtctatgttctttactgtgttattttgaagggtggatagagaagagttgtccgtaatgcctttcatttctgctggatttacaagggtatgtactcacttatttgttatacaagtataattcaatttgagaaattattttatctcagttcagtacccagcaaaagctttgtattaatttgaagaaaaaaaattgtctggccaggcgtggtggctcatacctgtaatcccagcactttgggaggtcgaggtaggaggaccccttgggcccaggagttcaagaccagcctgggcaacataaggagaacctgcctcaatcgtacttaaaaaaaaaattactgtccttgttttacagtttggtttaactttataatctgctaatctaatctataatagttcatagtctctcaaaactatgcctgctaaggtcatctaaacataataaaatctcctttaatggcattttcactaaaaattataccacaggatgtattgttatgatgctgacatgtatacatgcaactttttaagctagttcaaggattctggaaataaggcagcccaaacacagctctctttctctccactcccagcttcaatctcttggtttccctaagccaaaaggttgcttggggctttggtcagctggctgcaaatgaggccttaggaatcatacagagagaacttaaataaggctgacccttgggcagatttgtagcccaggttagtataagaaaggtagtcaagaaatctcaagccatgaatttagtttcaagttttctggatgagtaggactcctaagtgcctggcagaagcaaatataaatcctccccagaggaagacagcttcatctttgcccgcagaggatctccataaataattgctcaagggcagccggcagcagtcagtcaaagctggagtcaatccaccaggtgacagggcatcccaaggaaaaactaggagggaaaaaagcctagtaacagaccctcacacccctcagagattagttatgagatatgaattataaagcaagtatgcttactataggtaaagaaataaaagataaaccaggaaatatctgcaaggaataggaaactattaaaagtggcatagcaaattttatgaggaacaaaactgaattgtaagaaatgaaaacacagtaattgaacaatttaaaacttagtaagtcacatgtagcacagaaatacaatgacaggaaataagttagacaggtgaagaaatgtggaggatagtgtgtgaagttttagttgtgtatatgtaactggagttccaggagaagaggaaggatagaacagaggaaatatttgaagagttactagctgaaaattttccagaactgatgaaaaactaattcatagattcatgaattctgacatatccaaagtagagtaaattttaaaagaggacacatcctagtgaaactgcaaaaaaaaaaaaaaagaaaaggacttaaaatcagccacaggtaaaagattaccttcaaaagactgacacacacactaacagctagcttctcagcagcaacaagtggaaaacaagacagtggaataacattttcaatgcaataaaagaaaataacttccttgggaggccgaggtgggcagatcacgaggtcaggagattgagaccatcctggccaacatggtgaaaccctgtcttgactaaaaatacaaaaattagctgggcatggtggtgcacacctgtaatcccagctacttgggaggctgaggcaggagaatcgcctgaaccagggatttggaggtaggttgcagtgagccgagattgtgccactgcactccagcctggcaacagagcgatactccatctcaaaaaaaaaaaaaaaaaaaaaagaaagaaaagaaaagaacttcctagaattttatacctagcatacatatctttcaacaatgaaggtgaaataaagactttcagaaatgtggacattgagagaatttgtaactagcagatcctcacaaggaaatgctaaaggatatacttcaaccagaaggaatgtgaattccaggtggaaggtctgaaatgcaagagatgagtaaagaaaatggtctgtatagggtaaatataaatacatatttactgtatgaaacaataataatgtctagtttgatgagaggatacagggagaaagagactacaaactaatcatatatctagccaagttattgtttaacctttcttttggggatatacataaaattcagagatatagttccccaaggaaaataattcagaaaaggactctaaccatataagaaatgaactacaacagaaatttgaagaggagaggagggaaaagtagtgagctataaaccctgccatgtgcatactccttcatggtgcctcctgctttctctggctctctgtctttctttatagatgtacccacacttatgcatatatgtataagattagtcccaaacagataaacatagactagaatatataatattcttttaaaagaagggacatactcaaagaggaattttaataatagctcacttttaaattctagactatcttagtcaacgctaggtgtttgtaaggtttgtggggaggatgcaggcattcttacagacttatctaagaggtagagtgagaatgagcccaagaagtattcatctttgtgggaaatgttctatgtgggaaatactttattctgggggtaattggtatcttgttttcaaataatagtaaagaaatctatgtctgcttttgagatgatgaaaaggagggtaaccgctgatagaacaggaaacttaagtaaaacttccaaaataacaagaggaaatagggagtttacagcaacttgatcaaattgagaagctgaagaaagatgaaacaacagtgtaaaatcagtgagaaacacaaagtcagatagaaagaatagaagcaggctgggcacggtggctcacgcctgtaatcccaacactttgggaggctgaggcaggtggatcacctgaggtcaagagttccagaccagcctggccagcatggcgaaaccccgtctctactaaaaatccaaaaattacccgggcatggtggcgcacacctgtaatcccagctactcaggaggctgaagaaggagaatcccttgaacccaggaggtggaggttgcagtgagctgagattgcaccactgcactccagcctgcacagtgggagcaagactccatctcaaaaaaaaaaagaaagaataaaagcaaatgtatatgaatgggctgaattcttcctttaaaagataggctgttagattgggttgaaaaagtacaattctataacagttacaagacacttaacatgataaaaggagcttaagtaaaagaacatagaggtagcaagtaaatgcagacaaaaagaacacagatattgatattgatattaatatcagatgaggtggaatttaagattttagtttatatgtaaatacagttttatataaaaagcacacattaggttattgattatatagctgtggctttcttgtgtttccccctttttggacaacccccacaacatacatacacatcagcacctacctccattccctgacctctagtaattcctgttaaattgtatgagaacagtttacttagccagcagtaaggcgtcccaggttggaagtcagaagtcccctatggatctttatgtcatccctccctaagctgcttgcttttgcaactaaggccgcaaaactggctattccttttaacaagaaccttagaagcttccactttctagtgaaacttaggggatagattattccctctgccttgggttatttgcttacctacagccgcatgaggtcattaaggcttgtgtttgtttgaggtctctttgaaagtacatagatgcactgttggaaatttgtgcctggtgactgccgtgtttgaaattctgcccaagaagtctatcagcatagttctgtggaccagaaagagcatcctggtagaaggtcaagtaaatcatggtccttatattttcttagtattactgtgttatcatggagctaacttgaaaagtaactgacacacacactcttgctgcctcaagcctgcacaccttaatcaaaatcaaggaaccccctgaagacttcaatggaaccacttttaggtgcacgcccctgtgaggacacgtccatgcaaaaagcccaaaaagctttacagtagtcactttagaagcacctgacttaggaaatgtagaggtagtggcaggctctccattttgtaggtgaggaattcatgcggtcaaccagtcctcagagaccactaactaattagtgctaactaatctcatccagagtctcttacttttgtgtgacaaaaggatgctcaggttactgagaagaagagttagacctggaggaaggggattctcccagtcatggctgtaggcggtggtgccaaggcttgaatctgaaagctaacaccataatgatatctctggtacaggggatggggcataggaaaggccatgagctattttgtgttttagccatgtttcaggattgaaaagtaggtggaggacctgctagcttcctcaattggatttggccattgagtcggtagactcactgctgggtgcacattagaatcacctgaataacatccctagggagtctgtttcagttggtctggggaggggcctgcatgctggtgttttttcaaattgcagataattctaatatgcagctgagagttgagaaccactgggagaggcctagcaaagatgggctcaggtcctagccgtgggtgtgatatgctttggagaaagtgaggttaagttagcttagaagtctaggatttgtagtcccagcccctttcgtggaagaaggttaagggagaggagactaaccgctgtttaagcagagggaataagcttgctttctgaggatccctggacctgattcttcaccctccatgccctgtgggatccttgggacagaaacaaaagttggcaaggggcaggaaagatgagatgtttagataaagagaacagtgtttaaacacgcatagcaaaacaaaagttttgagggagggggcaaacaggagcaagatgctgtacatttggtcacatgctagttttttttaccttgatttctgcctttggggtaaaaaagtttggtggatacataacattcagaccaattaaaaagtctgattgcatgcatgggaatccatttgtggaaatggataaatacacattccctccacagccctcacatcccctccacagccctcacatcccagaatcttacctgcggaggaactgaggacccctgtctatctcaaggccccgattccatgtctcctggagtggcacaagcactatgtcaagaaatctcttttccctgtccctgcccaatcagaagtgggttcctgtccagtgtttttgggtgttcccatggggtcttggctgatggaggtgtggacagcaggtctagcatactcctcccttctcagtcggtgggagctggcaggcatgtcacctctgtcagacctctgggtaagaaaggggctctgttttggcctataggtataaggtttatcatgctcctggtcaacaggtcttgccttcccctgtgggggtgacagtagctgttctttacatttatgcagcagtttgtacttaaaatgctttctcccatcatgtctttttattctcggtgaccttcattgggtaggaacagtattatttttcttgctttacagttgaggaaacaggctcaggaatgttaggtgcctcatatacaatcatacagcttttaaggcacgaaccaagggctagatttttaggttgcttgacacccagacaagaccctgatcacagttcagacgggtcatttgcgttcaccgtggtagtagaaggaactctttaaggggacccctgtcccagattggtctggctggggcttatagatagtgatatgcagaggctctgcctcttaggcatcagcttcctcttcagccaggtagagtattgtccacttattgtgcaggtaaaaagcaaggagctctttagaaatgggggagtaatgttcacaaatatttttacatttgaatagaactatatgacagaacacagtggctgctaagatgtctttatggagtatttaatttgatggtggaatgggtccatcttctcagaactatgtaattcactttgtcgtgagatatttccactatgtaaaggttatacaaaatacttaatgtccacggctataagagacactgggcaaatccatccatggcttctgccagtgcctctgctgtggaagataatcctctgtcggcttcactgagccactgttggaggttagttcaggaaaatgttgcccatgttggggttccccctgtgaaatacaggcgcaaatagaaatgcaagtatattttcgcttattgtaaacttacatgactttaaagcggaccaaatactgttgttgaatatactctgaaagcctaatataagtaggactttagttaatgaatttcctcctccacatgttctagccttgctttgtcagtgacatgaaaacaaccaaaatgctcttaacggaagatgctgaaagaaaagccttttttttttttaaaaaaatgaaaggctactaaatgatagaaggaaaagcattcttaaaccctattttttaaaaagctaatctggtgcccataaagtttctctcttaccttctgttcatcattaatgataaagtattttttagatttcagttgccaagttgagaagtttgtttaaagagttatttttattggcacaaataaagaagcacttttgtttatccacaaaattcctctttctgtttgtagaggtatgtagaaaaccccaacatcatggcctgctacaatgaactgctccagctggagtttggagaggtgcgatcacaactgaaactcaggtaattctaccacttctggaaagccctccaggccatacagggcagcatggcaagtgagaactttggttgtggggaatacttttgaaatggcctcttgcagaaatgggattggagagaatggagtggcaactcccctcgtacagactttctggagtctgcctggatgtctaataaggggtcattttagtgattagagactcacatttaaagatggagcccccaaataatagtaagtttaaaaagcagaatacaaactgcatatgctggattatctgttttgttttctaaggggacaaaaacggttttaatatacacccccccaatctattaacattagttatctctggtaggtgacatttttttcttctctacaataagcattttatctgctcttgataaacagggttttttggtttttttttttaagtgacatgagtagaggcctcattctttgtagagtaagaaaagcagaaaaattaatataattttatcagcttgacaaaagaaaaataaagtcagcagcttcctatcattttaggtttcttccttgggtgttcaactattctttaacatttcctttactagggatcaaagagagaattggatcatttcatttgtatgtgcccaagacagtcaaaggggatcggaatgagagtaccaagattaataaggaccagtacagggttccacgtgtagggaagataggtactttatagacaaaatgaaatgaatgattagcgggcagagtgtgagttagcagagaagtgctgctgagcagaggtgtttgaaggctggtgtggtatacaaaagagatttttacgctgctagattttgcaaggaaacttaaggtagatggttgcccttgggcctgcttttttcccactcctgggtcatctcagcctggctgcagcactcccacagtgaattaggctactaccctctctcagaggagagtagaattttggagcagtaggtgatgttggagcttattttatccaatcaagaatcagaaactgagacccaaggaagttaactgacttacacccaagatcttgtaagcagcaaatggcaaaaatagtgctttaaactgaaatctgcattttcgaaactgcattcattctttcttccatctctaaatctgactgtaacctcaaaccttttcctcctgtgtaccttagctgtcatctaccttgtggtcctaaactaaaacccctgtctcttctacatacgtccctaaatccagtcactgaccaagtccaattgatcttactaatttttggaatctgtccacttaatcttcatctctactgctactcttagtctaggtccctctctttttacctggattattgaaaccaccagttagtctccctatgtctagtcttgactccttcttcattctccacacagacgtaacacaattccatttgtgttcctgttctatgacaccccagataggcacccactgcgttcaagatgaagtccaaactccaaaatgtagcctacaagggtctccatggtctgtacactgcttacctctctgtcctcatctcccatcatgccctgctttgttctctgtgctccagctggcagccaaattatgatgtccattatacagggagatataaaaatataaagggaaaggaaatgtgaggctagagaattgggagaaatagagtcttgttctttcagatactaaaatgcactaaaaagctgtaacaagcaggggtgttactgctagattggtaaactagaatataaaaaccagaaacaggccgggcacggtggctcatgcctgtaatcccaccactttgggagactgaggcgggcggatcacaaggtcaggagttcgagacaagcctggccaacatggcgaaaccctgtctctattaaaaatactaaaattagccgggcatggtggtgagcacctgtaatcccagctactcaggaggctgagacaggagaggttgcagtgagctgagatcgtgccattgcactccagcctgggcaacaagagcaagactctgtctcaaaaaaaaaaaaaacagacttggatatatttaagaatttagtagatgatcggctgggcagggtggctcacgcctgtaatctctgcactttgggaggctgaggttggtggatcacctgaggtcaggagttcgagaccagcctggccaacatgatgaaaccccgtctctactaaaaaaaatacaaaaaattagctgggcgtggtggcgcatgcctgtcatcccagctacttgggaggctgaggcaggataatcactggaacccgggaggcgaaggttgcagtgagctgagatcgagccactgcactccagcctgggcaacaagagcaaaactccatctcaaaaagtaaaaaaaaaaaaaaaagaatttagcatatgattacatggcattttaaatcaacacgggaaaaagtggacttttcagtgactagagttgtgatagttggttgactagctggaaagaaagttaagctacgttccaatctcatgtcctacccgcaaaatgaactccaatgaattaaagacttaaatgtgaaaaagtagggctacgtaagtactaaaaaataaaagtggacatacataattggatgacgaagtcattataaactaacacttataaaagccacattttataaaggaagataatcagattagacaacataaaaatgttaagcttatctacagttaaaataaaccttaaataatgttcaaaatttagacaaatgactaactgggaaaaatatgtttgtaacatataggacagacattaggttaatatcctcataaatacatgaagagctttgattaatcaattgaaaaatgatcaattaaaaattagaaaaatattaaaagacatgttcaagtggttcacaagagatattaatggccaataaatgtgaaaagatgttcaacctcactaataaagacatgcaaatgatttaacatttttttatttaccgtatctgcgaaagttaaaaaaaagtatgataaaacccagtagggcttctcacagatccatctccgccaagcttgttatattggaggtgagaacttcttactgttttttgctttttttattttttatttttttattttttgagatagagtctcactccgttgcccaggctggagtgcagtggcatgatctctgctcactgcaaccttcacctcccaggttcaagcgattctcctgcctcagcctcccaagtagctggtattacagaggtatgtgccaccaggtctggctaattttttgttgttattgtattttttagtagatacggggtttcaccattttggtcaggccggtctcaaactctgactagtgctaggattacaggtgtgagccaccatgcccagcatgttttttgcttttttttttttttttaataacaactttattgagctataaatttacatattatctcctggttttttttacatgctaaaaatgagctaatttttattggctaagctattgtctttagtgagacagtttagtaataccagcaataatgtaaaggcattgttttttttatttacttatttagagacagggtctcactctgttgcctgggctggagtgcagttgtgtgatcactgctcactgcatccttgacctcttgggctcaagcagtcctcccacctcagcttctcaagtagctaggactacagatgtataccaccaggccagctaattttttattttttgtagagacagggttttgccatgttgcccagctggtcttgaacacctggactcaagcgatctgcctacttctgcctcccagagtgctggcattacaggtgtgatccaccgtgcctggccagcattgttatttttagagtttacttagtagtatctctgcactttataagcaggcagttttcttttttttcatcttctgaggccagagaatcttaaaatcattctttgggagattacttatacaaggaaaaaacctggaagcaacctaaatgtctagtgataggggatttattgaataaatcataatataatcttagaatattatatagttatttaaagtgatgataaagaatgaaaattattgatatggaaagattaatgtatagtgtgccagtgagaaaagcagattataaaactgtagagtatgatcttgtttttgtatgcatattacatatgcatttgtacaagttaatgcctagaacatttttcaatgcttattgaaaataattagatttttttctataaaatagaatgttgagacgtctgggtattgggatttcaggttatttgatcttattatttttaaacagccttattaaggtatagtcaaaggattttagtatattcatagagttgtgcttcagtcatcacaattttagaacatttttattatccccagcccaggctgtagtgcagtgatgcaatctcggctcactgcaacctctgcttcctgggttcaagagattctcctgcctcaggttcctgaagtagctgggattacaggcgcctgccaccatgccttgctaatcttttttttgtatttttagtagagacggggtttcaccacgttggccaggctggtcttgaactgctgacctcaggtgatccacccgcctcagcctcccaaagtgttgggattaggggcatgagccactacccccagcccaatctactttctgtctctgcagatttgcgtattctggacatttcatacactgtgtgatccttgtgactggcttacggttttcaaggttcattcatgttagggcatatatcaagacttcgtgtccttttatgtctgcataatattccattgtatggatataccacattttgtttatccattcatcagttgatggacatttgggttttttccattttttggcttttctgagtaatactgctatgaacatttgcgtataagtttttgtgtggacataatggggctgtttcccaaaaaggggctgcacttttttacattcccaccagcagtgtaggagggttcctcactaatacatgttatcgactgtcttttttattattcaagtgggtgtgatatagtgttccacttatttttgttaatgtttattttctaatttttttcaataaacattgtcacttgtataattttaaaaatgttttcaaacacgaaggatgtgagaaaatgctcacagaagaaggctaagtgaagaaagcaggaagcaaagctagtctttccagatgccctcaattttgtgaaaataatttgtttaaaataataggtagaaatgattgccttctctttgccaggctctgtgcagtattcttgactctattctcttatttagtcttcatgaagactctaaggtggtgaaagggaaggcttgatggggttcagtcacttgcccagggtcccacagctgctgaagagctgtgatttgaccgtggtatgtggccaccctggctcactggcccaatgtgtctttccttcatattggaaggaaagataccgcagtgtgtacatagtggtgattccagtggaggggcttgcaggggggtgtttatttctttttatgttttaaaatattttctcccttccttataaatcggacaaaaaatacatttaaataatgtaataacccaagattttattttgtagtatttacattaatcattcctttttttgtttactcataaagggcttgtaactcagtattcactgcattagaaaacagtgaagatgcaattgaaattacaagcgaagaccgttttatacaggtttgttattttggaaatctgtctttctggatttcttgttttgctttttccaacttttaggattgaacctctccaatatgatttttttttttctttttgaagtttaggagaccagtttttccttcgaggattatcagaacaaaatcaaatatgtaatttaaaataagctctctatagattagaaaacatactaataattaaggtgctagaaaatgcctgtagaaatgccacatttgcattcattatttccactagtttgtttatttaacaaggagagactcactgaaaaggatgattgctgggggcttgggggtagtgctgttgtacgaaggggaatgccctgaccataggtctgcaagtacaagtctttcacctttctcactgtttttgaagataatttgcacttacagaaatatactagaaacaactaaaagtttcagaaataacatacctagtaagtgctgaataaattacacattattagcaaagtgggtttatatgagtgacttaaggcaacatagcttaatgttttcagataacagcaaaaaagggagttgcaccagaaaaagacattcattttgtctgagaattagctccactttggagctctccagtctttcttacttctgggctctccagtctttcactttaatatgacttgtgacttccttgttgaagaggtgatggtgttgactttgagttggtgccctgagaggcagcgtgggccagtgtttgagggcacaggctttggtgtcagacgggcctgggctccatcctgcttcagctgaacaactttgggcaagttgtttaatccagctgaatctgctttctcatctgtggaaatggaaataatattagtaagaacaacagcctgccttttgtaaggatgtcatgaggactaaatgaattaatgtatgtgaagtgtttactatagtgcccagtgaggaaaatggaccctgacagatagtatcaattattgttttatcatcatcatcattagcacgtgcacagttttcccatgtattttctgcttatcttacagtcatatctgaaacttaaccataaagccttacatttgtaattacttcttagttcatagcctgctttccatacacatcatttattcgaaccatatgaaagagacaagagaactgtttcattcccatatccggataagagtctcagagggattaagtgacttgctgaggtcaatgtgtggagggggaggacagcctgagtgttttgcactctacctggtgctttattccatcatccccccacccccacccccatctaaacagccctgttgtagcagctcctggtttggcgctgtgcacatcccttcctctgcccctgttgaagtgggagtgggcctgctgccctcctggagcctcaggagaacatagcagaaagcccagccgggtatcacccaagcagaagctcgtctgggctccagaattcttcgtgggttatgtgcttatggcttcacaactgccacggtgaggtccaggctcctgagctttttctggggaaaaacctgaagggcttaggtcgaagacctttgattgtcctctttttcaaaatgacttttaattcactttatgttttttcttttgtctcccttcagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggtaagtaagaggtcagtgccttttttaactttcacaacacagagagaaggaagacttagtgttcattgagtactaccaggtaatcttaatcttactcctcccagcagcccagggaagtatagggaatgttatccctgttatatccattttgcaggtgaggaaactggggccaagaaaatatataatatgattagccaataagcaaagtaacttgaattgacacttaacaatcattgtttttatctttgtagtaagttaataacttgatatttctaataattggtcttcttagttgtagatgttggcaaatggttctgggtaaagaattgccagtaaggcaacacattctcagaaaacatctgagcccaagatttctccaagcctcgttaattcattgagcattttaaaaatgccttctgttagccagacactgtgctagattctggtatggaaagaagagcaaaacaaaaattcctgccttagagagctcatattcaggggttggaaacagacaaataaaagtaactattattcaataatgtaagaagtcacataatcatggtgctgaaggaacaggcagaagaaaggcaggctcagtctgaaaggttatttctgtgaaccacagcctctgatagtgcctcactgtgacagattttaaaatatgatgagaaggaaaaggctactgcttttcacaatcattcatggtcctttctgctggacttttttttttttttttttttgcttttggaagttgggtagagactattaatctgattatttcaaacatttgaaaaattggtgacttgtgcagcctgctctgtggaggcactgatggaagtgatactgtctcccctatggcatttggctagttcctatcttgtagcacaaaacagcagcttaccacaggggcagggtgctgtgcaaagcttatactccgctcatcttggaccccatgaagacaccatgaatgggcctgtttttcttgcctttcctatgcctctgagcacacaacattgccttgaagtgagaacaaggaaataataggccagctgcaggggcccagtgaagccctgccaggggaatgacaaaagtaggcactgctctattttgccttcaacttttctgtcaaggattttttttgttgttgtttttttttgttttgtttcgtttttttactagagggagtggaaggtcctctagaaagagaggtatgaaggctgagatggatgaagagaccctcaggtgctcaggtgcaccatgtaggtgagggcaagtattcctttccatggttgagaagagcatactcagaaggaggccacagagcagcagtcatccgagaccacagcagccatggtgggggtgttaccatgaccacctcaatcctggcatttaggttccttgctgctactggatgagccagtggttttgttgtgaggttcaactgggtatgaaccaggatgggccttgtacaccttgatgtggcagaacttccactgaggcattccatgtccctctcactgaggaggcaagtagaggtaaggaagggatgtgctataagtgctgggctccatccagttctgtgtgaactgtgtctcacctttgctggggttgtgctcttgggcaccaggtaacaaaagccctcaaacttgaatagcaagagacctgctctctaaaattatacttattgtgagcaaggaataggaaacatcatcaaattattgacccctatactgctttccttttttttttttttttcttgagacagggtctcattctgtcacccaagccggaatgcagaggtgcaacagccttgacctcctgggctcaggcagtcctcccacctcagcctcctgagttgctgggaccacgggcacatgccgtcatgcctaattttttaattatttgtagagacgggttctctgtatgttgtccaggttggtctcgaactcctgggctcaagcagtccgataatcggccacccaaagttttgggattacaggtgtgagccactgcagctggcctgtactgctttatttctaaaaagagcctgggtatttgtttcgtttttcacagtttttggggagcatggaaaagcaacctttgtcctttgtcaggaacctgctggtctatgggcaacatggcagcagggcaggccgctgagctggcctgtgttttgaggtgaaagaatccataattccatctccggggaacagggcttgttgaggggtcagcaggccttatggaacagtggcactgtgatcaggaaggggaattcaggcatctgctggagaccagcattgcagaatggagacttaggaaatggccagatggctaggagttgggaccttggagtgtcagatgctaggtgttggatattgaagtttgaccttggggcagaagagaaattttgctgatgttcaagcagggaatattataaacattttccatctccacaaaccctgctgcccattgttgtcagtggctcctcttttgggtaaaaataacaggtatgttgatttccagcccccgcacttaggcttctttgcatcctatatgtatatccacctgactcttctcttttttcttcttccccaagacttgtctatcagggctttagaacccatagtctcccatcttctcagatacctaaactttatattgtcaattctcttttagagatcttttttttttttcttgagacatggacttgatctgtcacccaggctggagtgcggtggcacgatcttggctcactgcagccttgatctcccaggctcaagcgattttcccacttcagcctcccaagtagctgggaccacacgtgtctaccatcacacctggctaattttttaagcatattttttagaaatggggtctcactgtgttgcccaggctggtctcaaactcctaggctcaagcagtcctactccctcagcttcccaaagtactgggattacaggcgtgagccaccatgcttggcctcttttaaaaatcttgattttttttttccctccctcagaaactgtgtgttcttcttttgtcatttaatgggtaccaagtaaatggtggctacttagatgcctaagatgatgatgtgcagctgcagaaatcttcagcatttcaaaacttttaccttcattagctcctgtgcctttgctttcctctcactgtctccccttttcctactcttcttccatttcctcccagatttaccagaactctggcctttgccccctactgttgtccctcagaatgttcctttgttgttgaagtatcttttctgctctgtgtagaaatctcacacttctctggttttagtgtcagcctcttttccaaggtctggttcagcatcctactatcatcttaattgtctagcaatggttttctctcatctcccaaaaacccaatctctcttccaaatcctgctgtctctgctcatggacctacctcacagttgctttgacttagattcctgaaatggttttgatcccttcctccccgttggtcccctccatcaaatccacaagcattgatggctgttaaacccctgttttgagggtccattgcctgggcctgaccttgctcagggccttcttcccacactctggagttacagtgtgtaactctgtctccttgtccggaatcctccatctccactcggtccaccatacactactgcctgattagtcttactgagtcatcattttgtcatgttgcttcctcagcatagagctcatagtcctcagcttggctgccaggattctatagttgaacctcagcctacctttcccattcagtaacaaaagccccaagtgttctttgacagtttatcatgtgcacacactgtgcccaccctggggataggatggctggatgatgatgatttaattctcaagacagcgggtgccaagagggactgcatcaatagcttggtgcatagcttgtagcagacagaagggaggtaatagtcttactcctgttctgaggggagcttggcctggagaaagaggcctatgcaaaccacctgcacccaaaccagctcatttactgaatgtttactgttatgtcaggactttgctaagagtttatgtgaattacccaacctaatcttcatggtagtactctaaggttgtactattattattctcaggaactaaatatatatatattttttttcctcaagacagagtctcactctgttgcccaggctggagtgcagtggggtgatatcggctcactgcaacctctgcctctcgggttgaagcaattctcctgccccagcctcctgagtagctgggattacaggcgcctaccagcacgcctggctaatttttgtacttttagcagatacgaggtttcaccatgttggccaggctggtctctcaaactcctgacctcgtgatctgcctgcctcggcctccagaagtgctgggattacaggcgtgagccactgtgcccagctggaactaaatcttatatgatatttatgtaagtaaatattttttgtttcctctggtgactggaaaacttattgactctgttaccctagccaagccattgcctaaattgtcctgctcctttagatggactgtggaactttgcctggaatggcctgttagccttgacttgggatcgctcagtcacccaagtctattcagaaaggacaagaagatcctgaatatatatatatatattttttttatatatatattttttgtttttgtttttgttttttgagacggagtctcgctctgtcaccaggctgctcactgcaacctctgcctcctaggttcaagcgattctcctgcctcagcctcccgagtagctgggactacaggcacatgccactacacccagctaattttttgtatttttagtagagacagggtttcaccacgttggccagggtggtctcaatctcttgacctcgtgatccactcgcctcagcctcccaaagtgctgggatcacaggcgtgagccactgtgcctggcctgaatatatttttttaaatgctgactgattgaattggtccctgtaatttttttctctctctttttttaatgtaacagttttattgagatgtaatttctatgccatacaagtcacccattgaaagtatactatttgatagctgggcatggtggtatgtgcctgtggtcccagctacttgggaggctgaggtaggaggatcacttgagcctgggaggttgaggctgcaacaagccatggttgtgccactgcactccagcctgggtgaatggcgagaacctgtctcaaaagataaagaaagtatactatttggtggttcttagtatattcacagttttgcaaatgtcacaattaatttcccatattccccttgatagtgagctttagaagtaacccttagacctgtctgctgaagccttccttctaaggtagacatgcaagttgtggacatggaggacaacccacttatttctgcctagggaaccctgtttagtccttggtggctttggactacaagcctcgtcctgtgggctgagctccccctcagaactgtaccaaggcccatacctcccttctactccagtgtgacctaaggactcagctgggctttctggctgttttttgatatagcccttttttggtgcccattgttttcagaattatatcagtaagcatcagtaatcatcctttgattctatcggagtattctggtttctttttgatctgctttcccagaggagtctgaagatgagctcttatcattggtatttggatgcaggttgccatgtaccaaacaagaatatttcagaattgacctggagtagggctctggatagcaaacctcagctaagccaacaaggctgccatggtgcttaacacccagcctgggtcaactctaggtcctgagggactctggaaggctaagaaaggttatggaataccctaggggttcagtgtcctgttgtgggttttagggatttccatagtttaagggccttggtgattttcttggaggaattcataacattttaggacggtgacaaaacccagctccatcctggctttccctaccaccccaagataaagggagtcaccacagcccggttctcttgctgtggtcttgttctgtgtagccctctttccccaggctgcacttcctgtctgaaagaatccccacgttctgtgtctgatcaggagagcacagctaatgtgatttcagccctgggttttgaggtctcgtcgtttgttttacttgagcttggtcctggctgttatctcatcctccacaccctatatacagggggtgaagccttcacacatcccagaagggcctcaagccatttagttcacctcagaagccggtagtggccacataatggtcccttctggcccccagtctggctattcttcccctcccaaacacaggggcagaggctaagccccctcttccacttcagcaggtgggagttatgagaggaggaagtaagggggagtgccctttatttgggggtccaggacccctcttgtctgcagatggccactgaaaatatatgaccacttagactatggtgacctgacttttgtcagcaactcagaaggaggtggactttggaagttaagaaagaattgtcctattacctgaaatcagtttggggttgggatcattttttatcttaattgctttagcaatgtaagtgaatcagaactgaagtggaaaatgttcttgggtttatgttttcaacacaaagtatgacgatgcttacattccatttataggagtggcaaggaatttactatgccaaaaagaaaaacggagataatatacaacaaaatgtgaagataatacctgtcattggacagggagggtaagtggaaaaaacaagtacatcaatcaacatacagtgttttgggttattgcagaatttgctttgaatatttaagttaaggactgctgacagaagtgtcaaggtcaggtgtcatcacagaatggccttccagcatagtgttttcttggtgacttcctcatggctacagtctgaccctctacttgcagcccagagccaacatactctgggcagtcttgtttaagctgcgtggatacacaagaaactgaagtatttgtttaagtcagaatgtcactttagtaagttgtgtgataatactgactggtagactccctatattgaaaagattttttatctaatttgataggctatgtattatttctgcagagacctatcaaattagataaaaatattttaaatactaacagttatggacattcctatataaaacagatgtgactgtagattggaaaccagtatatatcaggagcctaaaactttcagacagtttatctcagaaacctatcttaaagaaataatatggtaagatgaaaattatgaatatgaattatagaacacctaaaatattgcagccattagaaatgatgatcatattcacaggttctaagatgagggccaaaaaaagtagaaatgatgatcatagaaaattaaattacctcatgcctgtaatcccagcactttgggaggccaaggtgggaaaatcccttgagcccaggagtttgggatccgcctgagcaatatagtgagacccccatccctacaaaaaatgtaaaaattagctaggtgtggtgacacacacctatcagttacttcagggggccgatgtgggagaatcgcttgatcttgggaggtcgaggctgcagtgagctatgatcatgccactgtactccagcctgggcaacaaagtaagacactgtctcaaaaggaaaaaaaaaaataaaatatgagaaaggttatgatacaatgttaaatgcaaaaagtaaaatgtaaaatgatagctagtgtttaatctcaatcatgtaaagaaaagaaggaaaaaagaacaggagaaagtatggcagtggccgttgtagtaaccgctgttgtttaattgagcccctcccttcctggccagttctcaatgtgtggtaaatgccacttcattccatcctaactgcagccctgtgaggttgggactgtgatcgtctccactttacagatgaggaaactgaggcttagagaggtcaggtttctagcccaggggtccagctgccagcgtgaggcgcagccaggctgcagacctcagcactgactgcacagctcacgtgctttgtcaccaggctttgctgccagttggtgatcgcctcagggagatggatctgtgtgggttctctgttctgattctttgcccttttatgtcctttccaatttttttgtggtaagtatatagggatttgattatcaaggggaaaaagtgaaaaaactgaaggaacaataaataaatgagaagagtcagcagcctctgagctaagccctcgttgctttgttttagacatctagctaaccacgttcagtgtgaacctcaactcccagtgtggcccgcggctgtggccaccagtgaccgtgagcagattgtttgttggaacttgaagaaaagcatcaatgtaaagggttgtgaaaataaaaacatgttaaggaactaaaggctctcagttggttaacatgcagttcattttaaaaaatatgtatatttgattgtctcatgattaattgggaagaattttgtcatttttactgaagtcacttgtacagagacgccaaaggatgtttgtgatctcttctttatttattggtggccttggtcacagtgagaagaaatgttctcagagcgttttgtgtattgcaaaagggaggtgccattttcgtaatgaaaaattaacgacatatccatcaaattagagactcagaagagaaataatgcattgttttttacttgcagaaaaattagacactatgtgtccattatcagagtgtgcaatggcaacaataaggtacgtaaggagagccccccggggccccaggaacaccccagcaagattttcagcaatcagaactaatggcttttaaaattcacttttaggctgagaaaatatccgaatgtgttcagtctgacactcatacaggtacggtgccccgtatttattcttagagttcattgagtttttggagaaaaaaaataaaaacagatctttaactagcttgcctggtgtaatggtgggattttcctcagactgtggcaacatttctctccttgactccccaggctggcttatgagtcacttgtacagaggacttgagcgcttgtgagcattctgatgggtgccctggggcgggtctctgagcctgcgagggaaagaaatggtcaactgaaatgcatgaactcatgtgaagtgtggttttataacctgatttatactttaagagggttgagtgtttatcccacagtcctttaacagggatgtcttcatctgtcctgacacttaccactgccagcctgcagggaggtagccaggcccctcgcacttgcctcacctctatgtttcttaaccatgccttggacaccatctgttcttccccatagctttcttactgcaaatgcatttccctggtttggagtcacctgtttccttcaaacgtgtcatgacttcagcaagccacttcctgttctggccctcacagatgaaggggctgggctgggatggtgaagcgccactccagcttcaggcaggaggtgctccgtcaagtgtctgtgtagacacttggcgtgccaccctgccttgcctgagtagtgtgctctgcttgcccatgtggtctgtaagagcctctaaggagaagacttcccttcatgctgttggtgacatgctttctgccttaccagaacagttcattctttcattctagaaacacttactacatatttttgtgagcacttaatgtgtacaagatacctgtcctaagtgctttaggtacagcttattttaatgaagccttagaataactcaaggaggtaagcatttttaggtgaaattctctttacaggtaaggaaactgaaagtttaagtaatctgcccaaggatctccatttaggaagtggcagagctagcacctgaatccaggaggactgacactagggctctgaagcacagtttttatgggtgccccaggagcaatcagagatttagtctgaaaagagagacacattgacacaaaggaacacagcaagtgataagaagtgatccccaggaatgagaaagggcagtgggtagtcttctagacagggagaggtggatttgaatagaaaagaaatgtgagcgggaaagcattccagcaataaaaacaggcatagaagggggaaagtacagggcatgttccagaaaaagcaagtactaaattttgacttgtataaaaggtcaatggggaaagaggtatttgggtcaataagaatccttaaatgctaggtgggaagtttccattttcatctgtggacagtgggagtctgaggatttgtgagtcagggagcagcgtgatgacatctgagctttgagaagctcttagagcatgtatgtaagattacatggaaggagacaccagagagaagaataccagcattgccatggtcgagaggaaagaaaacaatggccagggaataataaggtgatgacagtaggaagagagaagagagaccagatgtgatgatggtgtgggactagagagagaaaagcaagaaagtccttgaaaaggttgtttctgagcctggagattcaggcagtagcagtagggctggggaggatgaatgtggagagctctacctgtgaggtcctggtgggcagtcaggtgggtttgtttgttcacccctttgcccatttattctacagatttctgttgagtacctgctgagtgctggcttctgtgttctgcaaagaggttaggtctagagatgaaaatgtttctggccagccaagcattagcaagtagcacagatgtggaagtgatggaaaccagggatggtaaaggggaatggaaactttgagattacagtggaagagaacagcaagaaaaggagaggaggggtgaggtggattcctagagaccacccacctccagagaaggaggaaacagaagcaggaaaagaggggttagagggacgagggagtctggagagcgttgctgaagctgaaggcggggagaacgggaagcatcaagactggtcagggctgaagcacacatagggagggagggggatatggagccagagatggataaaaacttgtgctttgcattcaagagctcgtgtgtgacctgcagacatgcagtttcaggagaatggcgagggcagaagccagattgcaggggctggaggagtcagagtagaaagcagcatgtgtgggcctgttatggagagtcctacaccacaagttcacagggggcttttacttggttgtaagcatttttttttttttaactcttaagaagagtaccatagggctggacgcagtggctcacacctgtaatcccaccactttgggaggctgaggcaggcagatcacctgaggtcgggagttgagagcagcctgaccaacatggagaaacctcgtctctactaaaaatacaaaattagccaggcgtcgtggcgcatgcctgtcatcccagctactcaggaggctgaggcaggagaatcacttgaacccgggaggctgaggttgtggtgagccgagatcgcgccattgtactccagcctgggctacaagagtgaaactccatctcaaaaaaaaaaaaaaaagaataccactgtaaagtaggtatgactattatttatattcctttattacagaggaagaaactgaggctcagaaaagttcaatgagccaggtgtggtggctcacacctctaatcctagcactttgggaggccaaggcaggtggatcgcttgagcccaggagtttgagaccagcctaggcaacatggtgaaaacctgtctgtaccaaacatacaaaaaattagccgggtgtggtgacacgcgccagtagtcccagctacaggggaggctgaggcacgagaattgcttgaacctaggaggcagaggctgcagtgagctgagatcgcgccactgcactccagcctgggcgacagcaagactctgtctaaaaaaagaaaaaagttgaaagacagcctagagttgggcagccgggatatggcagagctgggactgagaggcagagtcagtgatgcagtcagaggaaatgttcggcagggggagcatctcccaaactgcatttgtaccagggcatttggtcgttttacttggtcaccgttgacttaggagttttacccatcccacccaggtgagccacttgcccatcctacctacccccttagcagcataaccacctttatgtccaaaggtctcaactggccatcttcacttgagaaggcagggtggagctgttataggccatgggccagccaaagtccttggttatacacaacagaaatcaattcttcagcagaaaaggagttttttctggaaggaaatagggttgcttatagattggacaacaaagctctagaactagttttggaaaaggaagcaagaacctggggaagctgagcaattgtccccactgccgtaggcatgccataggagcactgtgcttagggggccactgctgtcactactgagctttgagcaccactggccctgttgagatctggttatagggtgttgctgttctcaccacgggtagcatagcttcttcacacctcgcttccttacctcactcaaaagcagactcttggaaggaagcactcatttgtctgggcctgtgtcacctactctgtcactaactgggtatggagcagtggagtctctggccttctccctcccctactgagaggacttagtactcccagacatgggaaggaaggttcagggtctgggcatccaaaagagtaataaaatcccaatacatgctcccttttccctggcccatgtgttgttttcacgtgacactgtctcactgaggacaccaaattgtagtgacaactgtccagtctattgacttgttctaggtcaggccctgagcctgactgtaagcatacagaaatgaacatgagtttcgctgtctggtggcaggagaaaataatttgaatatgctgtggtttgtagtaccacactggagaaaagctggggaatgcttcccagcaatgatgatgatgatggttgacctggtgtctgaagagaagtaggggtcatgcagaggacaagatgggagaagcagcacccataaaggcatcgcgaagcgaggctggggcaggccagtttggattcatcctgtaggcagaggaagaccaagggaatctttataaataggtaaatgggaaagggtcaggtcttaggaagacagtcatggagaaaagagattgaagacaaagtaactcctgaatccagcctcaggagcccaatcagagactggattcaggagttacttaagtataatcagtaggatttgggaaccagcttactgtgtgggataaagagaagacttcagaatgacaccaagatatctagcttggccactggataacattagttaaaataacaagtgcaaataagatcgtaagaaagagcaggtttgtacagggagtggatagtaagtttagatttgaacttaccacatctgaagtgataagccaaaacttttggccctgggccaactattctgaagagagaaagtgaggcaggaagactgagtaccaagaaaggagtccagcaataatagacgtgaataatggccaggggagcactgaggagcaggatgaattcattcattcatcattcatccaaactcagtgcagttgtgtctctgcttgcaagatatgtttctatctgggggtgaggtaaacagtaagcaaataaacatacagtatatcagatggtgctaagttctgtggagaagaataaagccaggggattgggcatgcaggggatgaggaggtggtcaggacatgccttgccagtaatgtgacaggctctggttcttgttcaggtggtatggaatggaacccaggcctcatactttgcaggtgttctcatgggctaccagggttggggccattgttagaggcctcatagatgattgaaaagagttgggagatttggtctgtgcctggagaaagtgagctttcttgggaggaagaggtagttaccagaggcccatgtgcagagagtcctgtgggcttggcagtttggaggtggccctgttgcagagtaagtgctctgcaaatgcttgttgatagtgcctgaggagatgttccgacagtcagctgtggtcccggcagaatgacttttgggcaagtcacataaaatactggggtctggacttcctcatatccaaactggaactcatacttccaggctgcagggctaatgcgagttggaggaagctgctgtttttgaggggtactgattggttatcctctctcatcacccccactgtttttccagggtttcctggatttacccagcaggtcaaggaaatgctattaatttttctgtattgaaagggtgggcagagtttatggaccctattttacagaacaggaagccaagagcagagacatgaagttgcaggtgatcctgagcccaagccctggctatggaggcctagttagtgttctctccactggcaggccggatacctcaggatgagtatgtgttttctgagcacccagtaagcatgaggccctgggcgcagcacgccttcaggagctggtagtctcattgggatgtaagcctcacacttcatcttcaacctcttggtgttccctgaggagagcttctgagagctgggtgctggggtgacagggtggagacgtggtccatctctacccactgggcgaaaattgctagaatcatctataacgtgctacagggactaggggagcagtgagcttagcagggcttttgggaacaagaggatcttgtatttacataaagtaactttgaaacagtcaagtagaaattaaagcctggttagtctccctccacttttcacagtgcgtccttcatacaccctctgctgcttgctcctctccagccacactgctccatctgcacaagcagtttcctcctcctggaaatgctgtcgtcctcctcctcatcttggctgcagctacaagactccatccatctcctttctgcccccactcccttgagaatctgccacttccccctccaggctcctcctgaacttcagaattattactgtaactcctagtttacccacccttttccccactgaccatctcctttcgagttcatggactatacctcattcattttcacctccctaatgcctagcttagggcatcacacatggtgggtgaaggtttgttgagtggaataaaagagagaagaatgaaggaacaaataatcataagttctcagtccaggctcatcaggtggctatgtggacattactcatcatgaagctcagaggaaggagacacatttccagctccatgtggttgagaagaggggaaatttgaaggaatgaacacttggagagggtgcagtgttgtgtctcagacagaaggagccggtgtcaaggctgttccagagatggaaggcggagcagttgtgctgatgcagtacattcatgggaaacagtgagagatgaaaggcaggctgctgcaggccatccttacctgcccttgaatgccaggaagttctttatctctgagacgctgaaggattttgagcaggggagccacagaatcagagtggctgatttaacagaactttgatttgtgcacaggaaggtgcaggtttttggtgaagcagatgtgtatttattgagcttctatacacatatgcttcttccagcagatggtaggcacagagctggtcacctaggaaagacaggaaaaactgtccctgccctcaagtcattcatgttagcaaggaaggcaagaaggcaagacaataaagcaggctgttacccagcactgttggggtggtgtggagagactttaagggaaggtttcccaaaagttaggatacctgaactgcatcttcaaagaagatcagaggtaaccaggcgaagaaggtggcaggggagaggcacatttccaagtaggtggtttgtaccaaatcatagaggtttgggaggcaaattaacaaatcataaatagttcaaggtggatagagataggaggtgcagacctcataggactctgggtgccacactgaggagtttgaatcttatcctaaagacaaggatgagccattgaagtgttttgattgagagatctggttggatttttgttttacaacgatcgcttggctgcctgcagagaataagttgaaagggataaggttggtgttttagaaccaatctgggaggccattaatccagggaggatgacaaatgtctgagcttggacagggatagagcaggggatagactggaggtgtttaggaggtagaatccttagatttggctgacccagtggaaggagaggggagggggagaagtgatggatgacttctgtctaccttatggtacatgctgttcagtgatctgggttaaagagcagatttggagaaagataaggacttcatggtggataatgaattcatttgcagtgcctgaggagtgtctaagtgaggtggtaaatggtaagttaagatgtaagtctggagctcaggagagaggcctggggtaagatggcaacataggaattaattaaaactataggaagaatgagatctcccaaggaggttttgttgactgagaagggctaaggatagaaccttttgaaaaaccacctttggaaacaccaggggtactgaggaaggaggaaatcatgaaagaaactagaaaggagtagtaagaagtggaaggaaaaccaggagagtgtggactctgcaaacagaagtgtccagaaagggatcagttgtgtctagtaccacaatcaagtcaggtcaggtaaggattgagttgtagccttcagatttagcaaaaaggaggtcgttggtgaccttgacacattcactctttagtgcccacagagaagaggatttagtttaattgggcaaagaagcaaagagcaagtgaagagccttttcgatggtgcaaaggaagtgctaagggcctacattcggatcctgtacatgagcagggagagaagttccaagtgaggaagccaagacaaggcagagaagctactccatggctgtgggaagagctgagctcagcgcccaccctgctatgcactcatctgcaaagcagctcctagtttccttgtctgtgaaatggggatgcatggtacccagcaggtgcacagagaaggggtcaggaaggtaagtcagagttgccttgtcagtgattggtttgggggtcaggattagagaagagtcaaagacagtccccgtttgaagcctaggagagtagtgtgtccttcgtagagaagagggggtgaaagggaggcagatgagctatcatttgaaatatacctcaaacagtgttcaccatactaccctaggaaagagaagaatgttttccctgggatattgtagtccttattttgtagagaaaataaaagattttttttctttggggcaagatgagtggggatcaaaattttcccatcattttattcaattatatagaaatataataggagaaattctcctgaggtcatttctatcagttgtcactttatgtcttgggactctgtaattacataatctggaactgtaaagcccttgtttatctgtgcacctggtgggacattttgagaaactctacccccataaaactggtttctcatagtcttcatctctgtactgtgtttacttttgtggcatttaaaacatttaaagttgagagttttaaaaaaattttagattggtaaccttccttaatatgttgtttaaatatctttgaagaggtgatttatcatttgtttctacagataatcagacaggcaaacataaagacaggagaaaaggctcactagacgtcaaagctgttgcctcccgtgcaactgaaggtgagtgacaaagacaagagaaaaaaatgtgatcaaatcactgttgaacacatggagccctgccctgccttgcccaggctcatcctgtctacctccaattcttgggagaggagggaaccctctggaaactagtgttccctttctccctctctgtggactcctgccaatgggctccattctgagccttttaatggaatcagaaaataaagaaaaggaagaagatacatttcccatatattctatagttgcttttctaaactgtaacagcagaagatgtcagttcatctgctataattgtttgaatttgataattcttaaagatctatcccatcgtggtttgcagtttgccatggaaacttttagagagaggtgagctcgattttggaattgtgaaagacccttattcagcaaatatttaagttctaattgaaatatactttttaaaaagaatatgtaagtgcatggtctgaatgacttagtttttgaaatgtagtcaacattgtttatacagagtgtggaggcaggtattgctgctagctgtatacattctttggcccaaaaatgaatacagaaggatacagagctggttgtactggttcaaaagacaaacttttccaaggtgatatcagctaagattatacagtagggatcaaatgctaccctctcatccctcacagatttgtggtaaggcccagatgacatgctgtgtactccttgcactggaaagaccatacagattacacccctgctttgagggcaggattggggtggtgccagtgaggaagcggtatggggttatgggaagactgtaagctttggtgtcagaatgacctcagtccaagtcccagcttcatctactctctgtgtagccttgagggtggacttctgtgtttccattgccttatctgtaaagtggggataatttgctgtctgcagaggattgtgtgaggattcaatgagtgtgtatggtgcctggtaagtaagggtagggactcagttagtgttagctgccatcgtcatcttcattgtagctgtcgtgattacagtcccagaccctctgcagtcctggagcagcacagagcagggctgaggtccctgcccagaacagtcttcactcaccacatgctaatgtttgttgatcctttggattccttggtatatttctgtgttttaataaacatctttttcttataactttttatgatttttgagttataatttatatacaatgaaattcacttaagtttcatttcagtgagttttgacaattctgtatgctcatgtagtcaccacccaaaatagatatagaaaatccacacacacaaacacattattaaccatgcagaagcaaccattgatggctagcaccgtaaattaattcggcctctccttgtgcctcatagaattggaatcgtacagtatggcttgtttgtgtctagcttcttgcactttcatgttttcgaggttcttccatgttgttaggtatgtcatagttccttccttattgctcagtagtattccgttacaggaatataccacaatttgtgtgcacatcttcttcttgtttccattttgaggctgctaagaataagaatgccatgaacatttttatgcaggtcattttttgtggatgtatatgctcatcttctccctagaagtgggattgctaggccttagagcagctgcaaatggtgctctccagttttattctccaataatagctccaacatatggcaccatgttactctcctcactcatctgtgagagttccagttgttccatgttttcccacacttggtaataccagaatttaaaatgttagccactccagtggttttaattttaattttccttatgactgaagttgagcacctttttattggtcatttggataatcctcttctgaagtgtcattcaggtcttttgcccatttttataattgggttgtatatcttgttggtttgtagggattctgtatattgtctagatatgggttatctgtgtatcacaaatatatttttttagtctgttgtttgccttctcccctctaaatcatatcttttgattcttaatcaaagagcagaggttcttaaggaaatttattttatcaggttttctattattacttgcgctttttatgtcctatttaagaaatcgttctttatcccaagatcgtgaaaatattctcccttgttttcttctaggagttttattgttttatcttttgttttaggtctttgatccatttaaaattatttatatctggtgagggtagagatcaaggatgactgcccctgaccctagggaaatccaactcgtctatcaccatattgaataaccatcttttgcagtagcaccattattataaatcagcttactacgaatatgtgatctgttcctggactctattctgttccactgttctgtttgtttacgcttgtaccaatatcacaatcagttacttatatagtaagtgttgatatctgatacctggtagtaggtagctgttcttcttcagtgccttggccgttctaggtcctttgcatttccatgtgacgcttagaatgagcttcttagtttatacacacatcctcctgggatttgttttcagagtgccttaaatctgtagatcacttcagggaaaattgaaatctcaataatggtgagtctttcaaatcatgaacatgctatgtctccatttatttaggctgtctttgttttctctcagcagtgttttacatttttgttgtagaaatcatacaaatctttaattagatttattcttaggtattgatggttttttatgctattgtagtggtgttacttgtttaaatttccaattgcttattgtatatagttatagaaatacaactgatttttgtatattgactttgtatatctaggagcttgggtaaacttactcactgtaaaagaagaggagtgcatttatagattcttctgggctttctgtatacacagtcatgacaatctttatactttttttcttaccttattgctctgtttgatttttttctaattcctttatttttaattgacaagaattatgtgtatttatcatgtatatgatgttttgacctatctgtacattgtgaaatgactaaatcaggctaattaacgtgtattacctcatacactttcatttttttgtggtgagaacacttaaaatctacctttagcaattttcaagaataccttgttattaattgtagttaccatgttgtacaatagatctctgttgtttgttacaagcatatatcaattatttttaaatgaaaacaagtccttttatgacagtgataaaataggagtttttatttttggtttaatgaccttgttgggtaaaatggaaagttggcaatcctataatcaccaaaattttaagaagtttagttgggcccccaaatttaaaacatttgagaccccctgaattggttaactttggacggtgtctctccttgggcctcagtttcttcattggtaaaatgaggttgacacatcagtctctgggacagcccctggtcctgtaacgtctttgggaagcagcatttagcctgataggattgttcgtggagatacccaggactggatgttaacgttttttctgcctatattgcctgggcttctcctcaccccaaaggaaccatatcttgacaggaacaacagaaattaacaaactttagagcctaagaattgctgcctgcctcattgaagatatttacctaatcagtccagattaaacataacagtgggaagcaccagagggtaccttgaaaaatttaaccagaaatttgtgtatttcagttattggtgagttgaatgtattgctcctgccatatatgaaacaaagagcattgtgtggcattgtcttccggaacatttttactcctagagaatggcaagctaagtaattataaaggcttattgtcatagacacaaaaagaggctgtttgacttgggcttgctagattgtttcctctgttttctctctggcctgtgacatcagaagttcagtccatgggggcatatgtgcattctagtgcctagaactgaaggaaacagaattggttatgccagaaccccaggcttgttaggatgggaaggaagctcagcaaactcagttctatcctgccccttcatcatgcagccgagcacactgagccctctgctgtcaagacaggtgcccagagttgtgcatgccctgatttgtgcatccctttctccacagtttccagccagagacgacactcttccatggcccggatacattccatgacaattgaggcgcccatcaccaaggtgaagcagtttgtggtctgtctccattgagcacacatactccttgttctccccaaggatcatttccaatgagaagaaacagggacccgcagtaatgagcatgctgtcatagttgtgtggtgctagtagcctcctctgaagagagaggatgtgtgacatgggcattttaactagtcttaagttagtattaagtactatggccagactgagtcctgttgggttttgttttgtttttgctgttatttgttttttagagatgtgctctctcatttctgttgcccaggctagtctcaaactcctgggctcaagtaattctcccacctcagcctcctgagtagctggaattacagacacgtactgccatgcctggctctcccactgtttttaaggttatgaaactcaagtattttctttccataatgtaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgtaagtatatttgactagactcttggctagagcctgtctgttcttggttgttttctcagaggttattcacttaaacagatattgaagaggcaggcagggctctgtagggttcagtcaagacctaaactctcctccattgcctgggttctgctattctctggccaagcacccacctgctgcctgcctcctagggagagcttagcttggagcagagcagggaggaatgtaatcctgacagtctgctgagcaccagttctccagtgttgcttagggcttctacagtagtttatctaaataaagcttgtttagttgtattaaagatcttcaaaactgggacagtgtagaacagaaagattgtctttctcccgccatatgtatttaaaatggtgccgggggtgcaacagtttggccttcaaagcatcccacacacatttagatgactgtaggaaagagggatttgggaatctttcactagaagggggctttgtgtcatagactcttgaggggtcctggatgcctccttcagcatgtctggtgtagagctctcacaagagagggacaactttgtgcagcacagattattccattgctctctgtcagcttttgtcttggtcagaagcaaaatccacctccctcccaattactgctttctgaagtcactggattttataaaaataaggttccaggcagaaatctagaaggtagagtgtttacaatgctgataatatctcactgtggtcttgcctatttgagacagggtctcctccagactgcaggtaagaggtgaaaatgatgagggatgggggtaggatagtgtcctggaggcgagcagatgagaatagccacaggactggagaaaaggggctgctgagagtacgggtttgggccaggtggtctggaagcagtggtgaggagcccaggagagtcaactgtggggaatgaggtcacttatgaggtgagagaggagctaatgtttccaggaaagcctcgtgtcctcagagtgaggagggttgcacgaaaatggaggagaaggactgagggcagagcacagttgtccctaagaaaccaaatggtcctggagtgcaagcaagaatgctgggcttaaagaccacccacccctcaaaagatgcaggctcacctcccgggtgttgaccttgctcctgagtttagcttccaacagggccaggaccatccttcccagcattagcctgttgtgctctccagtaagtgactgaggtcagtggtcaatcacaggggtggacctgctgggcccagggcagccttgagtgcattggtggagagggctgccctgagttgtcctgtgggaggaccacctggagtttccaggaaggaaagaatagttgtgacttttctttttcttgtttccttgatttttatcaggatggtttgcgaagactatcagggaatgaatatgttctttcaacaaaaagtaagtttttcctttttaatttcttagatcactgtctataatactgcagtctagcttaagtgatgaaaataatttttcacctcattaagaagtttcttggtatgtcataaagcctcagaaacaaagcagctgtccctgaggcggtactgtcctccctaagaaacagttaatcctggccgggagcggtggctcacaccgccgagatgggcagatcacaaggtcaggagttcaagaccagcctggccaacatggcaaaatcctgtctctactgaaaatacaaaaaattagccaggcatggtggcaggtgcctgtaatcccactactcaggaggctgaggcaggagaatcacttgaacccgggaggcggaggttgcagtgagctgagactgtaccacaacactccagcctgggcaacagagtgagattccgtctcaaaaaaaaaaaaaaaagttaatcctttaaagcctatttgttctccaaattacatcactttacagacactcaaatggtttcaagcaatataatcactcccatctcccttgatgatgtcccaccacggatagctcgggccatggaaaatgaggaatactgggactttgatatttttgaactggaggctgccacccacaataggtgagttcatgcagagctcagcagcgggagaactagattcccagggcctgtgtgaggaggctacctgaggagtatggattgtgcacaagcctggtacctggtcagggtggggccctaaggaaggagtaacagggcaccaggtggctctgagtcaccagggcctgggggagagtctgctggccacagtgatggcacattcatggaaagcatgcaactgagccagtgacttctccaagtagcacaggacttttttctgtgaaataaaggtatttctcctgtaggtggtaatatgttaagattgctgtaagagatctgctcagagcctagaaccaaaatttattagaaacacatacacatgtgataagagctgctcccagcttttggttgttctgttggtgataggcatagggacacccaaagccccagtcatcctcatctgggtgtgatcacagagagtgggagcaggaatggggttttgccttgagttttttcccttgcgggagaagagctgttaaccaaaggtggtagttggctgggcacacaagaaagggaggtccacagagctgattccagccaggactgcccactagggtgtctaggcagaggtgtgctcggttgggccatgggatggctcctcaggtctcatctcagtctgggtgacctgtccccaagataactccctgactttttcaggctccccttgagttaaccttctgatacgttctacttccctatctcccagcacagccaaggagagttgaaaagaatactccctgggcacatgagtctttgagcatctggtttacatgctagtgacattacatccatgtgaattgggctaaggcaggtcagtttaagtcctgtgatcacttctggatactgcctcaacacagccagtttcttggccttcacaggcaagggccagatgctgggtcaaggtgatttctcaagtaagaacctaacttggtggccagctggaaacctcaggggaaatcccctcatacttttaacgcccacctccagaaaggtgggtgttgagaaaattccattgcatacggcagtgtctggcttatatgacattttcaggaaatgttttcttataggcaggatgtctggccaatggcatgggtccagcaagtccaaaggagaggatagtgttcaaggtggtacaagcttagcctggagaaagggttattttgaggaacccactagtgcaagtaggaagctgaacctggaaggacagaatgagcaaactccccccaacaaatcgggagccccaacgaggctgaggtcagagctgctgtgggcagccagctctcacccgtgcatcatggtcccctgagggcaagaagtggaaccagagttggttggccccaccagagagaggccagcacagcccaagcaatctccactttgctgccctgcactctctgaaatttggcttggaacctattcaggccttaaacacttggcctgtttgtttgctttgttctaatattgtggggttttttctgtctataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggtgagctgttgtttacctgccacatttaatgggcaggagcagtggggagagtctagtgcttctgcctccactaagatacatagcatgactgctcacgtgtgcagcctggcacaggaagggcaaggtcatacgaggaatcaggcaggaggccacattagctttgggaaattgatgtgttaattcatgacataatcccagctattccatgagggtacaagaggcagaatttggtcccggaggagaaacctaacaaggacaggatagggctattcttctgggggtctcactccaagcctgtacactagtagagccaagtaactgttggatatccccactttagggcctccatctgtacatgaaagtctgcagggctctaaggtcaggttcatcatctctgttcccagcactgctcccacccagggttatctacctaatccagggttccattatccaaccggatacccagattagaaaccgagagtcatccttggttctttccactcctcaaccccccacatctggttgatcatctgaccttgcctcctgtcacacctaaatgttctcagattcatctcctgctgctgtcccagtgaggccccccgcaatcctttcgcatctgggcagttccaaactagaattcttgcctgccctgcctcccatggaatgcccttaccctactgccaatgtgatctttctgaaacagcatacctgatattgtcattcccaggagcagcttcccacctccctcaggatttaaactttaaactctacagctctccacactcacctcaacaatgagctcctctcatcatttcttctcctttgtcccagtcacaggccacttttgggccatgccaaaccactttagtttctgaagcttctgcccttgacctgttgctcccttgactggggcctaagatgactgcagtcatgcagggccagggcaagtggctcctggctgcatttcctcctctgtatcacgggactagcatttggcagagagcaaagcagaagatgacatctggcacacacagggagtgaacaagtgttcattcctcaccttgaagggtaaaccttctcagaactttccgtgctccctctggttcttatttctgtttttgttttttgtttttttccagaaaaaatcaaatcagactgtaggtaaaatagggtgtccagagaaggggactgttttctaaattatgaaaacaagtaacaacagagggacatctgtgtcaatatggctcagcatataaagaacccaatttttgctgtattgcttttaaactactctatagacaacatacaaatatatatttagagagctaactgaaaacagtttattagagcatttattgaaatgtcatggtggctcacacctgtaatcccagtactttgggataccaaggcagatggatcaggaattcgagaccagcctagccaacatggtgaaacaccatctctactaaaaatagaaaaattagctgggcatggtggtgcaggcctataatccagctacttgagaggctgaggcaggagaatcacttgaacccaggaggtggaggttgcagtgagccaagatcatgctattgcattgcagcctgggtgacagagcaagactctcgtctcaaaaaaaaaaaaacatttattgaaatgtaattcacataccatactatttgcgcacttaaaatttaaattattgaattttaatttaaatcaatttaaataaatttgcaaggctgatttattagctatacatctcaagagtctgtagggtatttccaaaaatgatcttatactgggacataatgtgttgaacttctaaacttcataggctatattttctaaccacaacacaacaaaatagaataactaatggttaaatttaaaatatcagctacaacaaatgagaaaatattctgaataatttgggaatcaacaaagaaataaaaccaaaaatgacattagttagaaaataacaaaaatgagaagcttatctgtcaaaacctatagaatgaagccaattatatagttaaaggtttatgttttaaatgccttaattacttttaaaagggaagaaaaaaaacatgggaaaagcaaaatgataatccagtgtggctcttggaaataaccaagaaaataggtgaagttctagccaaactagttaagatataaagacacaaaaatatacaaatttacagcagaaaatagaagtactgcacacatatgtactaaatcaaaagctttaaaatagttttaatggaatgttttaaattaaattgatgtaagaagtaaaaaaacaaaaaaaaaaaacaaaagaggccaataacatggaagtaattttagtaatttttaaattattatttaatttcttcaaaagttggctcctgacccagatggacaggtgaattctttagccctttaaggaatttttccatgttacataaaacttttcagagtcttgaaaaagatggaaaacttccagatcattttgtcaaactcacaaaactctgacatcaacctgacaaagatagcactaaaagggggaagaaaactaaatcaattcccagttaatgtaagtggtgcctattttaaattttatttaaaattgtttctctcctttattaatattagtttatgctggtctaagtcaatatctcagactaaggacttttttggtgatgggtctagagaaagactggctgaggaggtgactcctatctgttgagaacacctgtattttggtaagtccttaacttgtgtgagactaacaaatatgcagaaatataactgtttcagggtggagataggaaaactagatttgctcacgtagtatgcttttcttagaaatctgaaatattcttacctgaaagtaataggggagaaagaaaactatacagaaggcttccttgccttcagtgtcataccccagtttttaaaagctctcttgttttcaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggtaagaacaatgattgggaagtgtgttgatccctctctttcttttttaaacagctatattgagatataattcacatcttatacagttcacccatttaaagtgcacaaagtatacagtgggccggacatagtggctcatgcctataatcccagcactttgggaggctgagacaggagaaatcacttgagcccaggagtttgagaccagcctgggcaacgtagggagaccctgtctctacaaaaggaaaaaaaaaattagccaggctcggtggttgtgtctgtagtcccagctactcgggaggctaaggtgggaggattgcttgagcccaggaggctgaggctgcggctgcagtgaaccgtgatcacaccactgcactccagcttgagcaacagagccttccctgatctctcatgctaagttaaaccctctaattattcaatcccagatttcttcatagcacgtatcacatttcttatttaataattactttttaattatttgcgtaatgtctgattagattcttaagctctgtaaggtcacaagggtcatatgtcactgtgccctcggtgccctcagtgccacagtgcttggtacatactagagcgagaccctgtctcaaaataataataacatgtacagtggtttttagtatattcatagtggttttagtatattcatagagttgtgcaactcatagtatattcaattttagaatattaccccttcgatagaacctcaaatttatgagcagttcctttccattccccctcaactcccctagtcctagacaactactgtgatctactttctgtctctatagatttgccatttctggacattttatgtaaatggaatcatacacaatatgtgatcttttgtaactagcttttttcacttagcacaatgtttttaagattcagccgctttgtgtctggatgtttcaaggtgaagtataatgctgatatcttgagctcttagagactcaaagaagcagtcatctatctctctccctgaagcactccactctgccctcctgtgctcagcatacatctccttggcattgtctctgtttacatgtcacttccttggggaagccttccctgatctctcatgctaagtttaaccctctaattattcaatcccagatttcttcgtagcacgtatcacatttcttatttaataattatttttaatgatttgtgtaatgtctgattagattcttaagctctgtaaggtcacaagggtcatatgtcactgtgtcctcagtgccacagtgcttggtacatactaggaacttagtgaatatcagttgaagaaagaaaaaacattgtgtcatgaagaatacttattaatatggatttttaaagaagaggatttttgattttgtaaaactcctttctgccatgttctaggatttcagaggtggagttaaagtagtttctattcatatttgcttatagttacatcagttatcaatggaaaactacatgagaccctattaactttccagagaaagttttctactcaactgcagaaaagggattgaatagagactttgtttcatattcataccccttcaaattttgaattacatggattaccccttcaagaaatgaattttttaaagtactaaaataaaagcaagggttagaggtggaggtatcaagtactccctatgatttcgcagctttcagaagatcggtcctcacattctatgggcactaaaatggttgggcctcaagacacctccatgtggggtatattctttctaaccacagatttctatcttcattgacaagataaacactgcaactataagttttgcctatagcttttggttttaacttcttttgaggttctccttgctaacgatctaggcactaacccctaacttccatgtctttttaaaatgtgccttgtggctttcagtggcattagatttatagctgcagaggacacatacctggataacagattgttttcaggagtacctgtctggtctggatcagtaatttgtagcagcctctaatttgtcatcgaaaacaggaatgattatcggacactgcgccaggggattatcgacatggtcttagccacagaaatgacaaagcactttgagcatgtcaacaaatttgtcaacagcatcaacaaacccttggcaacactagaagaaaatggggtaagggaaacttattgcaaagagaacctgtgtttggggtccttgtactgttgtgttatggagacacatgggctatgatatcagccacagaagggttccctcagtgagtctattagactcttacagggacagaactaatgggatacacacacacacacacacacacacacacacacacacacacacacacacaaaggggagtttattaagtaataacttacacgatcacaaggtcccacaataggctgtctgcaagctgaggagcaaggagagccagtctgagtcccaaaactggagaacttggagtctgatgttcaagggcagagagcatccagcatgggagaaatgtaggctgggaggctaggtccatctctccttttcatgtttttctgcctgctttatatttgatggcaattgatttgattgtgcccaccagattaagggtggatctgccttccccagcccactgactcaaatgttaatctcttttggcaacactctcacagaaacacccaggatcaatactttgtattcttcaatccaatcaagttgacactcagtattaaccatcacagtgggctcactgaatttagtttttattggttaaaaaattatttaaagtgcaaaaacttggcaggaaaaaaattagcacatccaactagatgggaaaactcgaaaggaaggtcagattttagataagctaactttagacagactattcctgcacccttcctcactaatatccccctcccttcttctccattctgtgatcagttggagcccttgatatatctttctagccactcccactgggcacatatcatggtagcagcagctatcctctcttggtcctcacttagaggagcatgtggattgagaaagacactgtatttgtgtcacaagggtgacattattgttgcccctgtttctacatttgaggcatggagtccacaacaactgctgggcaaggataacattaaccctctcaccaggcaggagtctccagctgaggaagcatacaggcccaagttcccatcatttgcttatctgtagaatggggataagaagtctcaaggcataggactgatgagcatggtacatggtaggcacttaagaactggtgcctattatactagattcattgtgtcatcagcaacttaaagaatatgttctttcatgaacctcttcctttgaggcccacatttactgaacatgttggcagcagctcacagtcttctctcccaccctcctccccagctcctatcaccatcctgagatatttgccacacacagggatgacttatcctcgcaggctaggatcataattccttgacttctaactccattttacttctgcaattcatttgtttggccatggcctttgtctgccccctggttttctagcatattaccccatgacacttactttggtttaacctgatgttgagaactgtttcttcaccctttcctgttctctcaatttgtcagcctgcccctgacttcactctctttccaaagacttttaacagaggtgcctgtaccagcctgttttattggctcctgccctgccattctggatagggctcattgtcacctggccaccactcctggctgacctcatgccacagaaggaaaccatacacccagcagacttggtttcctctgtctagtctggacagcccctagagctgagttctctgctccacttaacattatggttctcatctctgttgtcggtacatggggttacttctgagagactgaaaatcaatatccagtgggtcagagcaggagaaaggaagatgaaagagaatagtttccaggctggcagtatgaaactatagtcacactgcaggtattaacggatctgaagaaagaagggtcagcacagagctggtcacagtggaaacctggagtgaggagagctactgaagtgtcaccggtgtagtattcattttggcactctccaggaagtgtgggaagcctagagtcaggatgccacccgtccatcttgatggcagtctgttccctctgagctgggaccatcagggcttcttaggctactgctattgcatattgaaatatatgactaactcctttggaatgttgcttgatgggcacagaatcagactgaggagacctgcttgcctttagtctttttcattgctctctgccccaataccctctaacctgaattctcttcagagagcctacaaatagtggttctattacatcataaattgatccatatccagtggggatccttggatgcagacagcatgtggtactgtgagtggaaggcatgctgggactaaaggcagaactgaagttcttatcctggctcggctggttgctttggacaagtcacttcacctccctgagtctcagtgtcctcatttgtaaaatgtaataaataatacttttcatgcttaccattagatcttcttgtgagtgcagatcaacagagaatgactgttaagtcctttatccatcaaatatgttaggtgttatcttgggaatctgccctatcacaggactgggttgagaagtacggaggctgttgggctgcaagagcccatttgttgtgagggcagagaaatttatttttttcagctcatactcttttttaataaatataataaaagacaaaaccagtctttgagttcttaccaagggggagagagagagtggaacagaaaaaaaggcaactgtgagaaagatttagtgagaggaagagaagaaagaggcaaggaaaaggggaagggcagatataccaacccctagtgctaccctccacttctaggtcctgttgcaatctcactgagcctcggttttctcctgggtaaaatgagaggccaagctcaatgctcacagtatccttggcactgttttgtgagatccttatagatcctgactagtgctctttttatgcttacagtgggacagaccagtaagagagggcttggcaccaagggatccattttgattgctttgaattccactcatgtttcaggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcaggtaagttgctgcctcttttaagtttctagagagagagagagttaaaacccataaaatcatacgagataatggacttaacactaggaaatagggttctaaaaaaattctgtccttgttttgcaaggtaacaaatggtaactggtaacaaattttttttttcttaagaatattttattttccctttattcttgcaggatatttttgttagatatagcatcctgggttgatgatttttttcctgaaagtacttttaaggagtcatctggtcttcatattctttctgagtagaaaaaacctctcttggggcagaaaaaaatattaggaaatatactggctaagatttttccagatttggtggagggcatatgcacatgcatatgcatacagattcaagaagcccagtgaaccttagcccatgtcagatgtgtcatagtcaagcagctaacaggctaaagataaatcttgcaatcagccagaggaaaagcgacacattacttataagaaaacagtgattctcatgtcctctgacttcccatcaaaaactatgaaggccagaagacacgggaacatctttaaagtgctgttagctttgggaggatcacttgagcccaggagtcttaagagcagcctgggcaacatggtgagaccttgtctctacaaaaaaattaaaagttagccgggcatagtgatgcactcctgtagtcccaagctacttgggaggctgaggcaggaggatcgcttgaagcccaggaggttgaggctgcagtgagccatgatcatgtcactgcactccaacctgagcgacaaagtgagaccctgtctcaaagaaaacatacagctaacattatatttaatggcatgagatattgaatacattcttaagattggaaacaaggtaagggtgcccattcttacctcttctgttcaaccttgtattggtgttcctcatcattgcaatagacaaaggagagagaggtttaaagaacaaaaagtaagacatacatttgcttctgtttgcagatgacatgattttatgcagaaaattctaaggaatatacaaacaattattagcactaataagtggatttgatttaccaatgtcataggacacagctcaatatacaaaagtgagttgtattttatgtactagcaaccaacaattggaaaatgaaaccaaaagcccagtcccatttacagtaggaaataaaatttaaaaattaaaattaggaaaaaatttaataagagatgaccagaactttacagtgaaaaccataaaacattgctgaaaattttaatgaacacttgaataaatggtgaggcatatcatgttcacatactggaaggctcagtgttaacattcacttctacccaaattggtgtttcaattcaaaaatttcagcaggttttttttctgtggaagtctacagactgtttctaaattatatatgaaaatgagaaggaccttgaataagcaaagcaaactttaaaaagttggaagatatgccctgtttggcttcaaaacttaaaataatcaagaaagtgtggtgctggcataaagataacaagtacaaccatgggacagaatagaaatccaagaaacagatcacatttatatgatcagtggctaatgtgaaatttttgcagtaagtggtgttaggataattggatattcctatgcaaaaaaaaaaaaaaaaaaaaagaaccacaactcctatctcataccatagagaaattcatagacctacatacaacagctaaaaccataaagcttttagagagaaacataccagaatatcctcaatgacttgaaagtggacaaagatttcttagatgcagaaagcaacaaccagccaggtgcagtggcttatacatgtcatctcagcactttgggaggccaaggtgggaggattacttgagtccaggagttcaagaccagcctcagcaagataatgagaccgcatcactagaaaaaaaaatttttttaattagttgcctgtggtggtggcacgtgcctgtggtcccagttgcaggaggattgcttgagcctcagaggttgaggctgcagtgagccatgattgtacactgcactccaacctgggtgacagagcaagactgtgtcttaataaaaagaaaagagcaacaaccataagaagaaaatttgataaattagacttcttcaaaatttacaaagtttgctcattcaaaacacagctaagaaaatgagcaggcaagccatactggaggaaaatatttacaaattatatttgaaaggactgtatccatagatatataaagaactataactcagtagtaaaagataaaccacccaatttattataggcaagtatttgtccagacacttccccaaagaagctattatgaaaagccaataagcacatgaaaaaagtgctgaacatcattagtcatctgggaaattcaaattaaaaccacagtgaaataccactacacacccaatgggatggctaaaaatgggaaaggctgacaacaccaaatgttgaagatgtggagcaactagaatgcatgcatttgtgatagatgtgtagaatgctacagtcactttgggaagcagtttagcagtttcttttttcttccttttttatggtaaaatttaccattttagatctgggttttcttcccttcattctcttcatatggtatatcacactgatcttcatgtgcggaaccaatcttgcatttcagaaatagattccacatagtcattgtgtataatcctttaatatgctgctgagtttggattgctagtattttattaaggatttgtgcatcagtatttacaggggatattggcctgcaattttcttgtagtgtctttgtctggctttattaggataatgctggcctcatggaatgagttaggaagtacttccttccttttcagtttttctggaagagtttgagaaggattgatattaattcttctcaaaatgtttggtagaatttaaccagtgaaaccatcctttcttgggaggtttttgattactgattcaatctccttgctagtcattggtctattcagattctgtttctttatgattcagtcctggtaggttgcatgtttctaggagtttatccattgtgttggcattcagttgttcatggtactctcttataatcctttttatttctatgaaacctggagtaatgttcccactttcattctgattttggtaatttgggtcttgtctttttttcttagtccatctagccaaagatttgtcaatcttgttgatcttttcaaaaaattatcttttggttttgtttttttctgttctctatatacctctgttctttattatttccttccttttgctagcgttaggtttagtttattctttctgtagctccataacatgttaagttaggttgttgatttaaaatcttgtaggcatttacagctgttaatttcccccttatcactgtttttgctgcatctaataacttttggcatagtgtgcttcattttcatttgtctcaaagtattttctaatttcccttatgatttcttctttgaccccttggttgtttaagcgtatattagtccatttgcattgctataaaagaatacctgaggctgggtaatttataaagaaaagtttattttggctcatggttctgcaggctgtgcaagcatagaactaacatctgctcagcttccggtgagggctcaggaagcttatgatcagagcaaaggaagggggaagcagatgtatcacatggcaggagagcagggggaattgccacacttttaaccagattacctgtaaactcagagcaagatctctcattaccatggggaggccactaagccattcacgaaggatctgcccccatgacccaaacacatcccaccagaccccacctccagcactggggattatttttcaacatgtgatttggaggggacagacattcaaaccatatcaaagcatatgctatttaatttccagatacttgtgagtttcccggttttccttccattactgagttttggttcatttcactgttattagaaaaggtactttgtatgaccttaccttttaaaatatatactgtttgttttgtggcctatcatatgttgtatcctggagaatgttccatttgcacttgagaaaaaaatgtatactctactgttgttgggtggatgttctatacattctgttaggtccagttggcctagagcattgttcaaactctattgtctcattgttctattcattataaaaatgtagtattgaagtctccagccattattttagaagtatctgtttcttccttcagttctataaatgtttgcttcatatattttggaactctggtatttgatgcttatatgcttataatcattatatcttcctgatgaattgacccttttattaatgtccttccaggctggagtgcagtggcacaatcttggctcactgcaacctctgcctcccaggttcaagcaattctcctgcctcagcctcctgagtagctgggattataggcacgtaccaccatgcctggctaatttttgtgtttttagtagagacggggtttcatgttggtcaggctggtctctaactcctgacctcaggtgatccgctcacctcaacctcccaaagtgctgagattacaggcctgagccaccgcgcctggcctgtaacagtttttgacataaagtttattttgtcttttaggatacccaccccagctctctcttggatattattttcatgagatatctttttccatcctttcattttcaacatatgtatgtcttgagagctaaagtgattttcttgtagatagaatgtagttggatcatgttttcttatccattctgacagtctgtggcttttgagttgaatctatttacacttaaaataattactgatagggaaagacttttgccactttgttagtttcctgtatgtcttacagcttttttgtccctcttcctccattactgcctcctgttgtgcttatttgatattttgtaatggcacattttgattccctttttctatagatagttgcattgtggataccatagagattgcataggacaacctaaagttacaacagttggttttgatgtcaacttaacattaattgcatacatgaactcttatatagctctaccaccccactccattttgtaaatgtcacaagtaatatctttatacattatatgtccattaacatttaaaattatttttatgcatttttaaaagtaaagttacaaaacaaaattgtaataatgctgctttttatattttcccatgtatttaccattatcagagatctttatatcaagttactgtctagcttccttttatttcaacctaaaggatttcctttagcattttttgtaggtcaggtctaatggtaatgaattcccttggcttatgtttatctaggaatgtcttaattcctcttttttgcaggacagtttgcctgaatcagaattttcagttgacagttttttatcttttagcacttcatatatataatttcactgccttctggccttcaaggtttctgctgagaaatgagcagatcatcttattatctcctatatgtgatgagtcttttcttttgctgctttcgagatcctctgtcttttgactgtttggttatagtgtgtctcagatagatctctttgggtttatcctacttggagtttatttagcttcttggatttgtagattcatatctttccccagattatggcattttttggccaagattttttcaaatatggggtctcactatgttgcccaagctggtcttgaactcctgggttcaagaaaccctcctgccttagcctctcaagtagctgaggttacaaatactgtgcctgttggctattatttcttcaaataatctctgtccttctcttctcctcttctttttgctgaactcataagatgtgtattggtccatttgatggtttcccataaattcattaggttctattcacttttcttcattcttttttctttcttctgtctgcccatatctgatactgaacccctctggtgaagtttaatttgttttttgtatttttcagccttcaaatttgagatggagtttttgctctgtcgcccaagctggagtgcaatggtgccatcttggctcactgcaacctctgcctcttgggtttaagtgattctcctgcctcagcctcccaagtagctgggattacaggtgcccgccaccatgcccagctaatttttgtatttttagtagagatgaggtttcgccaggctggtctcaaactcttgacctcaggtgatccacccacctcagcttcccaaaatgctaggattacaggtgtgaaccaccgcacctggcttgttaggttacttttcataatttctctctttgctgatattctcactgtggtgttcacctgtcatttcctatagttcctggtctgtgtgtgtgtgtgtgtgtgtgtttttaggtctttgagcatatttaagacagttgttttcaagtctttgtccagtgcctgtacatctttagggacagtttcttttcttcctttgagtgtaccatattttctagtttctttgtatgccttgtgatttttgttgaaaattaggcattttaaaaaacagccacctctcctagtctttgaaaactgtctctcagccttacaattaacccatcatgaaagtttaaagttttctcaaacattttctgagcatgtcttgtctgggtctgcatatacatactcttcttaattcccctatatacacagctgctttcagatgtcttaatttcctgaagtgtcttgtctgaggttatcctcagggccttagatgatctgttgttggtctccgctcataatctcttgtcttcaggcatccatattggtcatccccctgcagctttcctgagcagtagtcattgcttttctacctgggagctaagtgaaacagagaccaatccttcaggcagcccacagacttgtcagaatgttgcaaataaggtctgctctgctccctccggttcaagggacacagctggaaactgggccgctgcctcctccagaccaagattgtaccacactggggaagtgtggtgcaaggttgagtgaaaatacccttaagtttcctgctgttttgaatgtggcttttcttgagtgggcattcacttggttgctgtagacttttgactgttttccagagttcctgtaaggttattttagccagtctctcatttcatggagaaatgaggacttggagcttcctagtcccccatattactgatgttactccggtgctcaggctttgattttaaagtcattaagacattaagatacagttgcttcttgtattcagtggggttaggtttgcaagttcaccccttatagccaccctgtctcttgaatagcatggatactaagagtgccagggcctgaagcaaggtgaagaggcatctctggtttgtctctggctggggctgcttgacttcatggggagtggggcttgagtaccacttgcctggctctgtgccaggtgttgtacagtcttttattttcgcttggggcacagcggtgaaatgtgaaacttgtagaccctgccttgcaggtggggtcacagaaaggaagcatctacaggtgtggagttctcactggtgacttagatgagggcatgggccacagtttgctggtctccaggagggaacgggggcccctggacgttccatgcacttgtcacattgggccaaagagaagaaatctaagcacgagggtcttcactgaccttcagccagccagctgcttacatgtgaatagggagggcaggccctgagagcagaaagacagaacagcctctggatgactgagtggctgagctaacggagcctttgccatggctgcccagagagagctggcttagggtctagcgtgaccaagggagggcacatcaggagagcgccccgcccagggcactgctgtttgagctggacaggcccatggggtgtgaacccaaggccctccctgcgcccccaccccttcctctctataccatggcagagactcgtgtagggctgactgcttttcttagacagcagtggggctgccaacagcagggccttcaccacagccagcggatgctgggccagcgttccccactcctcttaccaaagcacgtgaatcccatatgctgaaccaccagaacagcaggaactcttctgacttttgctcagtcccacagtctagcactgttcacctgactttcttggcacttgtccccagcaccgtcaacacttacctagcatacacgcacctctgggcactgtgctaggtatggtgccatcctaggaaaacctccagaggttcgcctgcttctctcaagtagagagcccatatggagagccggagtgagttgttgtgcacagggcaaggtgcagaaatacttggtagagccaggcctctgggtgtcactctgggagagcctgaggtgctgggccaggtgtagtaaggaagatgggagaagggtgactgagtgcacagaaaaaaggcaatggagtcagcgactttagggagctccacgcaagtgccggagctggtgccgtagagctgcggtggggggagagagatgctgggacgagagaactttctgacctggcatcccctggagggcctgtgagtgcaagcatgggaacgttctgggcgaggtgctgcagccatggtgaggccctgtggagcaagggctaaggggaggagctgcgagtgagttctgccagctaccagagcctggctgtgatggggtgagctctgctggccatttgggagctggaagttcggctgtgagtgtagaagacacgtcttgtgagtggccaacagtgggacgagacttcagtggttagcaagtggttagcctttcttctgtgcactcagctacccttctcccttaccacacctggcccaacacctcctcaggccctcccagagtgacccccagagggctggctctaccccctccagccctggcactggggagaaaggctagtgttcaatacaacagccaccatcccttcacccggccccacacatgtactagggtcccatctagaagagctgctccccccagcccactcctacctcactccatctgcgctcaccctgttctcatcctgccccactgtttgacttgactcccagcacaggcgccctggcacagcagggatcttgcagcgattccggttgcacatccacaggggcttctaaagaatgcactcaggacttctggcctcattcccaccccatggaccttacctcacccttttctccagcaccattgggccaaaatgagaccttatcaaagaaagaacaggacgcttgcctttttcctcaggttcttaattatgtttttagttttttgcgagtctctctgaaatcctgaagatgtggaagagtttgactaaagtacataaatactcagagctctttttttttttaaacatccaggatctcaagggtgttcagaaccttttcaaaaaaataatttagccatagatgagaagcagccactaggcccttccttgtaaagtggcccctgtgtggggatgcttcaagccaggtggaaggacggctggactgtgataggagtgagaaaagaacagatctttttctttgagggatgtgagcccccttagttgtcagacccagagaggcattgaaatgtgacagcagttacgtctcactccccaccctgacctaagtaatcgcctgctctgtggactctaggccagtagcctgtaaactctgtatattaattttgcctcagtttctttaggtcaatacgaacaacagagcggtggctgactacacataatgtttgggatcttacctgaagagcttctgcaaggaggcttccagatgtttaaagtttggcttgagttggggtgtcctcagaccccactgacatggagtagtcctcattctgagaacttggtatctgttatgagacatggtttggctgcgtgaggtggtgattggcttctcaccatgacaagccaccttaggctgccaggagaagctcttcctgggggaggggctgcccctaggtggagtggaaccagatgttggggtctcctgatcacattttctgctttacagactgatgaagagaagcagcagggcttacctgtggtgatgccagtgtttgacagaaatacctgcagcatccccaaatcccaaatctctttcattgattacttcatcacagacatgtttgatgcttgggatggtaagaaatcttccttaaaatagcatattttcctctaaataatggggaaccgcgtatgaaagagcagagtgcatttgactgtagaatatgatttggggcctgggctttcaagaacaagagcgaagtgaaccatcaccgagggcccctgagggctaggtgttctttcttaacactccccgcaggcataggtgtctttatgcctgttttatagatgacgggattgaacttggggccccacagcttgtagtagagcagctagggttcaaaaccaatcgtgctggctccaaaacccatggtgtttctacagcagccctttgccctccactgtcccctgcttctcccagcctcactctacacaagaccagaaggactggtctgtctctgactgatgcatgtcaccctcctttaacttcaggtggggcacaggagtctgtcaaataaaagaatatcggagaactgatattccacgtgcatcttcgtcctgagggctgcaccttgaaggaggggctacagggctgataaatgtccagatccagtcaggaaataaacccatgtctcaagaaggccgtagaacaggggtaggcggctggggagaaggactgaagcagtggagctagatagctgcagctttgggggacactgcatactctgcagctcactgcttctgggactgagaccagacgcgtgtgtccccaggctgcacgttcttcatgtggtgcaggtgaaaggagatgctggtgtatgtgaagcatgcgtgaagggacagtgagcacacaagggccaggccatcggttggggcgggggggcaggggcacactacatactgctttctgacaccccaggcccaaaggtgctgctggtttaatggtaattaagcagattagccaccttctgttttatttaccacagttaccagctcagcaggtggtcacagaggaggtgctggcattgaggacagggtttaacttcagtcagccacggctcgttgaagctgctgggtgtgtttgcccgggtctgtttagcctcacgcagatgcctgctcccatctgtcactctttaaaatgctcttagtgaaagcctaaaatgtaaacagaggctgtgaaagcatatcacattcctatctttctctccagcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaatca
